United States Patent 7,868,149 (PLANT GENOME SEQUENCE AND USES THEREOF) - sequence listing, part 11

SEQ ID NO: 5249 - DNA, 21457 bp, Oryza sativa
caatgaagtgtagtagtagtaatttcttctgcgcaatgaccttgtgatctgcaatgtttgtgtaggattcgcggccagctggccaagtgcacgaccggagtacacctgcaccgtgttatctacaggggcgcgtgcgagccgtccaagtgatacgcggactgcgccgtggcgtacaagggcgtaggcgaaggccagtgcttccctcagcaagggtgcaagtgctcctactgctgcaagccgtagccgcatgaatccagccaggaatgggagatcgaacgctgaagttttcattttctgttcttactgcttctgaactctgatttttttttgtcactgagagaggattctgatgaactctgaagtttatttgaaagagggttttgaactctgaagtagcatgaaaggtttaaagttatgatctggactcgcacatgaaagaaacaatcgatcgtgtggtttcgtggacaaaccaccatgtcctgcaattaaacttggtagtggtaggattgtcattttcttcagcactaacaccgaagatgaatggatcggactgagttttcaaagaaaaagaaaaaggatcagacagaccatgaaaagcgattgacgcgaaaaaaaaaagattaactagattaccttaaattcatcaaattaaatgatgttacacaggcaatacttgagaaacaaaaaaaaacttattaaaattttaaaattcgtaaacttctaagatattacagaaaaagtaaaaatgacggtatgtaaattcaaaagtaacctaaggaacatacttgatgtgcggaccttagttttataaaagggtaatttttttatccttaaaaaagtaccggagttgccatattttctagtataaaatttgatacctcgaggcacataaaatttagtgtaaaatttagatgcctcgaagtactttttcaagaaccataaaatttctctttataaaatccttgagcatgataagttattgagtgtaagaaacatatataacaattgaccatcttctatggatttaaagatgcataccacatcaccattcttcctccattggaatatccttgatcttgatggcagatatactagtatatgggccctatttggggttgtcttataataggtgtggcttctttcagaatctctaattctctcaacagtccaagattttattcagattatgagagtatgtattataaaattcagaaaataaactagaaggtaaaagttgggaagctcatctttttgtattatcaccagctaactaatcaccacatgcttcttaaaatagttgtgatcgaagtgatagacttaattgaccctgcaaatcaacacaccaattattggagcctctaaatttataatcgcggactaaatgattgagtatctgagacaagataaatgacacttggtaaataaagcccaataattttagaggaaaatagagctagggacgagctctggtcgtgggggtggagaaaggttcacacttgagatgaggcttaactattacaaggtccaagactcaagttaaagttcggtttcagcagtaccattgtcttgttttgacgatatccgttaactcaatatgaatttcgatgtaaggttagatgaagtggaaatatgacgaggtaagatttccgtgaagtatcacaaagtgatatcctaatcataaattaagaggtagcacacgccttatgtccaaaaataaataaggtgtaaaatagcatgccttattttggcataaacatatgttttagatctttattagaatcaaagtattgatggtatatcttatcccatgaaaaataataacattccgatatggtaaacacaacatcagtataaaacacctccattacacacactgtatatagtactaccggaggtagagcaccatcagacacaagcaaaattcaggatagcaactactgatccaacgctcggccaacgtttgctggagatgaagactagccaactactagcactgctctttgctcttgctgtcgttcttgcggcggaagcaacaccttcagattcaggtagtctcgtacatatatgttacctgcgtctaaaaaagaatttattccccgaatatttatccatattcatctaacaaagtaaagtcccttttaaaaacggaggtagtactattttttaagacgctttaatttgatcatctctacaccaagtatacacacacgtgtgtatgtttttctctgtatatagtttttttttctcagaattgttcatcgcaaaaaaaaaagttattggaaattgttgggcagagccctgagcgagagccgcttgatcctccatttgtgcaggtggcgtgaatacggacgagtgcattgggcggaagatactgaaagtgccgtgccaacggtgcttctcggaatgcattcgctcgtactcggacgggataggcacctgcctcgacgagaacacatgcagttgcgcctttggctgcggctttaatccgcccaaggcgtcgcccccgcctcccagcgaactgatatgatatggaaatgacgtttatacatgtccatgtgctactgcacatcaagctttgcttgttagaacttcgtgtcttcttcttcttctgatcgtctcacatagacatgtgatgtgatcaggttttgaagaactatatgatgctactggttgctttgttttgcctgtatatatatataatgattgatgaataagaatcatttctttctttcaaagagttaccgctccattcagatggactgtttttaatttaagttgttcgtgtttaatcttaccaatctttccacgcagcaatgaacctgcacaggcacctgggccatgctatggaattcatatatcttctgcattagaggggtactaacgcagaggatgagtagtactgcgtattagggatactgtaaaccgtccgatcgagaacggaaggatcaagtcatgcgctacagtattttcgaccctatagttatagtaaagcatcactgttcatggcattaattcactgcccttcacacgaacagactgtaaacgatccggatccatatgctatggcggtttggcctgagccgtccaatgggataaggtggttttcggttggactgtcattcccttaggactccggtctgtgcgtgcagtagtgttggggggcaatatatataaaagagtaaagtccatcaccggtccctaaacttgtaccgctgtgtcatcctggtccctaaactcgtaaatcgaccgttcatgtcctcaaacttattcgactatgtcatcccgatccctaaacttatagatcactcgtttaggtcctccaacttgttcagttgtgccacctcggtccctaaatttggatttgaatatcatctgggtcaaataggacggtctaaagactttatatttaaaaataattcataactttttcatgtgaactctaatgaagataaactttatatcaaacttgtagccctcaacacgatctacaactttgtagttgaattttttttattttaagtcattttttgtcccaaaatgtaattttaaaatcaaaattgcaaaatctataaacatgcaacaatattttgggaccctaaacagttttaattcaaaaacttttcaactacaaagttgtaggtcgcgtcgagggctacaattttgatataaagtttgtcttcattagagttcacatgaaaaagttatgaattattttttgatataaagtttttagactgtcctgtttagggaccggggtgacacaactgaacaacttggaggacctaaacgagtgatctgcgagtttagggaccgggatgacacagtcgaacaagtttaaggacctgaacggttgatttgcgagtttagggaccgggatgacacatcggtacaagtttagggaccggtgatggactttactctatataaaaaatggaagctactaaaatgtacgcgtgtcacttacttaagttgtattctaaacggtacttaattaggctgtgttagccaaaacgagttgggaacccactcaccacttttttcacgcgcacgtttttcaaactgttaaacggtgtatttttttaaaaaaaatctatatgaaagctgtttaaaaaaattcatactgatccatttttaaaaaataaattagctaatacttaattaatcacgtgttaatgggccactccgtttttcgtgcgggagggattacttcacatcccatactaccgaacacacccttagatacggtagcttacttgttcttcgtaaacacatttcccaaaccactgttgacgtaaaacacgaggcctgggagatttgcttaactccagtgcaggtccaaagcttgcctttgggtgtgttagcgtgccagttgatttgatcctgcaatcaacaagaaatagaaataaagaaatcgcggttaattctataaataatagccgatcggctaagtgccgatgacatatcatttatctttgagccgatgtcatatgtgaatcgttcggcgactataaatagataataaagaactaaacctactcgattggctgtagatattaccaatatatagttcttatatcgatatatatttaaatcaagtgattgggatagatcggtcgccatgccgagacagtataaatcacctggatcgaaatatatattaataacaggactatatatgtttatagcatagccgatcatatagatctagcatgtatcggctaatactccgatactactctatatcaggatattaaaacaagtataatatatcaaataaaagcttaatatacttaaatataataagatctttgacataaagggcggatttaacatgtcattgaagcatatagagcgaatatagttaaatcaaataagataggctgaaactccgatactaccctaatcggcaaccagaaggcaggctagagattgatattctaagcacgacttaatagatcaaactcaactgatgcagcattaagtatgaaaagaagaacaatatctagacaatcaagccgctggaagtttcatagagtggtagatttcttatataatctaaatcaacatcaaaatctaacctaatcggctgccctctactaacagatgttagccgattataggttagatagcgatattgccagagattatgtatgatatatgataactcgacgaattacgtaaacaagattagagtatcataaagatggaagcactaatcccgagaacacaagccgtcataacaagttttacctcttgttgaagatcgaaaccgatgcagctcaacccgaaagcaagaactcgtcgaaataaaactaaagcaaaaagatggcgatgcgccgaaattgtattgaacgtgtgtgtcttttttacatagggctcagggtctatttatacccgagaattacaagatatgtccatatcggacacgactattatctctaacaaactctaagataccataagtctttgcggcagacttttgccctaagcatatctctaaggaaattacataaaacatcctaattaatagatacaattgccttttcaggactctatgcacgtgcagcaatcatcttgaagcatatcaactcaaacccaatgttggatacgagtcatattgctggaatcggctatatcacctaacccagtctgattcagatttagccgattctagtcgtagccgatctcgatcccatcttcacctccgatgttgatattaccaaatttggtcgttaacaaccacgaaatagtgtatttcgtgcaaaagtctttatataaaagtttttataaaaaacaaatttatttttaaagtttataacaattaatatcggattaatcatacatgagtgacttatcttgtttttgactgccaccgcaaatttcggttgacaggcagaacgagcgcagcctttactcctactacttatctcttcgatgatttatattccaaacgttctccatgtcacgcggtacatgcgctttccattccttgtgaaaattgacgataagcaccgatacatcaccattagttgatactactatacaaccctttaaaaagatcagcgcaaacgaatataccatatcaatgctaattactcctgggattacaccgcgattaattcctgctatccatatcctatttgagtaagtgattccaaaaataaaactgcaaacaacactataaccaccaaacaaagctagcaccgttagcagtagcatcgatcagcacaagtgaaaaaaaaaaatcaacagcgtcagagatgaaggccatccacgcagcactgctcatcctggccatcgtcctcgtcgcttcatcatcatcaccaccaggtacgcaatacttggcgctagcttgtatccatctctggttttttttggtgatcgaggctagcttgtgatcagctgcatggttgggttgaacgaaatggcaggtggcgtgacggcgcagctggaaacctgcacggaggtgatcaaccgggaatacccgacgtgcgacagcggcttgtgcgtggcgaactgccagcggcagtacaggggcggcattggccagtgcgtcggcaacaagtgcaagtgcgactactcctgcgccttcctgccgccgccgccgccaccggcgacggcgagaaactaaccggttggtcgacgatgggaaagcacggcggcgcgtgtcacgtacttagcttacagaggttgaatcaggattaatatatttactcctgtgttttagtacagggtgacccgcgcgttgtcagtattgttatgctcggagaggcgtttgatgaacaaataaatgaaagaaagggttcccgttctcatggtatacatcggtttgcatgggaaagctagtcgtttcacccctcaagtggaaggccatttgacctcctaagtattggctacaataattatattttcatagtaacatacctttttttaataattaatattaaacttgacctttgcttcaactaaagctaaatccacttattacaaagtttttggcttgaaactcaaacacgacagaaataaacaaaggtacatgaaaagatgacacaatcacaccaaccaagaaaaataacaacttattcaatgattcggaatttctcgtgcacgaaaaagaagggatttcacaatacgatttcactacatccccaccctgcgctgctgactacccatcccagtgcgccaccgctcagccttgtcggcaccggaagccgccaatggctctggcatgccccttccaagcatgcaattcaactcctcccttctacccctctcttgtttgattttttttctcccattccagcaatgtcccggtcctttctcatctccgacggctagcgccactaaatccatcccctccgccaaccgtcaccttccatcctcacggctcaagcagcacccaagtcacctacctgtctctgcacccactaagatgtttccaccaccccatccatccctctaaagccaccctccaaaacccctaccctgctccaccatggcaccaacttctaaccctaaaactataaaacctaggtcctctgctggagttttatcgtccgaggtcacctccaccgctgtcaggggaaactcgtcgccaccgtggtgggtgagttacccactccttctcacccgagctctaggacgactccgtgacaatccaagagccatggagcatgtgaatgacaactatgtcttatattaaaaaaacaaagtaatacaattgtatgcatgtctcattagaagctcgacttagccaacaagatattaaagcatgcggaaggtttttctaagaatgtttgactcaaaaagggaaaaagggcctatttgattcaacttaattgagaatgaaacaatcacatgcctatcaacgtcagaacgtcatttgagccaactgctcaatgaagcaagtttatgagagtggtgtcaagtgtcgactgttacattcaagtaagttttttttttgaaggaatcatagatcaggtgatgtttattgtcttttataagagtgcatctacacatatgttgacagaaaatcccacctcctatctttcaaattttagatcattggatatgcttcaagattcgtgcagaccccttaaccctaactcctctcctcctcccccatccatatgcgcgccgccaccgctactcctgtctctcgcacgcgattcccagccgccaccgccctaccgcgccgatgcccgcctcgccggctggccagagggcgtcaacggcgccggcgaggcccctcggccagcctcctccccctcgtccttcccctcctactcccccctacatcctcctcgagccgtcggcggcaagatgcccccgccaccaacgccggcccaccgccgtcctccagccccgcgaatccggtgccgccgccggtgcctcgccgcccaccgccgggctgccgcctcccccggccatccctttaagcccggcgaactcttctttcttccccttccccctcccacccttcccaccccaccccaccccaggaccctaattcttcgccggagtttgggttgtcgccggctccggaaaagaagaggagttcgtctgagttggagaagaaacagctggagcacgaattgcgaaacacatccagtgaactaaaatttgcaagatttagaggtaggttttttgttgactgaagtgtagcaattcctttattattatccatttggtgaattagtccatggccaatgctccatcgtgtcacgtaccccggcactccttgtaggaatcaggccaaacaagcaacgccttgtgtccttatgcaaggagacatgactcttctacaagaaaggacgcaacaccccggagcatggcgcagctgcgagatgagggtgcgggttggggcagcgtgtctaggagctcatggcttgagcttggtgttgcggtcccctcgttccaatcagtacgtagtacaagattgacctctcgccctaatctcacttcgttatttggtaaggctagaaattacctctctatgactgttgggttctggctacttgcattatgggctataacatctttaacatatgctttggattgactatgacccatctaaacattttccatgccatacggagcatatgcgctttttttttctcgtgaaaattgacaaattaaaatgcaccgaaatatcacctttaattggtactattgattaggtaccaatttggtacaacccttaatacaaggccactatataatcctaaagatcagcacaaacgaatatagcagtatcaatgccaattactcctgaaattaaacccgttcccgttatccatatccatacaacttactgtagtaagtgattccaaaaataatacgaacaacaacactataaacgccacactcccattcggtacacctaaaagaaacaaagctgcagctaagcaccggtagcagtagcagaagtcacaaggaaaaaaaaaagccaatggcgtcagagtcagagatgaaggccttccacgcagcactgctcctcctcctggccatggtcctcgtcgcatcatcttcatcaggtagtacacaacactcggagctactactctctctctctctctctctctctctctctctctctctctctctctctctctctggcttgtgatcagcttggtttgaaccttgaacgaaatcgcttcaaaattcaaaaaaattgaacgaaatggcaggcgtgatggcggccaagatagcggggcccaagtacttccaggacacctgctcggcggtgttgaacccgggcgccccgtcgtgcgacagcggcgagtgcgcgaccaattgcccgcggcagtacaaaggcggcgtgggccagtgcatcggcacgcagtgcaagtgcgtctacacctgcgcttccccggcgccggcgagcaactaataacccggccggccggccgatcgatcggtggtcgatcgacgacgatgtgcagtactgtgtgcacaggggccgatcatcactcacgcgtcgatcaggcttaaattttacatacagtgtgacgcgtgcgattgttaaattttgtgatgcctggagagatgttgatgattaaataaagagactatttatatgggattgtcctattttcagcagcgctaaatagaacgctgtgtgaacctctctctgttttttttttggtgtgtggggggggggggggtctcatgtgcttcattacagcgttggccacgagagagttcagttgctttgtttttgcagattttcttttagagtgaatttagttaatatggtcctcaatttagttcctaacattttatattataaaaaaatcttcaaaatttatcatatagctcaatattagtctctagattcaacgaaaatgtgcgaagtgaacttagttcaactgattaggttgcttgtgatagaatcaatttacccttgcatttatggctaattattttatcagtggtagacgagacgtttatgtagacttcgtcaatctcaaaatataccgatccaattcaatgctcgcatttatatctaattatttttcagtggtagacgatgcattcatggtgactttgtcaaccttagatataccgatccaatccagccttatgtttgtactgtgttttttaataaaaaaaaccaatgaaaatgccacatcggtatgccgcatcttcgttgcaatcttaattcctattttatcaatgatgtaactatgtaacctaaattaaaagagcaattctatggtttttgaggagataccacgaggtactaaaaatctagtgtaaaatttggtacatcatgctacctttgctcaaattaaaattacgtagagtgaagcagaattaattctcccgaggaaggctgtcaaaattagtcaagcacatgaacagtcagcatggccgtgcataaaggatattaggttagggctgtcaaaattatcatcggcctgcggccggcctaatcattgatggccgctgttccgagctcagcctgcgagacagaatccgacccgatagaggttgggttgggccggactttatatgtccgtgtcctccgttcccctttcacccaaatctacagattgctttcgcaattaaatctggtactaataggtttcgccttccaagttccaatagagagcgatggcgtggatgaccccagatccgtggataagcctcctcgaggaggaggaggaggcgtgcgtgagcgtgaacaagcgccccaagggggaggatacagtgacgagcgacggcgagggcgaggcggcgtgcgcgaacaagcgactcaaggtggaggccacagtgacgagcgacggcgccgtggtgcgccagcgccatgaggccgctgtggcggcgaggggctatggcgacaggatgcccctcgtgccgcagccctttttgcgagtcaggcagattaccgagatgccggaccgataccggttcctcgatcgcttcaccgatgagcagctcgccaccatgcccgagagcctccacgcaactttggtgagaattgaggggggcttcaagaagagttgggttgaatctgagctcaggcgcatggagatgtacaaaaacgtaatttgagatttgagatcgtaggtggcaaagcagagatcaagcagtagcatggaattaatccatttgtgatcctcgtattgcggtatcttgctctgcagtatatattgcaaaatatattttgtgaaggtgcacacttttgattaagcaaaaaaatttgtttaaccttaaatcctgctaaggtggctcaaggttatataaaaataatggtttgagttgtctttttagcacattagaaactatactccctccattccataatataaggcacaaccacttttcttagatgttctataatataagtcatgcatgcaagcatgcaattaattatgacattttctctattaaattattactattttaaatccttatataattctattagatgcatgcattatatttattagaatgttccaaactacaagatgataataattatttcttggtctttggattaagggtggttataacttatattttggaatgaagggaatagtgaattggcgcatggcattttccagtgacgaatgctcaagcaaccggtgggaaattaggatacttcactcttgccactttctttcagcagaagcagtggcattccctgtagcttttaacagctacagtttcttctaaaattatagctcccacgattatccatagttaaccagctccaaagtccaaacaggaccgacatctttctcaagattccaaagccggacgactccagcatgagttaaccagcttggcccgactctggacaaggcatggtctgaattgtattctgccatcctatgcctatgacaagttaggccttttgaaggttcttgcatgtagtctctccggtactagcctcgtttaggtatgggcaaaaattaatgcaagacacatatatgaaccggataaccctatccattgttgggaattagtagtatataatcacagccatcaaagctaccaaaaatagatgatttgtatttagaagcattataattcatatataagcctattgattgtaatgtaatccatattaatctgttgtctttcttggaagtgattctaaaaatagagcatccccatggatccactataaaatcatggcatttgccatatagatcaacaacgcatctcatctcatcactcatcagtgcgttcgcgaaaaaatcactcatcagtcttccaattctagctttcgacaccaacaccaaacaaaggatgaggactgttcagttgctgctggtcgccattgccctcatgtctctatcatcaggtaattaagcaccttctctcgccgttgatttcgcaaacatagatcacgcaactcctaagcaagaaatctatcgcttgtatctgcagtgatggtggcgagatctgcagacatatctgccttaaccccgaactgtagttcagttatcctgaatccgggcaaggcatgcagcgccgccaaatgcaacgcggactgctccaggatgtacaagggcaccggcacctgcttcggtccagttggttgtgactgcgagtactgtccgtctgcctcggcaccaaccgcgactggatcaaagaactagctgggctatatttgtgatgtagaaatgatatgtgtactcatttgcttccatggacatggcagcgatcgatgtgacgatgatggtgtatcagcaaattcttttcttagcatgatataatgatggtgcaaaagttcagttatgtttcttgagttatggccccaaaaatattgacaatcaataccatactcatgatactgatttttcttagagaagtactcatgaatcatgatactgatacggataggtttgagctttttttaggcagtggttatgattgggcttcaggatgtgggctaatctgggcttgcatcaagtgggccttgcttcattggcttgggcctttgtttgtgttctttctcagttgcagttcacgacacgtgtacaaaccacggattttttttacaactcggcaaaggttaaaaacagcagaagcacagggaacgtacggtgcaatcgtccacggcaggacaaagaaccgacatctaattcggcattaacgatggatccattggccacggtcagttgtgtagtgagtagctagatcggccttgcagcagcaggcttcgctgtgcgtacagccgttgcctgtcgcgcccgggaaactggggtgcatgcccagttgccaaaaccccggccgtccctactccctcgtgatgcttcttggagtacttcgctgctccattcaggaagcagtggtgtgccagcgttggactaattaagctcgatcgctgacaggcatcaccaacaaccatatcctactagctctgaattccagcgaggtgctctaatggcatgtttgggggcagtcagagagagggatttgtgttattgtgtcctacgcgttgcagctgcaaaccacgtgctagatcactgacaggtgggccagcgtgtctggcgagttaggcccgaatcaaatcagagcagaattatcatcaagttgttgcgagataaaagtaacacaagatgtgcaccttttttatttttttttctcctgaagattcagccagccagtggtgtgaacagcacagacccgacacaggctttgccacaaacaggcacacatgcatgcatatatctgagaaagaaggaaaaaaactttgagcttaagccctgaaaggctccattctggttgccctcagctgctgcaatcctgatgtgatttgccttcccgggacagcgatctctcattattcctcaccttttgcctcccccccccccccccccccccacttgtgtggactcagccgcacagcgacgttgccccaaaacgcaaatgcgacttttcggagtcgtacgcccggccggcccgatcgactccctagctcgcctccccctctgcaagcgctgtgcctttcaagccggggaaaataaaaaacaacaacgcaacgtatgcctcacgacgagccaacgagacggtgaaaccgacgagagcagcgtgcgttcgttttccgtatctctctctgacgtttactcgccatcgacgacgacgacgtacgcccccggcggcgcgcgcggtgtagtccgagaggcccgcgaagcgccacacatgcgcggcaccgcgtaccacggctcgatcatgcaaacgcgacgacggcgacggctgcgagctgcagatccaagaaagacaagactgaaatatacatggtttgcgtcctaaattcgtgctctctttaagaaaaaaggtttgatagatccatctgattgacagatcaagctagttgttcttttcctttcttttctctcttttctcaattctctcccatctttgggaaaagtgggaacgtgacgagagagggtacaccagctggttagtactggtgatgaaaggatcagggtttgtatgttcctagactgtcatatcaacgtcggctacaggggaatatatgtgtgtgggtgtgaccaatgacgaagtggtaatgatctgattagatcgatatgagatgttgtccccatgggtggtgtggttgggctagaaccatctcaacagcagtgacctccgccgactgtccgtgcatcatgcagggggatggtatccaatcagtgagatcgatcgagtagattttttggcgttaatgaaggcaactaaactcaggattacgccaagacacaagccacatcaagcacctaaccatgcatcaacagatgcagtactttcacattattgttggaccagggccatgttctcggaagaggaagcttgcatatgcattagctaaggtgtcgctctcatgccggcactggcaaatattgtgcgctgtgcgatagtagtcgatcgatcgggactcgggctacgaagttcttattgaattaatttttccagataagctagggacaagggacgatgctgttgcttgcatgcatagtggtgaattggtgtgtcgtagcatatatagcatccatgtacgttgtctgtattttaactgtgtgtaaacatttcccatcttacaacgtcagatgcagaatttaatcaggcagtttgattttcagatcctacaaacatggagcaggaacatgtacaaggcagacactgaataaagaacggagtgcaacttcgcgcgtcataaatttcatttgagattaagagcaattttaaagtttaatagtatagccaactaccagtttcaaatcatctataatcaatttaatagccaattcatacaatagttacatataaataactacgctattaatagttggtaccacctgtcatacacacattgcgtcatagagtctgtgctgcaggtgactacaaatctgtagcccgctagtcatatctctctattttttttcttctggatatgtgtttatagctgacttgtagtatgctattatatctcctctaattaaggaagagacaattgtgttcttactcatgtttttttagtgcaattgtgattttacccttacttttcagactttgcgatttgccctcacttttctgaactgaataatccatttacccctagattggatgtccgttcggtggtcccaaattaagtgaggtaaagaaaacagataattgactaacaaaatatgaaaaatactcttctagccccacctattcaaccaaatccacttcccactctctcccgcaaaaaaaaaatccattgctcactcgatcgtgggttggaaactgtgaactattttttcgtgggacatatccactgattaggtgggttgccttataatggtcatagatagtatatattcaaaactcttattatataaaacctgtcattggaaattatgaactattttttcatgtgttatccgcagtacaatggacatgtctttagttttaattcaaaaacttaaaactgaactgagattattttactactaaagtttcactttaaaccaaataattttatcacagtttggaccaccacaaacaacttgttccatacacacaaacctcaagtaaatcggctctagcacaccaataaacttccccatctatacactggtcatatctttgataggctttgtttttatattgaagagttggtgaatcaaaaaaaaaggacaaaattattcagtccaaagtaaaaagagattggtttaagattgatccaaaataaaactttaataataaaatgcgcctcaaactttaatataagtttttttacaacttgtaaaatttgagtttgacatgtagagtgatatatctcatattgatatatcttgttttatttttttaactatataaataatatgaaaaaaatgaggagatatcccttagatagttagatgatgaaaatctttctcctacattcggttctaaaattatatagaagaccctagtgcaaagcacttggaccctatcctctcttcgtttgcgtctttttgtgcttgttatgcatgtgtcgttgccttttgtgtgccatgcatgatgcaatgaaacagatgaagcaagtgacgaatgaatcgggcatgcatgcagagggtagcgcttacatttgggaccacgtttaaatgatgctcagagtgctgtgcatgtcgtttgagatagaaaaaaaaaaagctactcctctacagccagtgtatcattgaatgggcgtcatgggcatgttcagcaaacggcctgatctactactgatgtagagtacgactactgtgtacgagtactacaagccggggtcccggccatgcacggcttttcctaccacctacggattccggcaaaggaattgaattccgggcctttgtgtactgaaatcaaggacggggtgtacaaactttgatctgtgcgcgctgtcgttctcataaattgcgtagagatagctttcgagaccggtgaatggggatgctgatgtactgtactccctgtccgagcaatggttatttcgtattcgttgtgacctgtgaaagtagattagaaaggttgtttcacctttttttacatagacattcagattgttgtagcctgtaactgtacatagttttacgtttttctaatatctttctgattgatagaaaatcgtatatatggcatctagtatatgctattttgatggacctttttcttttcaaacgagagcacttttttgtacaagatttgctaagttttaactcctgggaaatcggtatcacttctccacgaagcagtaacaaacaagtgacatctacaatgcacgtaccgtacctaaagtgcttggtagtataactgcaggcagccgtgcaaatagcaacaagtacaaagaaactagagaaaagcttaggtcaccagttgctggagctggttccacgtacaggaacctaaccgaacacactacagttacacactggtactagtacgcagtactccattttgaataacgactcgcgacgatcacgtcgaaattccaaacacattaattcacggtagttcgcggccacatgcgagcacgagcaagcgcaaaaaccaattaattagcaagcgcgcccgcccagtactactgctcatatgttcttcccttaataagcaaagcatcccccaccctatccaacgtgctggacgcctggactgctggtgggtcgggtgaatttacggcgtctcacacgcaaatcccacgtactccacggctcgcaccggcatctcacgcgagagccacaagcccaacatctcgcgggacacgcgagagcgatcaggcgctcgcggtggtggcgcaatccgcgcatctgtagcgaaacgagccggccggtgaacctaacatttgcatggatggatggatggatttgctgcggcgcgcgggttgatgtgaggggtgtcccctaccagccggagcaggggtagtagggggggagggggcgcaactcgtgcatgcacggatggagcgggtacgacgtcgtcgaccgcggtgcagtgccgcgcgcgtacgtacgtaactccagtacgtgcagctagctagcgcgctggctccaccgccggccgcagcgtcttttgtcgttggatcgatcgacgctgaaacggtcggacgacgacacgttctccgggtcacggggattcattcaagggagctaacgatgatgatgttgaactcctgagttgtgaagcaggtagctagctaagctatagctcgacagatgcgagtttgaattgggtatgaactgtggggtgggtgtactatcttgtctcgaacgtgcccggccgggagagaatttacatgagctagctggagtagcaactactctgatcctactatgttttccgtacgtacatgctggcattaagggataagacgtgattggttacggcgatgacaacctgatcgagtcttctcgggaacagaaacatatatgctcccccgaaaacaacttaattaattatactagttcttcgttgtatatatatatatatatatattctgcatgctctgatacagtaattttcagataaacagagctttcagatcatccaattaattcaatttctagcggcctgttggaaaaaaaagagatcagatcgatgtttaagtgaccaaacagcgtaaaatcacagagtgtttcatcttgttatttggacattcctgcctccccttagacataattagggtgtgtttagttctacgctaaaattgaaagtttatgtatatagaaaagttttttgatgtgatgaaaaagttagaagtttgaagaaaaagttaggaactaatcctagccttaggggtgcaatttcaacaacgacaagggtactccaaccagttgtggacagttattgaaagcaactttctacccccaccgttgtggcttctatggctcttcccaaccaatcaaagcagactaattaaatatctccagctcttgctcacacccatgggtcatgtgagcggtacgagtccactccacacccaccagctactattgctctttctagttgaatcttgcttgtttgtgcatgcagattgatctgagcctgaagggtgatgagaggaggtgagccgatgactagctgcgccatatagtaggtgtggtcctaggtttggaggattggagatctccttcccgacagcaagatcagacccatatttatgctttgagaagaacaccaccaaaaagcctttggcaaagcctacctccttccctatctgcattaacagcttgacactgcccctgcagttgtcagcatatgtgtgcatcttcagatcttctgtgccaaaaaaatttgccgtcaactatatatagtagtactattagtgatcacctcatgaccacgtatatatatatggtagagacaggtgagagataggaggagtatctatcagagtaacagtgttaatttatctggaataaactggtggatccacaacgattatcttgtagtggcaacgtgttaaatcgtgctccagtttagtactatctgcatggtgtgcatgtcggtttcttcagggattctgatcttctttcggtttgccttttcactaagaaaatgtattatatttctgatgcttgttgatgcatagatctatgaggcaatgggattgatggcacacgaaaagaaggaaaaggacacatcctgattactgcgttcaaggtttaattgggctgtggctagctgcatgtttggtcccaagcggcagcatccaaagtctcatccaaaagctaaaggggacagggagctccatcaatagagctggaatttgatgattgttttggagtaccgtctctagcttactttaagtggagagactttggcatatgatgtgatgcagacaagtgctcaaaaaagcagagcaccctcattaatcaacagcaagcaacacatgacccaagcaacaagagttcagcctgaaaatactatgggggtgtttgggaactagggactaaatttagtccctcttacaaaaacataagtccctaccatagggacttatatttttgtgagagggactaaagtttagctccactttagtccctccaaccaaacaccacctatgacaggccggttagataatcaggaatatatactctgtagattgagcctccctcggttgcagcttggatttttgtgctccaggatctagtacttttgttgtgcacaagtaacccaaaacgcgggaattgaaccatagagtgacacagaaagcttttaattaggtcagtatgctgttccttcttttgctttcttaaggtatctagtctgttaagagccagtttcgactttctcagttgggccaaacgactttcagttgacatgtccaacactagtagtaccggtcttgtacggcaacttctgaaattccatcaaacggcaaatcttttacacgagaccaattcagagacataccgatacataaaccaggcatgataattaagctaactatatatacttagtaactatgtacaattaagcacccagccatatataaagaagatgaaaagaaaagaaaaagttatgacagttatttgccggactccgcggcgactacaagagcaaatactatgatagacgtaaatgccacctttaattttatccatattattcattaataaactaaaaggcaacatatacaatatgtcacttccaacacacaaatgtcaatcatctaatactcacacatctttttttaagtttgtgtggaggttacctcttaatttagaagtagctcataatctctctcctcacttctgtccttcacctcatcactctatccaatgtgacatttttagaggcagcatatgaagcattatgggggaaaatttattaatccctcgagaggatattcattcgttttgtacatatcatctaaatagtcataaaaaaattgaaacaaaatgctaagatatagattaacatgaaatgtatcactccacaaacatacaggttaaaattcaacttctataagttataacaaatatagctg

SEQ ID NO: 5250 - DNA, 772 bp, Oryza sativa
acctgcacaggcacctgagccatgctatggaattcatatatcttctgcattagaggggtgctaaggcacaggatgagtattactgcgtattagggatactgtaaaccgtccgatcgagaacggaaggatcaagtcatgcgctacagtattttcgaccctatagttatagaaagcatcactgttcatggcattaattcactgcccttcacacgaacagactgtaaacgatccggatccatatgctatggcggcttggcctgagccgtccaatgggataaggtggatttcggttggactgtcattaccttaggactccggtctgtgcgtgcagtagtgttggggggcaatatatataaaagagtaaagtccatcaccggtccatatgcgtatcactcgatcgcacacatattcatgttttgtgcatgttgaatgaagggtccgtcgaaattaggttgtaaatgatctgcatcaatcaagctggacagaactttacaattagagaggatcctcatgtaacatgtgcattttcacttaatatggctatgtctagaacttcaaacgcgacaagtaaaagaacacggtaaaggtaacaggaaacattggtatgcgtgtgcttagtccttatagacaaaggcgccatgcattgtgcatttggtccccctgtgggggaaaaggatcttttgataccttataccccctataggagaatggtttgaagatcattcttgaaactttatagaattgggaatgaatgtaaagcattatttttatt

SEQ ID NO: 5251 - DNA, 21818 bp, Oryza sativa
  unsure (1)..(21818): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatatagaataagcatcaacatagataagagatcgcaataatattgcgacagacagttgtaggaaacgaagaacgaacggtaatagtgaaacgttataccccgaaaatgaccctccgctggagtttgaggcagtattgccttcgttggtgttgacgagaggctccttctccttgtctccggtgttgttgttgtcatcggttgtcgacatgttggtgaagatgatgcaaagcagtcgcgcttgaagcgctacccaaaaacttgatcgcctgcctacccgtgcaggttctcaagcggacggagtttcggaggcacttgctcgttccgatcacccgtgtgcgcgggatgaacagaaccggagaaacagagagacagcgcaggaacagaaggagagtatcgccaaggaacaatagtaggaggaagacacacactttgagagcctctgccttgcgttatatgtagagagagatctccattaccacacaaataaatctcatttgttgtgaaggttaccacaaaataaatctcatttgttgtgaaggttaccacataatgaatctttcatttgttgtgaaggttacaacaaataaatctctcatttgttgtggatgttacaacacaatgaatctctcatttgttgtggaggttacaacacaatgaatttcatttgttaatggtgattttattctcgtctgttacaaaacgtaagagcagcaggcaggctcggctcggtcggccgcctcgcctcgctacgcccacggccgaggccgactcggcatgcgcgcatgcgtgtggcagtccaaccatcacttcaaccggtcaacagggaatctctaatatcaccctatttaagttgaggttcttccacctaaattttcaaggcagtattattctctctaacattacttgtgggctcttgagattttaattgaattaaattgggcctagcccatttattccaacaagaatgagcaccaatttagtggcctttttcatttttcgttggatgcggattgcatgaatgaattgcttgaacattgaactgaatcgaattattcattctctgacaaagaatgcttctacaggtctctgctatggaaaactggaagctggtattttaacttttgttatccctggccttcttcttggacacctggtaaattaagcctctgttatttttgttacaaattcaatatgttataattagtttcaccttgttcactcctagagaagttacagcaccagggtgcattagatttagagcactcattcatcatttcttacatttgtcttgtcaccacctcgtgcagtctggtctaatggacaacggaacaaaagccggccttttaggagtttggatggttctcttcactgtattcgcagcaagaaaattccagcagcccatcaaggtacagattcctccaaattaaaatgctccgcatctagcttcattactaccgagtacatatgttcgttcctcacttacaacattacaatattgatgatcaatgtcatcctcatgaatcaggatgacattggtgacaaatcagtttttatgttcaacgccctccctgaagaagaaaagaaggccttgatacagaagctcgagatgcaaactgagaccgatggctgaaaccagcacagcagctttagtacgtgtacgtccaaggaagtatatgcaattgatgtacatgtatggtagtttcacagataccggcacatgtcagtaagagtagtaactcagtttatacataggaatgagaatgtactagctagagtaattgcgatgtgtagttgcaaatcagatataaatatatatacatgttgatggatctcctctgggtatctgatcagagaggggtcttaccctgtacaactgtctgttctcatgtgattatcttctctgtgccttacggtgtatatacgtgaatttggttattcctttgtgtgtgtatacctctgatgtgataagaactactccctccgtttcacaatgtaagtcattctagcatttcccacattcatattgatgctaatgaatctaaataggtatatatgtctagattcattagcatcaatataaatatgaaaaatactagattgacttacactgtaaacggaggaagtaaaatttagtccctgatccaaacaggccctgaaaccaatcgagagggggtgccggtacgtgaatactactcatgcattagtaattgctatgaatggtctcttttgatgcataattaattgaatatatatatacaacctagtgctacctccgtgtattgatccaggggcgggcaccgggtgagtcgatgacatccataaaccagtagaagaggttacctcccagcccagcgcatccagcgtagtacaaggtgccaagcttgaacaactcagagcggctaagcgatactctctcatagtcattctccatgatatcccgttgaacgtagcctgttgcgatcatgacaccaatccaacccaactcaaaaatcactctagcaaacggatccgaatctcgatccccagctcgaggcataattaattaattaattaatatcctccgaaatcttaatcttaatcttaatttcctcgctctagatcttctcttgttgaagaggccgatcaatcgattcgagaacacctcacctggctgcatatatatacacatagatcgatttgcctatgttaggtgcatatatattagtataaagaataacactgaagggaatataaaagctgcatgcatgtatgtatgcgttctaatggcaaaatctcgtttaattaatctgccaatcatatttgggggaaaaaaagagcaaagaaacaaacatagatgtgatgtaaaaccaatcgatgatttgctgtacctacggcgagcgagcgatcgatcgatcgaacaaaccaataaattattgggagctgggagaggaaattgcggcgcggcgaggcgagatgagatggactccgtccgccgcccgcgcaagcgatagatgcagcttctattctagctagggtgtcaaaacgcaagcgtatactttgagatttatttatacagagaatcgacttttgctgggtcgtatctgatcagaatttcgcaaaaaccgaccggttttcacaagcttgattattggtaattaaactcatgatatttatattcaaatattagtttatgaaattttttcgaaatctaccaaatttgaatacaaatatattccgactggtagatttaaatacaaatttggaatatatttgtatacaaatatacaaatacagatatattctgactgagattcaaatacaaatttatttgtattcagaatatattccgactagtagatgtttgaattcgaatttgatagattccgaataaatttcataaaccaaaatttaaatataaatgtcctgagtttacagataaactcgcgaaaaccggtcagctccagcgaaattccggcccgatacggcccagcaaaagtcgattcgccctgtataaatataaatctcaaagtatacgcttgcgttttgacaccctagctagaatagaagctgcatctatcgcttgcgcgggcggcgcacggagtccatctcgcctcgcctcgacgcgccgcaatttcttctcccagctcccaataattttattggtttgttcgatcgatcgctcgctcgctcgccgtaggtacagcaagtcatcgattggttttacattatatctatgtttgtttctttgctcttttttccccaaaatatgattggcagataaattaaacgagattttgccattaattagaacgcatacatgcagcttttacattcccttcagtgttattctttataatagatatgcacctaacataggcaaatcgatatatggatatttatatgcagccaggtgaggtgttctcgaatcgattgatcggcctcttcaacaagagaagatctagagcgaggaaattaagattaagattaagatttcggaggatattaattaattaattaattatgcctcgagctggggatcgagattcggatccgtttgctagagtgacgtttgagttgggatggattggtgtgatcatcacaacatgctacgttaaacgggatatcatggagcatgcgtatgagagattcccgcttagccgctctgagatgttaaagtttggcgtcttgttctacgctggatgcgttgggctgggaggtaacctcggctactggattctggacgtcatcgactcacccgatgcacgcccctggatcaatacacggaggtagcactagccactaggttaattaatttatcattattatcaaaagagaccattcatataagagtagctacaatagcaggctataagccagctgcaaacatattttaagcagataaatgaggagagagaaggtcagcggactacagatttgtagccagctgtagcacggactccaagatacagtgtgtgtatgacatgtgggaccagatattaatagtgtagtatgcaactattgtataaatgagctattagattggctataaataaattggagctagtagttggctatactattaaacttgctctaataggagtaaatggtactatatttacataccgcctgtcgatttggtttgagtctcatctatactatttggtacatcatttggtttgagtctcatctatactatttgttacatcatccgtgtccgagtcgattttaagttcgttcgttttcggaaatatagatctgtgtttgagttcgattttaatcccgtttgcttttggaaataaaaaaaagtcgtataaaaatcacttttaaaaaaactcgtatgctaacttgagagatgaaatacgtactcaatcacagctcatgattttcttaaaaaaattatccaagcgaattcgtataatgaattttaccctaactaaaccgtataataataataataaaattaaaataatatttacccgttgcaacacacggatatatttttaaagtcttatatataacagtaaatatgatatgccgattgagttgagttttatatctcataatgatgatgatgatgatgaaaagtgtcggtagtttgatcatataataagatactcagttcggccataaatatttaatatttaaaatagtattcagtctttttctttaaaaaatgatcttcaatactaactattaaatgttttttcaaggaaatatataatttggtttgtgttgtaaatatgctacggttgcatattagatttcataaatttattctcacataaattaacttaagagtcaaagtttcaaaaagttcgaccgaatattgtttgaatgtcaaatacttatatataacgtggggagtatattagtagttactactaagctaataataatggagtagttgacaaaaatcaaggagtgaacaaagaccatattaaatgaatacacaaaaatcaaggagtgagcaaagacaatctgaaatgaatacacgaaaaaacgagtcgacaaatgttacaaaattcatgaaaataaattgtcccattgaaagttaaaattgagcgtaaccacgtagtactgttcagaggggggggggctcctcacctgaattttcattaaaaggggcggaaaagtacacagattacatttacatagggggagagatacgaagggaggaagaaatgatttccttccaaacggaaaccacaatcctgtcgtctatcttcagacgctctgcccaatgagcagcatcttttaagcactttgcaactaggcgtgggagagatatcgacatccctttgaagatcacatcatgacgatgattccacaatccctagaagcagagtacgaagaaaacttggaaatgctttgcggcaaacagtggggcttctgaagctgagcgagctccgacatctagttaatagcagcctggatccccatattctgccagaatgatgcaccgaaggcagaaatggaaggctgactcttgttcactgttacagagctcacaaatatctgaggtcacgattttcttcttgaggaggttttgttttgtcgggagccgttctttcacaagtaaccaggcaaagaattgaatcttcggtggagctttacttttccagataaacttccagtttgcacagagaggttggctttggaatgacgattcataaaccatacgagaagagagtaaactccctgcagcactattcgtaatctttctttcatccagggaggggattagcgaagtggaagcaattagctcttggagctgatgaagctgtgagtttcagccttgggacaaaacaggcttgcgagtttgttgaaagaacttggtagactgaggcttgcttgtctagtgcatgagtaaacagagctgtgaatttggtacttaagggaccgcagtcgagccaggagtcatgccaaaaagaagtacgctgtccatctccaatagctactgatgttttggcctgaagaactggaactagagccgccattaaccaatacgaaatttaggacaaatgctacaaaattcatgaaaataaattgtcccattgaaaagttaaaatttgatgctgagcgtaaccacgtaaccaatacgaaaattagtgactagatctcgacacgttcaaaaggcaagctcacattatacttgcagattagacttctattcaggacaaattcgactatgagtgaatatcgatccctgcactccatgggcaaaagcagagaactaaggcctggtttagttcctaattttttctcctaaaaacatcaaatcgaatatttagacacatgtacgaagcattaaatataaattaaaaaaataattacacagttaggggggaaatcacgagacgaatcttttgtgcctaattagttcatgattaaccataagttttacagtaacccatatgtgctaatgacacactccctccgtctcaaaatgtaatcatttttaactatgaataaaatgcttatattttgaagcaaaaggaagtattaattaggctcaaaagattcgtctcgcgatttttagacgagttatgaaattagtttttttattcgtgtccgataatactttccgacatccggtcaaacatataatgtagcactaaatttttttttcgcaaactaaacagggcctaatctagctgccaattatctaccaaagaagattccatgtcacaaaattcgcaacacccccaacatgaaaaaatatggtacgcatttgagtgtcaacgcgtactgtgaagatgcaaattaaggagcaggcaatagcttggaaacaccacagcaccagcattatcaacagtcacctcggtcaaaaactaccagcaggttaatgcaataacatgcaagtgatattgacatgatttgggttaaacgaaggaatgctaggaacagaagttttcatcaaatcgaaactagacaagccagattgtttctcggcagttacctgaagcccatcttcaaatctctcactcgtcctttcactcaaatcagcaagtatcggcaaatatgtatgaactctcgaaccaacaatgctatctatctatgctacatttcctctcctttgaatgacaaataggtcgggtcctagctatatatatcctgcatgccgcagcttctggggtctaagcactgagtgaaaggagccttgatccattggattcatgcactgcaggatgactggtactggtggtaaggagccttgatctattgaatccagaaatttgagaactggggaagactactgatggctttaaggagccttgattcaccgcatcaataaacttgaggaagactactgatggcactaaggagccttgattcaccgcatcaataaacttgaggagggctgctgttaggggaaggttcttgctattgttagggctgtaagggggtgcagtgaacccttcaaactttgtcaatgccatgaacaccttgaatgtgggggcgactggtatggcaacctgagagtaaaagcaatgcaattttaaagatattaatgactgtatggcaacctgagagtaaaagcaatgtaattttaaagatattaattaagatagtaataagcatggacagagggctatactttcacgaagccagaaatagcactaactccaaatgattaattcagtacatgatctgaaaactcattatgaaaataattcagggataaatacctgaacaaggaattggaaccctcttccaggaatagcaacattctgaatttcatcgtttgaagaatcactgccaaatacctcaacaaggaattggaaccctcctccagtaatagcaataatattgaattgaaaaccttctccaggaatggcaacaatatcgtgaatggctccttcatcgtctgaagaaccatggtcattgctatcatcaaacatctccaggttcccatcatgccaattgccccaaaaatcatcagcaatgtcgtcccctccattgggatttctattgttgagagcagctgttcttttcttgtaaagaatataggctactatgactcccacaacgcagactgctccaacgatatagggtctcaattttacatcggacataatctctttgaccaagccaagaatgtgctgacttgagtacacagatagagatataggcatgatagtgttgcagtcatttggtgttgatgaagttctttgtaaaggagtggtgagcagggtactctctaaaagagtggtgatctctgaaggagtaataagctcaatgttctctgacatcggagtagtctggatggtttccttaagaacattagaaattcgctcaagcacctcgggaggcagctgaataacctcctcaggcagctgaagagcctcatcagcgcttggcagtggcaactttccctcatcagaaatttcttctcaaacacctctcgaacaatatcagggttgtttttgacttcctcttttacttccctaaagaaccctcgtaggaaagttcttattagggtgttaagagtcgacgacattatgctttagcctacggatcaaatatttgaaaatgtattagaaaaactgaaaaagaaacacaaatgcaacgaaatctcataaaagcgtaaaagaaatcattggatttggaaatttaattagaaaaactgaaaaaaaaatcacaaatgcaatgaaatctcacaaacaagagagtacaaacaaaaagagtaaaatatattgccggtccttaaacttgtgggctgtaaacttgttttaatgtaccacccccagttcaatcgttctttgaccacgtttgaccaccaacgtggcatgccacataggcaacatttttgtactcagtcccccgacccctccacatataccttcacacataactcgccctgacccgtgcatttcaacccaaatcccccaaaatatctctaaattaactagggtctctacggtgaggttagcagaagtaggccgagaggtagcggctgtggcggcctcggcggtgagattagcggcagaaggcagcgcagtgcagcggggttgggtgcagtgccccttgtgcaaggataagatcattttgaagtgcagagcaatgtcaattgctaatagggcgtgcattttctgtacacgcaaggagaagaatgagagggaagaatgatttaaggattttttttttgggattctggtgtcactatatagctacgaggagatatatgcgacgtgttgtgatgtggagggggttgagaacaaatgtgttgcctacgtggcatgccacgttggcggtcaaacacagtcaaatgacatttggacaaggggtggtacattaaaccaagttcacggtcctaaacatgcaatttcaagttcacggatttaagtgacactaacacacaagtttaggggccggccatatatttcactaaaaaaaacccaaagcccaacaaacaataggctagcttaactattgccgatgatggcgtctccggcgttgtcttgcggagtttgatcaagcgcaagagcgacagaaaagttgccgaggatggcatctcgatcgagcgcaatacaactcagaaaatcactagttgccgagcatggcatcttgagcgtcttctcgacggaattgggtcacgagagctcaaaaaaccaacccaagagccaccgcaaggaatcattaaccgggcaattgacgaaacatggctatggcgcgcaagtggagcgaaggtaatccagtccctactgccagatacccgtggtagcacaatcaataatccgtaatcaagaaatttatcttttcgcaccctctactcctctagtggtcgccccctccccaaccacgtactgtttctctctttttttcaattttataagctcctagcctcacggctgttgtatagtgtttccctctcctttaatacgaataggttaaaaaaagaaaaacaacccaagagttcgatggagcacgggagagacgcagaaaaccacaagtagccaagaatggtgtcttttcggcggaattctatcgcgagcgtgcatagcgcaaaaccgaagagaactcatcgaaaaaaccaaccaaacaacaaaatcaaatgggtagctggtcgcagtgcagaagatgcgtcagcgtcggcactcgccgcggcttgcaaactgtgaaccaaggccacggcggtttttgggcggaggcggagcacgaacggaagagaagccagaagacgatgtacgcgcatgaagcgccttggagaggtggtggagacaggaacgtaaaactaacaacaagatcagcaatcatccaaaatcttgccacgaaacgatccaaagacttccgaaattaaatatgttcgagcaagatagctcagtaaaagcaccaagtccatttgcgaaaagaagaagaacaccgcgatcgaaaaactgacagctcgcactcgcagtcgtcacacgacaatatctagctagcatcatcgcctcatcggagcaccaaaaaaacgcaaaatcgacggagatgagtaccacgaacgaccctagcatcaacgaaggggaaaaccacgaagaaacacacacacacacacaaaaaaaaaaaacaacaacggagagagtagcacgaacaaaaccatagcatcatcggacaggaaacaatcaaatgagtagcagcaaattccaaaatgctcaaccaagcgagccgaatttttttttcgaggtacacagaaattctcaaccaacagccgaacaccaaaacacgatcgaagaatcggagaggagagggaggggcggcgccacggcggagggcgctcgtcggcgggctgtgaaggcggaggagcggtcagagaggaggcggagaggagaggagaggtacgcaccaggggcgtcgtcgccgacttgcggaggagagcacgcgggagcgggacgacggcgtcgcggcctcgcgagttggtggtggccggagatggaagtcggcgcgccacgggcgtcgtcgccgtacttgcggagcgagctcgggagcgggacgacggcgtcgcggcctcgcgagttggtggtggccggagatggaagtcggcgcgccacgggcgtcgtcgccgtacttgcggagcgagctcgggagcgggacgacggcgtcgcggcctcgcgagttggcggtggccggagatggaagtcggcgcgccacgggcgtcgtcgccgtacttgcggagcgagctcgggagcgggacgacggcgtcgcggcctcgcgagttggcggtggccggagatggaagtcggcgcgccacgggcgtcgtcgccgtacttgcggagcgagctcgggagcgggacgacgggggggggcgggggaccccggcgtcgcggcctcgcgagttggcggccggagatggaagtcggcgcgccacgggcgtcgtcgccgtacttgcggagcgagctcgggagcgggacgacggcgtcgcggcctcgcgagttggtggtggcgcggagcgacgccgacgtagcctctcgcggtggaggcggaacagccaggcaaccgtcgccgacttgccgaggcggaggcgctgcgctgccgctcgactcgactcgactagtagaactctcgcgttttagtactcacacgtggcatctcagcctcgcttttaacacatagacgcacaatcagtctctaaaataactcaaactctcaaagatacggcctcgatcgtatttacaaacgaaatatgatttataaataaaatttttatacacgtcttcatagtgatctaaaaacaaatgctaaaaaaataaacttcaataaaaaaatccaaaatcaactctaaattgaaaattgaaaattcaaaatttactgctcgctgttaagttgatgggacctccggtgaacttttataatttggcccactaacggtagaatgcacaacctagactcactaaaatcctatattgagactatatttgtctgcgtggaatatttatgattatatgcgtgatatttatgatcactagcgtttaaaccttagtaagtgaaaccatacaaatacaactatcacatcactggtgcttccgcaactgtgatagggtttttaaacttgatatcaatgtttttttcagggaattgtttcaacaccggatcattctttattccaaaagataacaaacaatgttatttacgatcgcaccgctggtattgcagcaaacttaacattataagtgagcctgctatgcgtgattatcattaacacagggtgctccttgtagggctcttacaacaccagggaattcaccatttcacctaggtggcctaaatgactatatgcctgaatcacctttaaacctatccaaattccaaagatacaacaatagcaggaaatgctaagtcgactagtttccgtaaatgacaccatttgggctcacaggagagccattgtgttgaagatcctcttcctcaacttctgacaagaaaccgttctcaaagaatgctgaatgaagggcctgtatacactgtttcgcctcgctatcatggaccaccaatgaaatgttcacctgatcacgcacagtgagtattgtcatacaccctttggtcatttgcacaaaagaatttcgttcatctggggaggagagatggataccttggatgccccttgtgagatcatctggacgttaacgccatttctccgtagaacattgaaagcctggcgtacagcaacaaatgtaaatgattagatgcaaaaaacaaaccagtcaatgccctgcaaaaataaaagtacaccctagcatacaggattgcaagtaatcgtgttcatcaacaatatgtccaaccagagttttcggtggctaagagataataaccttctcaagaatcaatgacgatctctgtacattccctatcagtgagatgatagacctgtgctgcagtagatgaacaactgcaattttttcaagttcttcaactacatgatcaagttcctgccacatcatcccaagaaaacaaatgaatattgaattaagagaacagctggtgcagtacgtattttcaggatgtatcagcaaagtgctaatcctgcagaacaacttgaatccattatctgttctttttaagtttaaattgccctaacaggtttctagatgtgggctatctactgttccaagtatctatattcatcaaagccaaagaaaactaaaaatgaaacacattcagctattcgcaagcaattcaaacttcaggcttttgtacaatattttattcatacccccaaacccaatgtttgacacatcacacatgtatatcgaaacgtgatctgtctcaaactcacctgctggatcaattcacgacaccatagttttgatggatctagtgtcaatgatatactgacttcactggtagccacacaatcaacagagatacctaaatcttcaaatattgagaaaacctgcacaagagcataaaaatatgaacaaattactaatatgcataagtcaacaaaataaacaggaagagcaatgagcatattaaaataccttcgccagaaaaccatactggccaagcatccttgtgctcactatatccagcatagtaatgtttgacttcaatacaatgctggttaatatactctgaaaaataatgtacacaaatcagaaattaacaagaagtatttacaaacagacgtatcaaaatctattcatatgccgaaccttgctcaaatctcttgttttagtaataacagtaccaggtgctcgacggttatatgaattcttaactctaactggtatatcaccttctttggctggtctcattgattggggatgcaaaacctaacaattggcaaacgtatttctgttagggcaacagtagttgaccatgctatctcaatcaccgtgagagtgtcaaataattgtatcaacacatggtaataagctctacaatacctgtgcaccaaagtaggcaagttcagctgcctcctcaaaagtcaagtagggtacaggtatcgcgttcgcacaaatattaggatcacatgtcaacacaccatcaacatccttccatacctgttagagatttaaaaagaaaaagagttataacagccggtaaaacctcagagacaccacaaagcatatctgtagttttcagctgatatggttaaacatctaaccaacttcctcaattgcagaaccagaacgaacacaaaactgaaggaatgatctaagaaaatgtgtttacacatagaagcttaaaggtgttgaatgagttctgggagcaagtggattttcaacaggtaattatcacaaacttaggaacacaaacctggatctctcttaatcccaacgctttgccaatggtggtagcagtcaagtcgctgccacctctgcctaaagtggtgacagcacatgatttccatccctgcaatttgatgtgcattatcataaacacaaatataacaaatctaattcaagtgcagcatcataaatgcaaaagaataggcgcgatggccttaaacatgagtaatgggaaaatgcatacttttccaaggaaaccagtaactataggaatagcagggtcgtcaatccaatcaccctgtaacctctttgcaacagcaggatatgtcgcttcaagaatgtccgcatttgtgaaatcatcagtagttataaagccaatatcaaatgcatcatactgcaatcaagcaaaatttagttgagacagcgtcaagctaaaacctggaccaccatcatataccaataactgctcgcactgaaacttcatgtaaacgctgcatgcttaggaacttttaggtgttgatggaacaaaaaggtaccaaataacaattaaaatatactcattataataacaatccattaaaaaagactacacacatatagaagcacaataagatcaacttactatggaacaccagcattgttcctatggtgaaatgaatatgagaaattaaaaggaaacaagaaaaaatgaaaagaactatgaaacaagaaaaaatgaaaagaactatgttttagtggattactcatgtatattttataaataaactgatcgcacgccattttttcttagcaggtttcagttggcagtttaaaggaaagtgatcagctctattgataaggaaagaaatttcttagtttgtgctattgcactagcaataaccatgtacaatctctataaatcaaatgagcaagggataaatgtaatgaagtcccccaaattaccttattcctataacctagtcaatttgctacggtagtaatattctctcatttttttcacaggtccagatgttgcttttttagatagaatatttgaattatattatcatgaaaaggatctagaagctaaattgaaacaaagcactcaacaagccttcaattaaactactgcaccaacacatttactagaagcatgtacctgccgagcctttttcccaagtttattcaaatatgcagcaaatattcttgtagacatgcattcaccgaaggaaacaaggtaatcccgtgtcctaggagttagttctttcatcatagcaacacccttaagaagttgttccaattcttccaataaacctgttgatattaacagtgataaatacagtgcttttatagatggtacagtgctaaagaaagtacttccattaaagacaaaagggacgagaaatgctacattgaccaaaaataaattgatgaccaatggataatatgctgaagaatgattggtgaaagtttaaaatggtattatgatttataactaaggatgcagcataccatgtttcagctgtctaaaatctttcatgtttaaaacatggtgggctataaaacaagtagagaaacctgacaggtttagatcatgagagaagccacatgttccatttcattgtcattagattggggattctaaatagggtaattggagtttattttccatacttgctgcatttaaattatttggttgttgtatgtagaaactggaacaaaacaaacattacaatgtgttttcttccttgtgatgtatatcacctgcacttgccatgtcaattgctgcctcatctactttaagactgctcgatgattatgtgtccattgtatgaattcaaagcattgttagaataagtatgaacattactttagaaaccgctactttagttaaaccaactagggtggaggcactaagctataggatacacaagatcaccttgttgcatacagaatagaaaggtactctgctgaaaatgacataaaatgcatgataacgacctcaagtcttgtcaccaccatacaacattaaaggaaaattggtgttcttgtgtttattgacaatcctcaaccacaaatattgtctaacttctgaaatcaaatttcttcgtatagtaatgaggactgtttgtgtagctaaaaaaaaaatcccatcagagggtggtctttagtttatactgaataaaaacagatatgtggtttagtggatgacaatgccctaatctgaattacctgtagttttgatagaccatcttatggcctttaaaataataaggtcttctaaaccttacaccaaccaggactgtgaaatcgcaatattttgacgactatacatgtgccaaaagatggaaatcaatgcatcaacaagattggaatatacattttgcagtgtaggtttttgccaaccaaaggaaaatgggaagcttcagacagactaagcttccagtgatttttgtgtgtgtgttggttggttggggggaggggggggggattttgtgaaagaagcactggacaatacctgaaacaatcgatctatccaatccaagctcatcaatagtcctgagcaaagcaagaaaaattgaataatcaggagtgaatgctccgaaactaacctgaaatgacgaaaaatgaaaaacgaaacgcacctaacatggagctccttgataactgcgagctcgggaatttcagacgccttcggggcgccgcagctgacagccttctctccggcctgaacaaccaatcaaccactcacagttaagcacagaatggcggtagaaaaatccatacatttcagtttcacaatcacagcgagagctagaaatggttaccaggaggaggttattggtggtcttccccatggcggagagaacaacaacgggagtctcctcggggaagctgagtatgagatcggccacctcccgcatccgctccgccgacgccaccgacgacccgccgaacttcatggcgacggtgaaccccgtcgcggaggaggcggcggcggcggccaccgacgccgcgtcgtccttgttgaggacaaccgccgccgccccgctctggcaccgcaccaccaatcccctcctcctcgaacacctccctcccggcctcgccgccgccgcgcacgcgagatactgctgctccctccccaccctggggggagcggcggccgccggcgagtcccgcgcgacggccgcgaaccggagcgccaccgccatgtcagcaccgaccgaagcttctagatctctcctctcctcacctcttccaaggatcgaagcggaggtggcggcgaggcgaagggggtggttggaggttggagtggggaggagggggttatatagggggaggggaaacggacggcggggagaggcgggccgttgggtttacgcggccagtggacggcgtggatcaaactccgacggcgatcgagacgcggggccccaccgccgccgggacgcagaaaaatgggcgagcgaaaggtgggcggggggacgccgcgacgcgagtgggggtgggcggatgggagggcccacctggaagcgacgtgtgtggtggggtcttcacctcgcgccggttttgttttggaatccaccggctgtctctgtatgtcgatgggaacactgcttgcgattcctacgtcccactccaacattgccaccatgaatatgattggttaaccattttttatttttctctctagaaactaaactaaagttgattttgatctaagcttattagtagtactacattttctttggcatgattcatggctacatctttttttaagcattggcatggcttcagtaaatacttgctcgatctcaggagtatgttttctagttaatttagggcatgtttaattggggaaaagaaaaaattttggggtgtcgtatcggatgtttaaccggatgtcggaagaggtttttggacatgaatgaaaaaactaatttcataactcgtctggaaaccgtgagactaatattttgagcctaattaatccatcattaacacatgcaggttactatagtacttatggctaatcatagactaattagactcaaaagattcgtctcgctatttcttccctaactgtctaattagtttttatttttatctatatttgatgctccatgtatgtgtccaaagatttgatgtgatgtttttgagaaaaaaatttgtgaactaaactgggccttatgctatggtgatcttgttactagtgccaatgtttttcttcatgtttagagttgtgtggattgctgaattgcagggtagatcaggctgatcagtcacccaacaatgtaactgttatttgttataatcagcaggaaagctgacaagcacatatcacttgcagacaataaactgtttccatctttttatgaagaaatgatacccatatatactatcgacgaatgcaccaaacgaaaatctaaaaacctgccactttcagtcttttttttttggttttatgtgatactgattgaattggaagaagacaacaaaacaacaatagatacactgtggatataatgaaataaaaatcttcttcttcttcttcttcttcttcttcttttgaaaaattctggccatacgattgtcaaattcttcttacctgattttcactgacaaattgcatccttcatgcatcggcttaagcaaacaaaataaagagaaataaaaaatcgcaacggtgcaaacatgcaatattgatgcatgaggtgctcataggaggacaaaatgctcagtggaaatcaagtcagctggttaaaaaaagaatccaacaaagatccgtctttagcaactgcccctcacccaaaaatggatttatagataaacttttcaaaaggcacactttataaccgtcttgccattttctttttctctgaacattcatctcaagcttcagagtttcatagcattggaaaaaatatatacagcgtaggagttttattagctgaagggcctgttcactttgatgttattttcaaccttaccaaattttggtaaagttgccaaaaaagtggctatatttagtttcctgccaaattttggtaactatataagaaatcctgccaaaattttggcaaattgccaaaatttaccaaaatttgataaggttttttttggcatcaatgtgaacaagcccgaaatatataaaggaattgatttctgagtctactcccactctgaaagtttcatggttctctgaacccagcaagtagagcgtggtgtgatggtgtcttcctctttgttacttgatcaacagaaaattcagattcactttctctgaatacgcaacgcattcatgcttacaccatggcgcactcgtcaaataaaagaagaatcaagggacaaaacagtgaacagacaaccgtgaatcgtgaataaataaactattggcacttggaagatgtatgcaacaagaacttgaactctgttagtatctctttatgaatggttgagactgaacaagtgaacacagaacacttgtacatattgtggactctgaaaagaatccttccatattgaattcgatcttttttctgcaactgcgtcatctgaatctggatgctggttggagctggacttgtggattatttctggtcaaaattcgtgtgcaaactgttaggcctgacctgcttggaacatgccagctgagctgcagtattttccattcttcatgcatacaagaagcaagagtggacttgtctgacgggcaaaaagacccaatactggtcttatgctttatgtaagaagctcatctgcgattcctggtgccgaaagatactcatgtattctatataatataatgtataaactgattcatgctgatgccaactagtaaaagagaaaacaacggtataatttatttagccttgagagaaaaggacaggcaattagagagtgatagatttggttgaaaggtacattggcccagatcaatcagtggatggatcgactgtttttggttcgacagtgttctgtgccaatggcatcattcatgcattgaggtcatttccatgcactgtgcatatgatcgatgggaagagaaactgtagcaccgaattactagtggccacaggaaggcgagtgatcttcagatattctcttgcacacacccgttgtttgtttcagaaatatccatccattctcttgcgcccaaacagcaaggcaatgaccaacgacgcccagattttccgagtcccagttccgggtacaggacgtctgatcatatcaaaatccaatcaaaatcaacaggtttgtttttttcaggccggccaggaccacgtgaactggtcgagccttgaaggagacacctgaggtccaaggacgaatttacctacctgcaacaacgactaaacactaatcactaatggctactcctatggattattggtgctgctgctgcagcctgctcagcagtttgacactctccatgcaatcatgctcatcacattcctggaggagacaacaagtagttcatcatcaataacataagtacgcatagatgattattcaccaactctgtaaactttattactactatttaccaaagctcaaagctgcaattgcaagttcgcaactgcttgttgagactcgaggagcaggagtacagcacgaaatggatggaggggtaaaaggaaaaagcccatgggccgtaacccgtgttactgaagcctgggcccatctaagctggagttcagagagtgttgcgtccgactctaccgagtcaacgctcggcgacttcatcgagcgcccaaccggggatcctcaccgtccgatccgacacgtgtcggcatcgtgcctccccacagcggcaatcgaggagagagaggagcgcgagtctcccgaagccgcgggcgccacagttggtgaagggaatcatccactcttctctcccacgactcgtcttcgcccccacggattacgcatctcgcctcgcccccatggccgatctccacccgccggagcctgacaccaacggcggcagc

SEQ ID NO: 5252 - DNA, 2672 bp, Oryza sativa
gccgccgccgccgctgccagggctagggtttcggggagccgcaacgccagcggcgacgagtcggacggcgtggcggattggggtctcccgaacggccggctccctgggtccatggggtatggtggcgtgaaggcgtggctggatggacttgggctctctcggtacgcgccagtgttcgagatccacgaggtagacgacgaggtgctcccgctgctaacgttggaagatctcaaggacatgggcatcggcgccgttgggtcgaggaggaagttgtatgccgccatccagaagctccagaggagcgacagcgtttcctgagttggtgagctcttagcttctattgcccccaatttttgtttcatttccatagaaagctgctagtttatggcatttgtcaacccaagtgtgtatataggtttgatgaccatctactccgctagttcgaaaggaattgtttgaacgaaatttgaataatgaatggaataaggtgaatcaactgtatttgctcgtaataaatgtgatcattgtttacttggttttgatatactacttcctatgctgatccttgtgctgtgctttcaagatttaaaaggtgttcttacggattgtcaaattgtactctcaaacccagtagaaataatcatgaaatgataatgattttgattagtgcacgacataaaaggctaaatatagcagactatgcctctgtaaaaccagaggcctcatgactcctacatgcctactgaggcctttctttatttggtcacaactgaaggccttaatctatattgtttggttagtcaacctacaaatttatgttggatatagaactataggtcacctttgttgcacacgaaatctagaagtgttatgcattgtgtgttgtgaaattggaggttgctaattgccagttgctaagtactctggttgatatcgttgcgaacctctattttgagaaagcagccaataattgcagtgtagtgataaaatgtaaattatgtggtcaactagtaaacagaatgaaaccaatccaaaatggaaactacttagtagcctcattactcattagtatgtggctatttgcttatctattgggcaactttaaattcggttgtcagagctaacctacttcatgttgtttagactggttttgtgttgtcagctgactaccttagcaagcttcttctcgatgacttctggctggcaccacagttttttggtagtgtagtaagaggtacatcatacaggcttagtgaggggcaagagctgctgagaacattcaaacagcttcttattaggacacatgaatttttttcttgtaaaggtaaggtaggattacagcttcgagtaggaagggcgcaaatcatactcggcaaaggagtaggtatgcacatgcagcaagacagccacacagatttcataaaaatcaatatgctattcatagtttcctttatggcacatcagcgcactttttcctttgaatcttttcctgaccatggtaggtatatattctcaaaattgctcaggaccagtttctctattttgaccatacgttttaccagaaatcatgagaaatatgatatgtttcgaaacatgtatacattgttcacctcttgagctctgtttaaggtcattgttcaataatgcataaaattaaaccttgcaaaaggctatgaaaggtcaacacatgatccccatgaggaattattccatatcaagtggggaagactattctttgttgaaatgatttccaacaacaacaaaaaaaaaatcaacatcaggtccatagaaactggtatctaactttgtcctcaagtcaatcaacatttatctccatccgttgttggtctgatatagaatgcttaaacagaactttatggcatgaaagccattgaaaactattttcataaatgctgttttatgcccgtaaggtgttcatatgaaaagtaaggcaggtgattgatatcatcataattgaactaattgaaacagtaccaggctatgttccttatgggttccatccatctaatcagcaaaaaatagctacgtgttccttctgtcctatttaatattcatctttaaaattgttgcttatatttgtcagttcattgttgccttgtttgcctgtccgctcttccactgtacttgtcattgacatttcgacatgcttcaacttttgtttgcctattatcatttctatgtcatgcagacaactgatgtagggagttcatcatggcttattaactttcatttttatcaatgatttcaacatgttaattatcgtgcaaatacaattttcaatgtgttgaatttgtttatatcttggttgtgctaatatataacttgactatcttctcagaaacatgcggaaattctggttttatttgtaataacctttttgcaaatacacataatgatttaatttgtacccttaactgatcgcttatatttcaatgctagaacatgttttagacttgcacatattccttacatcatgtacaatctagtactaccatgcaatgtttctccaacttgtgttaacgatgaggtcaactggctaaaaagtggaaatggggggctgagcaagtacggatggcatgtatatttgaagtaaaagaagactttatgggcttgtaattgacaaaaataagtagaccagttattttttagta

SEQ ID NO: 5253 - DNA, 17334 bp, Oryza sativa
ccccagccacatgaatgaatttgctctcgtgtgaccgggcatatcgaatatggtacatgtgaaagaagagcatagcatggtatggaggaatgagataagtatcagatcacctacaataaggatcagatcaagccatcaccctggtcaggtccgtcgtgactgtacatgttccgaagaatggcaaaaagtatcggataaaaagagcagatcatcagactagctgagcctggcatgcgttatggccggcttttgaagagcctactaggcgagtagactttcgacaggtctgcctatctaaggattgatgagggctcaattatatgattcactctgtcagtctcctactattcttgttccatcctccatctgtggcaaaacacatttacaggccactctagtctaatctgcctcctgtggaatcaccttctcgtcttgctggggattcacgcaacctcagctaattcttcaagtaattaggacatgacggagcataaactttgttattacacgcagatattagttcatcatatctcaacaaattaccaatccattctaatcacccaatcttaatttatgaagtaggagtacatctgtgaaggagcaataagtatgtagatgttgaacagcaaagcagcaaaacgtaggggagagaggcatgaaatgaaaggcttgtttagttcgaaaaagaaaattttagggtgtaacaataaacgtttgactgaatattggaaggagttttcggatacgaatgaaaaactaatttcataactcgcctgaaaaccacgagatgaaattattaagcataattaatccatcattagtacatatgggttactgtaacacttatggctaatcatggactagttaggttcaaaagattcgtctcgtgattttcatacaaactgtgcaattaattttttattttatttatatttaatattttatatatatatatccaaagattggaggtgacgtttttggaaaaaaaataatttaggaactaatcaaggccgaagtcgcggctttgctactagctaaattccatttcatttgtactcctatagttgtatgtatctagtgggcacgagcacgaggggcgccttcctgtggagcacgaggccgccggactcctccatgctcagctcctccggcgccatccccaccggcagcgcccagtcgaagcagtgcagcaggttggccagcgtgaactccacgttggcggcgcccatggcgatgccggggcagatccgccgccccgacccgaacggcaggagctcgaagtgcccgccgttgaactccacccgcttcgcctcgaacctgtccgggtcgaacacctccgcctcctcccacctcgccgcgtccctcccgatcgcccacgcgttcaccatcacccgcgtcctcgccgccacctcgtacccgccgatcctcacgtcgcgcatcgtctcccgcggcatcagcagcgtcgccggcgggtgcatccgcagcgtctccttcaccaccatcttgaggtaggcgagcctcggcaggtcgtccggctgcaccatgccgccgccatctcggtcgccgacggtggccctgatctcggcttgcaccttccgcatcacccgcggcgaccgcatcagctccgccatcgcccacaggatcgtcaccgagctcgtcccgatcccaccgatgaacgcgtcctgcaattacaagcaaagatcgccgtcacgatcgccatgcgtggcaggtgtttgtgtatttgactagctgacgacgacgacgtgtgctgctgctgcttacgaagatgatggccttgacgttctccctggtgaaccggcgatcgccgtactgcttcccctgcttccacaggccgatcagggcgccgacgaggttgccgccgccgccgccggcgttgctgctgtcagagtcaagatgctgctcgatgaccatctcgaagaaggcgtcgagctgttggaagacgcgctctcggtgggcgatgaggccggtgaggtggtcgaagaggcgggcggcggcggcgttggggaagaagtcctcggcggagaagctggcgagcatgtccatgacgtcgtcgagcaggtggtggaagcgcttcctgccgccgccggcgaaccgctccgtgccgtagatgctgccgaacgccaccgcgccgatgatgccgtcggtcagggcgaagatgtgatcgttcagctccaccggctccggctccggccgtgtcagcttcccgatcagcttctccacctgccaagtgccaagccatacgttgtatcactgccatatttcaatcatcaacacatctaaggtaaaaccctacagatttcactataataaaaattatggtagtacggagtagtaatatttatgatcgaatcttttattttgatttaaatgttgtcaattatttaagaactgtataactatttgattgatgtttgaaacgtgatgagtaaatgaatgtatatgcacttgattagattgcaaaatcctccatatatcaaccaatacgaattagatactataacgtttgatcatttatattaatttaaaaattagtataaatatgtaaaagtataaagttgagattttaatttagttgatgtaaaaaatcataagaaaataaattatatctatattttttttaataagacggatgataaatataatgttaaaagtaaacaacttcgtatattaaaaaatggaggaagcatgtaagtacattacatgatctgattaaggtgcaaatttgttgtctcctctctctcattaacttataacatctcaactaaactattttaatcatatttatgtttattaaagctggagatgagaaccaagcaccttctagattattaattttaatgtatagataaagtaattcacttgtcaaatccacttgcaccgatgctttccattttgtcaaatgcatgcaacttccccccaacagctagcgagatttccatatatccaataataggtggaaacatacagacgaagacaaaatcgcgaatctgctactcgttatcttcttccgtacccccgtcccacaaaaatccaagttttttatataataaatctaagataaaaacttatttacatttatgtacaagaaaatatatcatgccattttaaattggttttctaagggacatagggagtagctagtactatatctatcccaaaataattgcatttttaggatttaaaatttatcccaaaacagttgtcactctagagtactaattgttccatcaatgatatctcatttaaattgctctcaattttaccctcaaccaccctcacaatctcacatattcaccatttaatgaaggacatctttcttcttgaaccttaatacttaaaactataattatttcggtatggaggtaatagctagctaccagcctaccaccaaccaattatcaacatgtcatcatcaagggcatgtacaatgaaaatgtctccttcacctcaccatccaagcaggcctatcatacatgtgtggaaattttgcccacttggtagatggaaattgtgtgtaccacacagtagggagacaaacaagatgcaggctatcgttgtactgtactgtacctggtcctggcgcgcgcgccatgcggcctggacgcgcggcgcgctgaagagctcggcgacgaacagccggcgcgccgcgcggccgtaggcgtcgtacggcgcgaacgccacgtccttgtacccgtacgacagccgcatcggccccggcgaggacggccggctgcagcagtcggcgtcgtgcgttctcagcaccttctgcgccgccttcggcgaggacaccaccaccggcggcaccgcgcccagccgcagcatcatcaccggcccgtgccgccgcgccagatcccgcaggctccggtgcggcagcgcgcccagctggagcaggttgcccaggaccggcagccgcgctgggcccggaggcagtctaagatgccgccggcgacgacggccgccggtgttcctgccaattaccaacaggagggaggcgattgggaggaggaggaggagtaggaggagctgccattgttgaggcagagctggagcttggagagcagcgtcgccatcactgggctttgctattgctctcgctctctcatactcgtcctatcttacgtgtatgaccgacctgccttcccgttcctgctagcttctggtggtatatataggaagtggattttgagtcctggagggaatatttacttgtgtccgtatgttacttaaatatagatatgattttttttaaaaaatataagaagttgtattaacatgtaatatatataagttcaaattcaactctgcatatgcagccgttgagttatttcgcgttgcagatacgaacgcgtgttcttcccgaacctgtcgagggggttcggagttttattccccgaaaaccagctagctatttatagcccatggttctttcagcttactgggcctgtattatttgattgggccttaatgggccaagctccaggcggcccgcctacacctactggattctgacgtggggcccacctgacacgcttactttctcgcccttttggagctccctcccctcttcgacgattcaaaaatccctcttctcctgtccgcttcctctccggccgccgccgctagggtttggtttccgccgcctcctccggctggtcccgtcccgcccgccgccgcctctgctctccttgttccggtatgcctctttgactcccgacaccttcatgcttggattttccggtaatgctgctgggttccgccggcgctgatgaccagcgaccgcctcctccgacttccgtatgcgcgatttcgtcgctgccgcgagctgaggggtcactcctgtagtagtagcgaacgccgatacggtgagtgccgtacggagtggcctaccgagtgactgaagtgtgtatgccgtagtagcgtcctgttttttgatgactgtggggagagtttgacatatattgattgaagtacctaagagctaagttcagtgtatgtagtgagtttgtatgtcattccatgaagttaattttccaatctttgacgtcctgaagtattctgtagttttataccaacttttgtgtatcatcattttaaacaatcgtgtatgaaaattgaaatgcagtttgttgacttgtactgcttatagctgattcctttctcatcttcctctaggtcagcaccctgaaagttgcacaataaccctgagcagtcttcaccaaggaaacgggctgtctgcttgtctgatgtgctattcttgttctggtatataaatcggctgctatttaggacacttcttgattgaaaatgccaacaagaaaaaaaggccttgcaagaaatgccaccactgagcatatcaatcccccaaatagccgaaaatcaagcagatcaactcaggctgcagctgctgaacataaagtcaatgatctgatcacttcttcctccaaaaagcagatcggtaaagtttcccctactattatgtacagtacaaagctatagcctatttataggaatgtatgaaactatgagtatgggagagtaaactgaaaacttccagagcttttcatcctacttgttgtgttctgcagtgctcattatatccaagcttattcctgatgtttaagtgccttttttttgtccactactacaattatgcttggtattatttgggaaattattcttcaattttcctttatctttagttttcttgaaattggttgtggctccacatagatttttcttgattttgttccaaatatgaattgctacctctgcaggtggaggccttctgaagaaaaatcgagctcttaggggtgggaaaaaattgaattctatttatgattctgctggtactggaaatgatgtcgcgggcgtgccaagtagcagtttcttcaatcacaaggtaaagttctttctgctcaaagtgaattttttagctggtcaggtgttgtctatttgtgtaatcatacattttaacatacggtgtgtttcgataaaagcgaaaaaagaaaaaagaggaaagcaatattgtttctgaaataacctcaaattgactgttgctttatcctttacttatttgtctggttgatctttttctattgctagcaatctcatgaaaatgatgaagatcgttcatgtgattccatattttctcccagttttcacaatcagaaggaagatgttactgactgcttgagcgaaggtaccttttgaatataactccaccttagcatttattttctgcactccaagtgtcagatctgtgtttgaatttttcacatgcatttatctagagaataagaaaaacaacattttttagatgacttcatgatagtgtacattgcatatttagatgcactctgtgcatactgatacctgctgcattgcttctccagtttgtattttccaatacgccattgtcattatgcaggcttagtacatgaagaagtcatacatgagcctgttcagaatgctgaatatgttaccaatagcatatcatgcaatacttttgatggtttgagcaaacactcttatgatattcatatgcaatcggcatgtggaagcacgctcgaaggtgatgaattcagtgaattgggcagcctttctcctgaagtgtctgctatatatcttgcaatgcagcactcaaagctagagtgtattgatgaacaaagccaagattctacctcaacagatgggtgtgctgatcctgatgaaactgtagagcttgattattttgatccgtatgccttcataaaagatttgcctgatttatctttggtggttcccaagtttcaacctgttcttcttccaaagcaaactcggagctgtcctagaactacccttgtccttgatctggatggtaagatgtgaatgttgtgcacactttaacttggatagactcttggtaaactcctttaatggaatcattaatgattatgtttcttccaaagtcaataatctgtgattagcttggaaatgttaaagctcatgagacctggattttgcacagttataagtttatgtcaaaatggattgcatattgttattaggatcgtgtaacttgcttattattccacttatgatataattgtaaagcatgttgcttagcttttagtgagtactccctccatcccataaaaaaacaacctagtaccggatgtgacctctgtctagattcgtagtactaggatgtgtcacatccggtcctagattcgttttttatgggacggagggagtagagaacatccaccctatgagatgtgtgcacattcctgttctgtttagcttcaatatctccggttgttcatttacttgatcatatacagtctgtcctgttgtttggtgttagccattacatgtaacctctgtactttatattgtgcagtcaatgttaatgtaccattattggtatgctgtcatgcaaagacactggtgcactctactcttgagccctgtgaagattctgacttcacattcccagttcattttaatctcagagagcacacaatctatgtgcgttgccgtccatatctgaaagagttcttggagacagtagcaagcatgtttgagatcatcattttcacagctagtcaaagtatttatgcagaacagctacttaatattcttgatcctaaaaggaggttgttccgccatcgagtttaccgcgagtcctgtctctttgtggagggaaactacttaaaggatctatcagttcttggacgtgacttggctcgtgtggtcattgttgataattcaccacaggtatgtgctaaaactgtactccctccgtactcgtaaagtaagttgtttaggacagcgacacggtctccaaaacacaactttgacttcttatttctataaaaatatttattgaaaagtgatatatgtatacttttatgaaagtatttttcaagaccaatctattcatataatttttacattttgaaactcaataacttgagagttattcatgatttatattcccaaggtttgacttaaacattgtcctaaacgacttcctttacgagtacggaaggagtacacatttcttcctttttaagaaaacacacatctttcattccatgggttttaaaaataatttctaacaaagtagtgggatgttaaagcaaacctagttatcaatagtctctttgcgttgtttagcattataatttgtaatgtgtaaatattgggtgatagggctacatatgttagctcgagggtaaaattcataattcaacattctaatagtagacatggacttgatgaagaaaaagaataaagttttttttttttttgggtcagtgatcaatgatgtttgtattagtcagtttctctgtcttctcctggcagtacagcaaatctatccactggacttgtcactatattctcagcctctcaggtttcaaaatcttcatctgtagtaatagtcgtggaacattcttagttggatatggtatagaatttctactttctgttagtacagcagtgcttaagaaagggctattgctcattgggccttatagtgaaatttctgttggacccgagcaatagtactttgggtgcaatttgattcctttttctttgaaatgaaattctaataagtttgtttctattcatttggaatagcctcagtttcttgtagcctgtattgagatttctatgctattagctgcgatttacctcctttttttgtcacgtcagttttgcaatcttagtagcactagtaataagtagacgaaccaaaagtatagttgctaatacatctgtatcttgctttcaggcctttgggttccaattagacaacggcgtccctattgaaagttggtttgatgatcgtaatgacagagaactcctaacattacttccatttttgcaaagtttggttggggtggaagatgtccggccatgtattgcaaggaagttcaaccttcgtgagaaggttgccactgcaccttctctctctatgcacttttagatgatcaaatcattttctgggatatagagaaataaattgaagtggcagttgtactctatagagaaggaaaacatgggcagttgtgtgaattgctggagaggacccaaggtggtgaattatctgtatctttgccctggtgtaatcctgtgtacttggaacccataaaatcgtgtaaaatatgctctgttgtactaatatttatacctgaagaactagggaatcctgtgttagcattaagttaaaatactctacatgagagttggcatggccttcttgttgtgcattgcagatagaactgctcagcacacaatagattatcctcttggtccagtgagtctgtaattgtcgaaagtaatgttctatccatatgctccagtatgtacttgtcaaaaataatgttgcagatagaataaatccgcatttctattttcactgctttgtttgattgtcagttggtgtgctttcttaccacagcctttctcctaaaatttattttgttgttgtattgaagaaaaaaaaaagaaaagaaaagaaaactggagactagtagtagtgcttcctccatttcattttaagtgtatataagtttccgtgctcaactttgatcattcatcttatttaaatttttttaataattagtagtatttttattgttatgagataataaaatataaatagtactttatgcgtgacttatgtttttaatttttttttaaaaaaaatttaaataagacggacaattaaaattaggtacggaaaataggtggagggagtagcattttatccatttttgtctggtagaaaacgatgctgaacgagtcgatgggggagggggacgccgcctacgccaagcgcgtgctgctcaccgccgccggcgacgacgtctcccgggggatcgcctccaccctcgccacccatggctgccggtacgtacgtacggacctcttgcctcgccgtgctctccactctccctctctaattcgtcctctcccgccgtagattggttttggtcggcgacgagggcgccctggctgggacggcgaagcaggcgcggcacggtgggggcgaagaaaatgcggtcgctgtggtggggctggatctccacggctgcgacgaggcggccgtcgacgcggcggtgggcacggcgtggcgctgcttcgacggcctagacgccatggtgaactgctactcctacgagggtccgtacactacttctgaatttctgtatgctgttcctgcagagctaattcttagttgttcctctgcatttcaaaagaaaattcctccggtcgacttcaattcgtgtactcgtagctgagaaccacaacatttcgccatgctctaagctcaatccaaacagtctgcccagtgctcacctaattttaattttagagaaaattccctatctgatctttcatagattactacccgagaaaatgtgccttgggcaatgggtggatcagtctgtctgtcaactatgaactgttgaaatttcactgtaaatttctgcaacaataaagtgaattgtatttttatatgtacttcatgtcgcattctccgtagctttcttaataagtgccttagttcacaaaaccagtatcagatagatattgttgtcagtaataggatacaactgaaaggatcaattggttagtgcttgtaccctgtatgcctggtgatcaaacttaaccacgatatgacacaatctggaaccccctacttcagcaaaatggcgctttgttttcatttacaaatgtttgtttttcccaaatgggcaggtgaagtacaagactgcctcaatataagcgaagatgagttcaagaagacaatgaaagcgaatgtaatgacaccttggtttctagtaaaggcaattgcaaagcgactccgggactcagaatccagttgtggagggtctgttgtattcttaactcagattattggtgctgagagaggattgtatcctggtgctgctgcatatggtacaagtttaggtgccattcaccaattggtccgggtaagtcttctgttcaagtactgccaactgactagtaccattgttctcccttcatcattgagagctgctgctttacttctctatgctttgctcaaagcttgaaaatgttaagcttgcaatgcacttgaaatgaagaaatgcatacatttagatggcagtatgtttcagttgaaaactaacagacgaccctgatagttctgaactgggaaaaaaggatcctggccaaatatatgttgttcttgagaaaagagcctccaatcctccataaacagcacttccggttcaatcaacaactgattctgtttgtgttgaattcgagcaccactcaaatcaagaggtaaacgtttgttgtttcttcagctgtcagcaatggagctgggcaagcacaataaccggctgacaactccagcagttctgaactgaagaaatatctcagctggccatatttatgcttttcttcataaacatgcttgaatcagcataactctgtagacgatacttgcattgcagttaacaattgattcgatccatgttgatctcgaaatataacactcataactgtaagaggtactaaatgtttgttgtgttcttcagctgtcagcaatggagctgggcaagcacaagatgagggtgaacgcggtgtgccgtgggctgcacctgggcgacaggttcccggtgtgggtggggaaggagaaggcggagaaggcgacgggggaggtgatgccgctgcggagatggctggacccggagaaggacgtggcgtccacggtgctgtacctggttggggacgagtcccggtacatgactggcagcaccatattcgtggatggcgcccagtccatcgtgcgcccgcgcatgcgctccttcatgtagatcatcacatcaccgtacgtgataataagcaactactagtaatagtagggagatccataacaataacaaggagagctccatcatgggtttctgctctgtagctgtgtgttcagatgaacaatttgctgtctgtaatgatcgagaagacagtacaaagttgtgttctgagattagtatgtacgccgcaggcaacgtgccatgatctgagccttctggtatatgtacgatctcggatacgtcagctcttatttgaaaaacactctcatagctgtatgtaagatcatttttttttgacatatgacaagttaaatgtatatggttaaaagagttataaaaatatttcgtctaaagtgaaaacagtgattagaaagatccaaagcgtaatatatgcaataaaaagtgatccttcaagtttggtaaaagggagggtgtacatgaatatgaatatgatccaaccgcccttatataaatcaaggtttctttttcgtttttgtttcaggatccgctcgtccaactgcggcgacggcggcaacagattgatcgaccgcctccgtctcggcgcctagctagctcggtgaagtttctcctaccggccgctccatcttggtgacgccggattattagtgtcataaagtaagtcacttgcataagtatatgagctctcagtggtgcatggttttactttacatcggtgcttttaccgtttagcatttgaaagatagcacttgtgttgaagaccactcagagatatactgtattatgtagtgatgctggggtgtttgaatacttttgggtaacaaaactgaaaagaaatttggaaaggacgggaaagggccacattttcaacttgcacatcttcaaacggcgccgtgcactgttagtagtagggcctaacaggccgatcctttttaggcccatcaaatttattgggccaaaaaaatcctagctctgagggcccaaaagaatttgttcgcgagaggaaaatgtcttgtttggaccatcaattaatcaaaagaagaaacaaacatgaggcatgtggctcttgcactgatcccccgagacagttttgagatgggatagtataatctttctgaattttgttttgttgcctctctctttggatggatgtacttctcattcaatcatagctgaagacatgatgacatctttacatctaaagtactatcatatcatatcatatcatatagtttgcccatcatgcgtatacttgtctgccgtcaggtatacagtaatataacttgaaatcgacccatcaatctacaacaaaccaaaaaaaacaaaattcgccctttcatgtgcaaataaagctatcttcctgactgtacgtagcctacaacaccagatactgcccgatcgacaatcaaaatcaatggatgcatttaccaggcacagtccacctggcattgggctttgcccagggtggcaacctggtgtagttcttccagtcagcaagaacacccttgagatcactgatcttggattggaggccgatgcagcagttggcgtgcatggtgcagatcttgctcagatccttgccgtagctgcagaatccgccgatgtaggccgtgtccaggtactgaaccttgagcttcagcttcttcaccagcttcttcttgatgtggttgaacaccggctgctcgttgagccccgggtgcgagctcctcgcctcgtgccactccttggtcatggcgatcgtcctcgcgctcggcttcacgtagaagaagcccgtgtttgggaagttgtcgatgttgtccgggtcaccgaagaacacgtcgctcgagatcgccatgtccgcgtacaccgccacgtgcttgaacggattcctcagccacacaatgtcaacgtcctgatcttgcaattggttaattaatcagttcatcttgatttgcagtcaatggcggtgttaatttcaatttacagttactgaattaccgtgaagaggaagttgtagccgagctggagaattcggcgctggagcttgagcttgctccagacgagctcgaggtagtccttggaggcgaagaacttctcggaggtgaagtcgacgtcgaggccgggcatggtgtagaggtagcagtgggggtggacggcgcggcaccgggtgagcgcggtgggatccatggcgacgacgaggacgtggcggaggagctccggcgtgccgtcgccgacgcggaagccctggaggaagatgtccaggagcgagtcgggcgccgcgaacgcgtggttcacgcacgtgatgatcaccgtccggtcatccgtcgccgcccgcgccaccgccgccgccaacccccggaactcgccgccctgccgccattgatgatcaaattagcgtgaatcactaggtggtgtaagatcctaggactttctttgccacttttcgtacactcgaaacaagtacaaaaaggtaatcaaggatcgagattaatatataacaaattgattagcctatctctttttcgaagtcaaaatagtagatcaagtctcatggaatgatttctgaattcgtggttatatgtagcatatatcttacaaaatcattttcttggtgcatttggcagacacccaaaaagggttagttgtgtcctactgaaattgaagaaccccctgtttttattatgatgagttgtactgttgagttaattttgaacatgtgaggaaactgtgggcaacagagtgaattcaagacggcacaaatttagcagattactgataccagatgacgcataagaaattaaagaagtgaaaattaattaagccgggagattaatgagaactaacctcttcttcaagatctgtactggttgctggaatatgatgagttggtgaagatgcagtagaggtcgcaggaggcttggttggcggctgctcctcggcgacagcagtagcagtcgtcggaggcttgccggtgatgttagcctcctcgccgccacgtgcgatcaccggcggcggcggcgccgttccattgccgccgcagtgcagcagcagctggtctctggaggtggagaactgcaccggcgacctggcggcgcggccgtagtccggcggcgcctggtactggaagagcagcatgacggtgagcgtggccacgcagccgagcacgaacgacgccgcctgccgccccgtcgcctccgtgaccgccaccttgggcgccatggacgatgagatgaattgatcgatcgagctaagtctctgcagcgggcagagtgctaaactaatatagatcgagacgtgtacgcactgtaccaagacgacgactgctgctgctactactgctaacttcgttccaaaataaatacagtcgtgagtttctgtgtccaatttattttatttaaacatttttaaaaaataaaaaacataagtcatatataaagtactattcatatgtatgaatgtgaacaatactaaaaaattttataatataaaacggagaaagtattatactaatcataaaaatttcaaataagatgagttggacacggaaacttatggctgcacttattttgggctggagggagtaggagctatcagcagcggccgtgtatgtatgtatcatgtatgtatgcagtatttatttgtgtatttgtatacgtaggtgtagatgtggcaatcgatgggttgcagttaacgaggcgtacgaagatagctgccttgccgtttccttccctgaaatagctgctactccactacaagtcgacgaattcgatcgagcactagctgctgttactacgtactccctgctgtaactgacgcgagaaatactccattctcgaccgattcatccaaattggtgccatcactaccctcgatcactaaagaattagactagtccatgctttggaagcttcgctgcaagtagcaaaggagatacctgtgtatgtatggatcgaaaattcgaatttaagaataataaataggtgtagtaaccgtatagtatgcatgagtgtgtactactatatgatattcagctggtaaactgtctagctagctactagctagtgtttaattttgatatgtgcgaactgatgatcgagctgagcaatgcatgggtgtggtagtactaaagtataattaagctactgatcaaattcgatcggcttgagagttagtgccgggaggatgggcgcacatggcgacgaacatgagttggcgtgggtgacggatctctcgctttgactactcgatcgccaccgaaatgtatgtactccatgagtatgtatatatgttcttggcaatacatggagaattcatcaactaactagtgctccatggttacatattgaggtgagcgttgctgcttaatttcccggacggaccgggcatgctgccatgtacacatgcacctcataatctgtagtatcaatcatcagaaatgtttagaaacgtattatctattatattcagatatgccaactgctgctggatccatggcactgctcatactacagtgagtgagtacagcagcttaccgaataaagtgcaataccatttacgtctcaaactcctcctccttgaaaatgctctaattatcctccacttcaacagatgctaattcatggatttcctaactgcactaaactactgcaaggcattgagctgcttaattcaggtatctctctgttcaacgtgatctgcgggcaattaaattaaacagcagactgaccaggcacatactggaagtctggaagtagcaaaccagtcgctggccttttctgcaacagtatttgtatttcagctaacctgtcaattagtgatcgatgcgttgtatgacgtgacagcaactgctacgtggcgttgctgcatcatatatatgaacagttcctcagtttacttgcagagaaggttcgcacttagattagcatagcaataactaaatgctgcacagtgctgctacttaatttggttactagtactgtagtactatgtgtactggtggtagtagcttagctaggatccattgattccgccggttttagagaatcttgtagtgatgtagtcgctgctgcgaagtgccacgaatcattggtcattcatatgttcatctaccatttgctcaacttgttaggtttcatctgcgatgctacttgtttgttcggtccatctgctacctacttaaactactcgatctatcgatgagacgatgacttttgccttagttaattggacctgcgattaattaaccaacatgatggcacaaatttattttgctgtcattagctaattaagttcaactgctgtgtccactacgctgactgcacgtacacacgtctgcatattttattttttttaaagaaaaactagcaatacatgcagtctttgctggtatccacagattgataccgctggatctgtatatcactggtggagaaatgctttttagtcccgtttcgtaacccccctgtagtcccggttggggactacgaatccgggacta

SEQ ID NO: 5254 - DNA, 5647 bp, Oryza sativa
tgtgtggacgggaaaagaggatcggtactatggattatatagtgtgttttgatttttattcccggttagtaataccaaccgggactaaaaataggtttttagtcccggttggtgttactaaccgggactaaagatcatagagccctgacacagcctgacatggaatcaaccgggactaaaaatcatctttagtcccggttggagttaccaaccgggactaaagatgatctttagtcccggttggtaacaacaaccgggactaaagatcttcctcttattaaccgggactaaaaatcatttttagtcccggtttttaatggaaccgggactattgtggatatgggtcgaccgactaaagatggtttctctaccagtatatggcatttgaactagggttgatgaatttctccgtgctagctcctaacccgatcctgacacttaagcttagtctaaggagctctctacttcccaaacttaattagccaattatacaatactatatattatcctgacacttaagcttaatctaaggattttctacttatggcccctttgatttagaggaaaaacataagaattttagaggatttcaatcctataggaaaatttcctatgaagccctttaaaacaaaggattgaatcctatctaatcctttgaaattcctatggaatggacaattctatagagattttggaggaaatttagcaagaccttcaacctcttgctaactttcctttgagtctatctctctcatccaattcatgtgtttttcctatggttcaattaaacggtcattcctgtgttttgcaatcctctattttatacttacattcctatcaaaatcctacgtttttcctattcctacgttttctcaatcctgcgattcaaaggggccttagcaaacttaattatctaattagaaaggtgactaaaatgagagaccatgattttatctttgcacttaagcttagtctaaggagttctctacttatcaaacttacttagccgattagagttagaaaggtgaataaaatgaaagaccataacatttttcaaacgaccaaatagattgattaacgttatattaatagaagggagtttagctgggatttgggttgggaagacttttccgctaatcgattgatcatcgcatttatactgttggccaacagtggcgactgcctggtatggtcattatcgactcatactccaatatgtttataccaactattatatttaaatggccagcagtggagtaataagtaacaatctattatttaaattatgataagattcactcatatatgtttatacaaacttgttactagtaagcattagatcagctgcagattggttgcatcaggtgtacgtacagaaatccttccaacaaaaagcatatgtaccatatgacaatatgtacttatgttgttaacttgttctagaattaactttccatcgagagatttaatcggttaatgacactcacgttcccctggtagccgttgtatatcattttcaggtcaagaataaactaagatatgaacatcacatccatacccatccgacgattaagttaggtggccaatcactcttaccatccatatatgcatatgctccattagttagtacggagtacttctttccaaaatagtataaacattgtcaagtaaatagccaggaatgcttattcgtctagttgcacaatcagaaatatttatattttcaaatggagggattactcaacttttacttacaggcaggggaagtcagtactgagtagctagctaattaccccgttgatcatgcaactatgcagtgacagattctgccagaatttggttcatggccgctagctgcagggcatgtgtgatgtccccagtttgaacagtagagagcagccggcagtatgcacatatgctgcatttaaggaggagttaggaccggagtaggagtactagtacttgtttattaatcactcatctattagcataatggtccatggtgaaagtacagcaaaattaggtgaaggtaacgtcgatattagttgtatagaatcatagaccatcttcccaacagtggtactttcagatcatctgtccttgtttccgtccctgttggagagcgacaatcggaatggtcactgacaagggacctctctgttgcccggaaacgacgaaacatccagttcagagttgcagacttcagacagttgccaaggatcaatggaaaattgcaactgaaaatgctggagactgcattgagattgaatattaattcctccaactataattgaatttcatccatatttttggaactagatgaatatgatatccataattgtttttaccctgggtaatctttagacctatgttatttgtttgtttttatgtgatgttcacatccatgttccatcaaaccatgtattcaacctgtattagaggttgttatttggttcaatgcttcaacttgccacacctctttagacttgtgtttggttcattgctatagttgtggcttacctatacttttttatcttgtctcgcatatcatagacttaatctttatctaattttaccatacttgtctagaatgagttatggcaatattagtaaagatccaaacaaccctgatcttcttattgggcttctcttaagtttatatgcaactggtcccttttaggcccgaaagcttgttcagtatgtgtgctgggccgtatggaaccatgacttatagaaacttctggcctgctcgggccctgagcccctgagcctattctttgtcgagactaattgggatgtggccttttgggttttcaggcaatagaacagtgtgagaatgctaccctcttatcctggcccatttattccacgaagctgaaatttattttagccttttgggttttcagaaataaaaaagattatgcaagtgtttgaaccctttattttcggtctctggacctattcagattgtagtcaaaataaaccttaccaatttttggcaatgccattctaaaattttggcaggatttcttatgtattgatcaaattttgcaacaaactaaatgtagatatgtttttggtaactttgccaaaaaaaaatgatgtgattgaaaatggcatcaaagtgaacagaccctcaataacggagtaccggcccatttattttatcattttgttccggcccatttattcctcaaagcagcagcctttaacgatgtatggcccgtatgaactttacggccttaatcagaggcacagtgttaagaccgtaaagttaggcccactacatatggttgagtaattcagtgttgccaccagcgccgcataaatatcttgggataaactaacttttgaatccagaaatagaagaaaaaaatagtctggacacatgcttgatggttgatgcaagctgatgcactcttttatctttacagagggagctccaggatacaagcatatgctagaattaatttttatacatacgtacgtaggtataaatatatggtgtaataacttaatatatagattttcctaacttgacaaaaagaatcggcgcaactaataattgaggagaaagaatttggcagctcgagaaattaaccggcctgcagacgagcgatcgcctagctaaccaagcaaccaaggcaatccgatccagcaatgctgatcaacgcccgtccgccgcctactttttataccgtgattctaaaaatcgaacataactattgttgcaattcattttttattttctagaagtcccgtcaaccgtcagcggctctgcaactatactcttacacaccccgcccgctgcttctcctttttattgtcattgagattttaaaattcgaatatgattatcaatgttgttttttttttaactttctagaagtcccggcaaccgcctttcatgtttgcttcacggcctgcctaacgtccttctttttaatcgtcattaggattctatttggtgttttattaacaatttttatatggcgtatcaaccgccaccaactctactcatttataggcatgttatttaatttatctcgtcatgtgttttagatggtcttttctttcaatagtctttatttttatcaaaaattttagttatttataaattttattcataattgaaatcttttttttttctaatttcagaatttactttttttaaaaaaaatagttgatatcgtattgtgttcttttaatgtttttatttttaattttcaatttcagttgtttcataattgtatttctacttgaactctcttttaattttttctaattttagatattattatattttttattcgaaattttaattaatctcgtatcgggttcttatatggattcttctttcaatattgcttatttttaattctgagtttcagttaattttaaattgtattcctacttggactcttctttattttcttttgctaatttcggatttatttttatttttattctgaattttaattaatctcgtattaggttcttatatggattcttcttttaatatttcttatttttaattccgaatttcagctatttttaaattgtattcctacttggactctcattttcttttctaattttgaattttattttatttttatttcgaattttgattaatctcgtattgggttcttatatggaaacttctcctttccttttctaattttggattttattttattttatttcgaattttgattaacctcttattgggtttattgggttcttatatgaaaacttctttcaatattgtttatttttaatttcaaattttaactatttttaaattgtacttttacttggactctccttttcttctttttctttttattcaattaacgtgagaatttctagtctcaacagcgaacgtggtgcctcctttcaaagctgtctttatataatataatataatagatataatagataggtagataatagcctggacacatgcttgatgattgatgcaaagctgatgcattcttttatctttacagaggagctccgggatacaagcatgctagaattaatctgtatacatacgtacgtacgtacgtacgtataaatatatgatgtaataacttaatatatagattttcctaacttgacaaaaagaatcggcgcaactaataattgaggagaaagaatttggcagctcgagaaattaaccggcctgcagtcgagcgatcgcctagctaaattaaccaagcagccaaggcaatccagcaatgctgaacgctgcgtgtatatgcatatgaacatatgatcgatcgatcgatcagtggatgcagatgccggggagcttccactggaacttgcccgagcgccgctcgtcgggcggcgccgccgtgtagttcctccagacgtcgaggacgcctcggaggtcgtgcatcttggcgccgaggccaacacagcagttggcatggagcgtgcagatcttgttcagatccttgctgagctgacagaagccactgatgtaggtggtgtcgaggaactggatggcgatgcccagcttcgcctgctgctcgtgcttgatcaggttgaacacgtcctgctcgtgctttccgaagaatcgccacctcccttgctgccaactccggtagaaatcgagggtcttgtcgttggatcgcac

SEQ ID NO: 5255 - DNA, 23628 bp, Oryza sativa
cattgattggattaattgtactcctggattagtatgcaattcgcaagtcattctctgaattttgcaatcaatcagtgagagcgccatcaggccaggaaaaccgggcatgagcgtgtctgcttcctcttgctcaacggaatctttcagtttcacaggttcagttttttcggtcgcctgtacgcgaaagacaagccacaagttccaatccaaatggacggccgggccgacaacaacacgagtagagtagagtatagacgaacgtgtcaaagtccaaaccaaacggtttagtccaacttctctcgaatcggctgcgtctctgcttagccgaggacatttctgcccagcaactatgatgaaactgtagtgcacgagagctaagctaagctagctagccaagcagagcactagcagccaatgtatcgcccaatccggccaactcaaccaccacttcgatggaacacatagtatattgcatcgaaaacgacatgaaaatgaatttatatattgcaattgaagcgtgaaaagaagaaaataatttagtactgaccgtgaagaggaagttgtagccgagctcaaggatggtctgctgaaacttgttgcgaccccacatcatctcgaggtagtccttgctcatgaacatcttctcggagcggtagtcgacgccggtggtgcggaggaagtagcaatggcggtgcaccgcctggcacccctcgtacgccgcggggtccatggtgacgatcaccaggtggtccagcagccgcgacacgccgccctccccgagcctgaagctctcgaagaagaggtccagcagcgaccccggcttcgtccacgccaggttgatctgcgtcatgatcaccgtcctgtccttggtcgccgctcgccggagcacctcctccaggtcgccgtaaggggacgccggcgccggagcctgcacattgtatatgcacacatgattcatgattggtttctgttcacatttcatgatcagtgcagatatgagatgactacagagttggatttttttgcttcatgatcactacaaactgaactccaagaattggatttttgctgcatgcatgtgacgagttggttgcgtctctatggttcagcattggctgacaagtggggccatttttttttggaagaattgagctatgggcagcaactaaagctgagtatagcagcaatctaggagaagacacgcccatgaatgccatgctgcaactagcaaatgagctcaaaccattccttcattttatctctttttatgcaagattttattttcaacaattgaaacggccaatgcattttcttctgaacaacgacatgtgctacctcacatggttgaaccaagaatagattttgcctgtcagtaagacatactactctgtcccatagaaaatctaattctagttacaaacttttacacacatatgtctagattcgtagctagaattggttgcgaacccgtcttctctctttagccttagagcaggtttaataaagcaggcgactgccggcggtaaaaaacaccacatcagcgatagagataactatgagataactagaagatgggtgtatgtacagctgctggctatacgcacaagcaccaatgaattgattatcatttttttacgcccaatccgtctgtacccgcgcattgcctcgcgtagacccacacgcagccatgggataagctttttctacagtttctttcttcttgaagttcgtgtgtagtcggcgacaatttaggtggtgtttggatccagtgatttaactttagtccctgtatttagacactaatttaaagtattaaatatagactacttacaaaactaattacataaatggaagctaatttgcgagacaaaatttttaagcctaactaatcaataattagagaatgtctactgtagcatcacataggctaattatggattaattagactcaatagattcgtctcgcaaattagtccaagattatggatgggttttattaatagtctacgtttaatatttataattattgtccaaacatctgatgtgatagggacttaaaagttttagccccatttaaacagggccttagtcgtccgctaacaccctctctcctggttttttccatccagctcatcactttggccaggttggatgcgctatcgccggcttaaaccgtatattgtacctgctcttacgcgaaaaccgccagacagaggcgtcatgggccggctgaacatccatcgccgatcagtcacacatggaccgtccgatcgggagccggactactagccgtttccggtgccacgtgtacccatcccactgcgatggccggtgacacgtgtgagaacatggcagcagtggcagtaaacctgtgggacccatgccgacagcagctacaggtaaaaaggagctagtagaacgcgatgagtcaccaggtctagactagttacatcatgtggagaagaagggaattagctgctggtgttaacaagtgtgattagtagtaatagtgtttacatggggagaggggaaagacaaaagtggttgggagaaaggggagaagatgggagcaagaaagcaggtgtcaatggcgagcattagcatagaggcaggaccgtgtctttgtgttgtaatctagactgactaggtaaataaactattactggtatggtaatctaatcagtaatcacgcgggtttggttaaccggtcgccgtcaggctacgtaacttgttcaaagaggattcctcctcctcctcctgttaatgtgttttgttaattattgctgatcgcggcagcatatgtaaatggcatctctggtttttatttgagcttattaaatatcacaatttgatgccatctccaccaccacgcactacttaattagtattactgtttgattattttttattcttgttactgttctttcagaaaaaaaacggatttgttaactccagggaggtagaaacatctgagggaaaataacctcctttgttttttttttcattttgaaatcttcagaaatgatattggtgccaatcaattcgttttgttcatagcatattgaagcaataaaaaaaatggcaaatatgtgcatacctggacgggggcgggagccggagcagcaacgacggtgacgttggcggcggcggcggcggccagcgagtcgttggagtcgacggcggcgtcctgcaacgggagcggcagcggcggcgcgtcgtcggcgttgctccaggcggagatgtcagcgaggcggcgtcccgggctggcggacatgacgaagaggatgcagacggtggccatggcggcgcccagcacgaacgacaccagcgggctaatgctgctgctgccgctgccgccgccgccgcccatcgtctccccacccttcatcttgccgccgcccagcatcgatcgatcaaccaatcaatcaaactatagctgcttcctccgttgatgtgacgaatggtttcttgctcaaattaagagaggttcttgcttcttgtggcaggatggtggaagaggaaggaaaggcaaagcctttgtctgaagaaaggaacaagaaggaggtatagtagtagcagagaggagagggaatgggggtatttgatggaggagcagcagcaacaggtaggcgaagaccagcctgaaagggaattaacgggcgtgatggaggcctaagagacagatcatcatcatcttaatcctctcccactgattgatttactcgtagttttggctttgctggtgtgatgacaacttgtagtgtgatgcgtgcctcttgcttcagcgtgacaggtttcaaagtcgcaacacacggttgctttgctttgatttgctagctgctggagctggaggtcgaggtttggctgtcaggaactcaggatgggttgggttgttggtgccgaccctgtctgcctgtaggttcgcgtttgtttaggcgtagactggacctgatgcgttgaactgttgagatggacgtaataaacccgatccggggtattattctgatttctgaattctctccctgcatccctgcaataactgaatttttctatgctacttacctgtacatgacattgtgtacgcgtctttggaggtgatttttttagtgttgcagacggctggttggttttattctgtttgctcacatgggggagaaacaatatttctgaatttccctcgtactgtgtaggaaaataaggttcgacatgaagaaaagaactgcacaatcaaacgttggatactgttgctaatttgagtacaaaacggtttcatgctttgaatattgttgcttatttatgtcaaaaaaagtattgttgcgtacaaacggcttcatgctgtatggtaaacaccgccaatcattcgcgtgctgagtcttacaaaacgaacaaacattcactatcggtctatcgccgcatgtagaagaaaatgatggtaatttcgacctgcaactgttagagttgattaattattaatttggtgaagattttttctctaccggaaggaaatgactaaggtgctattagcgacttctagctagctaggtcagacgccatctgatggccaccacaccctatatgctactagtatgatgctgcacttgccgtgttaggtttgctcatgtgtaagtcgcagcaaagctcatgccgctgttgccatcgatgagcaaaccttacctactagctctgctatctcatcgtcaactccatctttcgctacttgcatcttcagaaaaagttcagaaaaactcagcctgcctcttttcttgacaaaataggttccttgttcagagttaaattgaactgtctgcagcgtattcttttgtagtttttcgtgtatctagcttgtcattttgaggtaagcaagtaagcaccaacttctgtcattctcggtatataaacaaattggagaagtaggcatctaaataaagggtagcgtgagcctgtcattctgccgccaatttcgggattgcatgcaagactaagctttgaactataactgaacaagtaatctgatggcgatttgtcggtgcagcgatttggtactagcactgctaatctgaagcacaacagaaggattgttttttttttttacctagctttcactctgcttttgcaatcttgcatgctcttgggtgcaaactaccatccatcaatagctttggccgatacagtgctatatacttttgtgtgtttctgtcagatcagtctatgtgcaacagtgcaagtgttcttctcaactgctgaaaaagccaatgccggaggaactatttttaggtggaaacatatactatgcagtattgcagtaaattaactctccacacgggcgggtgaataaacttgtttacactgcctattattaattatctaaaaacattattcatccattttcctatagacagacgtctctattgaaggcctaaatacatctttgactaactatcttattctaatcattttgggtcagggaaaacaacatgtacaaaaacgtgcatatttccatggaagttagcagcatatgcaacacatattctgttaactaatcaggtcgggttcctgtcccgatcatgattcatgagccgaaatgtctaatagaatggcctagctgactgattgttttgcctaaccatataaagactggccgggttgattattatttatccggtattttgtcttaataatcaccagatacaagctgcttgccaaaccttaggcgcagccatgtacacatttttgcctttcctgttgttggttgaatcataacattagcaccaaactgtctgtttaccagtcttgaggaagaacaacaccgtaaatcacgctggaaatgctgcattttgctagccattcttatgtagttgatgatattatatatgctcctaggtttatggcaagttggcagagttaatttgattagaacgacagatgttaggacgattactgtgttggaagtttcttggattgacctcaaacgtgcaagcagatataaggctggcaacttgactatagttattagttggattctgtagtctggtctgcacatataatattatacaggtaatcagacagcattatatattgatatatactactgaataaaggaactaagaggttcagttttaacgaatccatgattgcgacatgaacaagaattaatctattcatatctagctacttgctacgatacgagctaacatgcacccaaatgaaaaaaaggaagagaaaaaaaagaagatatgatgtgcacaacagtacagatggtatatgtagccgtttgcacatggcttctcaagaacaaaatgcagtggcttgccaaaacttaggacagttggaggctctgcatttgtgtagcgagtataatattgggaaatcttgctgtttaagagtaaaccagctctgcatagctatatgaaaaggagtatcaggtaaccggctttgcaggggacctcacacggagagacgacgacagtggagaggttgctgtttaggtgcatgatgccattgctattgctgtattaggccaaactcaactcgctaggatgacaattattgcaggtgaagcgtgcataattaaagcatgtatagcaccaaacatgcatgaacctatcagttatatatatgggttttcagactaggcaggagaactatttttcagagaatgccctgtggatgtttaaaccaaatgaacggatcaaatcagcagcaggagcaggtaatgtgcctgtgtttgaggttgtaacacgtctcaatagtattttgcagtaatgaggtcacaagatcacataatcatatggattaatgggagatggcgaagaatcatgtttccttgtgtcgcagggcagcacatgcattgcgtcgccgccgttgctgtcctccgatttaacaagtcaaaaggcagaaaaaagaggaggagaaacagtagtttaaacaagaagaaaagtgcacaacgaaacgcggcgttctcgaggcgctttggctacctgatgatatatactaataatccaaattaaggaggtaattagaataatatactaatatagaagaatgggcagctagttagctggtgatatgaaaagaaaaaatgaaatggttggtggttgtaccggaagaaaggaaggttctgcctgcctggatggattacaagaaatcgtcgtcgtctttctgtgctaggctgcaactattgcaaagccaaacacgtacacgggtctctgcttttgcttccgttgccgttgaggttgttgctttggtcgccgccggcacaacgtgctttacctccaccgacacctcatcattttctctgaaaaatttgcaccgactcgttcgtcatattctcgtgtgaaaaaaccaactcccaggtgaaaatcatgtgctgtattttctctcctcttcttctgaagaaaaaaagggaatgcagagaccagtaaaagttctgtggagatcatgtatttatattcttgcgtgctgtctttcgaccgacaagacaataattgggttgaaagaatagctagtcaacgtccaacaatccagtgaggcagtgaccagtctagttttccatacatatatacagtagtacccccatttcgttcttcagaatttcagaaacagcaggacgaggtctcccatacttccaccgttcaatgaaactgccctctcaagaaacgcgtgcatttgtccaagtcggtgccaccatatttctgaattcccctcgtactgtgtattaaagctataaaaactaggatgaagacccacacagattatgcggttagcatgattatattttttttctcacataatagcataaatacttatgcattttactattagaatatattgaaatggcagcataattttaaattatgtactaacttgaccaaattaactaacatgtaatattcatatgtatatacgtgatagttgttaattattttctaattctaaattttagttatttgtaaatagtatttctatatggactctatactcctattcaaatatctcttaatttttaatcctgaagttcctttattcataaatttaatttctataggaattctaaactcttctttcaatatttcttatttttaaattttgaatttttcaatatttcttatttttaaattttgaattttagtcatttctacattgtattcatgtatggattctatactgctttaggaatagctcagtgccaccgagtaatgtataaaaatatatgtatatgttaatattttgttttgtgcaactacattacactctgacaatgagagcagaaaaatagaggaccgcatttgcagttcagatgtgtatgggtaatggaattcattgctattttaattttgtgcagctaatgaaattcgtttgaagacagattatgttaagaaattttagcaatccatacataagagtatagatgtctgtttgggtatctagagaactgaacacatctgatctataattggggggaagagtaacttttatttgtgaaacaaggaacggttgaaatgcttaaggtacagtcacaggactgtgtgtgtctgtattgtggtcataagtgaagaggatgagataaacatgaaaatggattttttgtgttaccagcagtttttaaagagtacgcgtatgttatacatgttggaagttgtcgctattgcttgtgacacaattgcatttttttaaatgttccgcatccttttgttggtggtgaacaagcaaatgtgtttgtctgatatggcaaataagatataaacttgtaagtaacgttctaacaaaagcagataagttttacagtgtttgcattccaaaattaataaagatccaacgctccacaattaaaggtactaccatataaaaggtatttaagtattgttataaatacttccgaagaaagggtaaaaagataattttcttaagagatgaaaaatgatataattgtcataatattagccggaggtatattgataccataatttaccataatgcaaattaccataattgccatcaacagtagggttctcaacattgaaaacatctgcaggttgtccagcaataagaaggcacaacgtcctcaaaggtgatccagatacaaaatggtggtaagccattttcttcactgaagagcctctttccttctaccagaaactaggggattttgaacctccttagcagtagcctgcaatgaaatggttgccacacccagggttactatttttttcccctgaagctgatgttctgatagaaataagaattacctgaatctggttttctgacggaatgtttttcatgcaatggacaatggctccatactctcccttatgagcaccactgctcttacaagatgagaaaagttttgtcactgccatctctggaccagctataccctgtaaccaagaattcgaaagaaattcaatattcctttcaaaagaatataaataaattaaataaaagatagctagcagttatatgacaaacgctgattgaaaaataaagtgatctcaaggaagaatagatcttttcatttcacaggtccagtttaacatgcatacattaattcagtgttgctggttacatgcttaaaatcctgtatggacaggccattttccatgtgagaaattaatgacaaggggatgcttttaactgtggtaatgaattatctaaatattgtagagcagtacaaaaagcaaatacctcctgcgatggatcagacccaaaaggtgaacggagcttccatagtgtcggcacaatattttaagcagtgaaataagcaacttctgatcatctcctccatggaactccctgatagaggaatcatagcctccaataatctcatcaagccacttgttcacatcctttgctgcagcacttccaccaacatgggggccaggaataggttgacaacacaacacatggaagtaactaagtgtgctaccattaacacagggttcagtatacaagatataatttgagtaagaaggaaaatatcaaaaagtaagctgtgcatagcatgggcttgaacacagcctttggggatggaggacgatgttacttgccacagaggaaggaaaccgatttaatgtcacatatgtgtgagataatcagacatatgggaaaactaacatttctgcatatgtttggctcatccagggacaacagttttcctgttcagctgttgtaaagcttgtggttggaaaacaactccaacaaaaatacagaagccaaatattccagttttccactgatcaactgattgagcaacaatttctaagagtcaatccaactgtaaccaggattctttgtaattcttctctcatacatcatactccttatttctgctgatttagtccaatcccctagagaagcaagcccactggacagttgcacatacaagctgggatgtgacgattccatctccatcagcttcttcgccaccttccgcatcatggcctcattgccctgagctttgcatccaccaataacagttgtccagctaaccgcatcagcttcaaagggcatattttcaatgaattcaactgattcctctagccgacctgcgcggactaagagatcagtcacacatgcgtaatgctcagctgatggactcacactgaagtccgcttgcatccggtgaaaccatgtcagtccctctttcacgagtccagagtggcagcatgcagaaaggacagcaataaatgttcgttcacttggttttatgcccttagttttcatcaactccaagagttccaatgcttcatgtccatacccattggaagcatgaccaatcagcattgagttccataagacctcgtctggcttatcgatttcttcaaagatcctgcacccatttgctaggcttccacatttgcaatacagatcaatgagtgaagacgcaacaacatgatcagattgcaaaccaagaacagtggctagagaaaagatctgctctccaaaactgatagagcaaatgctgctcgatgcactcagagcactggctatagcaaccttgtcaagccgcaaaccaagccgatgcatctcacagaataacccaagtgcatccctagcatgcccattctggctcaacccaaccaccatagaattccatgagatcacactcttaccagtgatcatatcaaaaattcttctcgcctcttctatctgcccacagtttgagtaaacagtgatcattgagttgagcactatggtatcatgaaacctaagctctctaaaagctctgcaagcatcctcccagaggccacattttgagtagaaatcaatgagtgcacttgctactattatgtcattgactgctccacattttagaccacacccatgaatctgttgcccaggattcaccatgactgaaaaaccacatacattcaaaatgctggcataagttgaagaatcaggtaacacatctgatcgcatcatccttgcaaaaagagcaaaagcatcatttccacaacaggcaaatgcacagccactgataagagaattccacatagcaatgcttggttcctcctttctgtcaaaaagtcgtatcgcctcatgcaaatgtccacaagaagcatagccatatatgagtgcagaaagtgagaactcatcaacctgagttaaaccattaaggacatagcgagcagaatccaaatccccacatttgcagtacatgttaactaatgcgcaactcaacaccaaatcctgttcaatcttggaaaccaccatccgagcatgagcctgcctcccaaaatcatacttcatccaatcagcacaagcaccaacaattgtcgcaagcacaaaagggtcattccatggagaagaggcatctgcaccactgcattgaccaaccgtcctgagtaatgcaaacgcctcatccgcccggccacgccggacatacctatgcaaaacagcattgcaagccacaggatccttgacaggcatttcaatcagcagtgaacgggccatgtcgagattgcctgtggacacaatgccagttatgattgtattccatgagaaggtgttcctctcgggcatggatcggaagatattaagcgctgcatggtggtctctggaattgaggtgggaggtgataacagagttgtaggagaagcagttcttgacgggcatttcgtcaaacaggcggcgggcgtcgtgctggtggagtggggagcagcgcgcatacatgaggagcaaggagttagagggcggcagcgatgatgggacatggccagacttgagaaggagctggtgcagctgctggccggccacggcactgcaggagcggaggagttggatgcagttgcggacgtcgatgatgacagacatggagaaactgaacaggacaggaggccctggaagcaagctgttgttctgccttcactgaatcaccatatccttagccactggccaccaccttgtcgagatcatagctgccatggaggacctaggacaaaacattacttatgatggactcttgcagtggggaagtgcactaagggtgtgtttagttcctgaaaaaagttgaaagtttgaagaaagttgggagtatgaaaaaaaagttgaaagtttatgtgtgtaggaaagtttttgatgtgatatgatatgatggaaagttgggaatatgggggaaactaaacacggcctaatgcattatccctcgctctctgacccctctcgccaacagagtccctacacacagagaaaaaaaaggaaagcaattgccttatgtccacaaattatatatcaaaaccacagtaagaaagtaagttggaactgatcagcatattaccaagtcctaaagtattatcaactcaagaaattaaaatattagagcccagtgccacatttcattttaaaaaaggtacttgataattgataacccattattttgttctgatagtattcctaaatatctactcacaatgaaaaagaaagtaaacacatagctttgattagttttcaagtttataatattaacttcccaaatgccaggcttactgtccatatttgatctgaatatctgagaattgataatgtttaggagaatacatacagctctaaggagcagtggcgtggccaaggaatttttggttgggtagtcctacttcacatcacatgccagaattttcaaacaccgcaaatcccatatatgagaataaatttagttaaaaagttatacaaatatagcaataacatcttataaaatcaataatcgactaaatttgacaagcaggttcaaaatgtgcaaacattacaatatacatagttcgatagcaatatccctattcctcaaactacaatggcagcaaatcaacagcacattcagtaactacaaattggcaaatagtaaaggcaagtggcagaaagttcaaacacaataactcaatgagaataatgaagctatgagctagactgctagaggtataacctgcaagagctgggtcgtcgtcttcccaagaggacaggacttgacagtgacaggaacagcaggtcggcagccaatggcgacgccgcgacagccaggggcaggaccctcctggtatttgggttgaggcagaagtggagagggaggagaaccctgtgggctgtgagggagacggtgcaggatgaggatttgagagccggagggcacggtaggccttgatctgtgcttgtcaaggacattgtcctcatccttccatgcctgcttctttccaaccttttgttctcgtcaagtgtatggttcttcgatctttattcaattcgattgaaattcaacttgtgtgtttccatcgagtccaatctcacatctatgtatatggttcttcaatttttatatctattttattctgttttcattgggacatattggaatgtgcacaggatactaacgatggtctcgcgtagtagagtccgttttgctcgaacaaaaaatcgcgtactgtgcggatgacaaagactacggatgaaaaatctcccagaaggcttacgcattttttaattaggtatagattgtttaattttttgaactaaaacacgaagttagtagttagtactatctatgatgcttgtcacatttcagccaatagagcaatattactcaaccaagtaatactaaacatttcttgagttggacaagggtaaaactctagtctgggctgctcctcatcatgaatcaaacttgggctagccttgtaggttggcccttaatcaaaatttgtcttggcaggagctatattgggggctcaggttgctatgaatttagcggggcttaaactgaattgaacataggcccaatttggtccctaaaaagatcaagtctgaatgattgcactataatatttacaatcagattagttatcctttgtttaggcgctctacctcaagataggtaatgtatccagtcagacagtttataattgtctcaaaagttgcatttctgctcattgcaacgcaaatcagtatcatataagagatgtattatcccatatgggccccaaaaagaaaacgctattgtcctacaaagcaaaagagtgtcccagttaactgaacttcacataacatcattgcacaaaaactcgcactcgatcgcacgaaacacatatatggtatgatgggtttcctaacacaagcagtcaagcacaatgccatcaacacaacagaaccatcagaagctttataaagctaaaagatcaatgatttacagaataacaagggcaaaaacaagtattgctcaatccaacaactgaaacctccccgaaacaaagcatacagatatgcaggaagtacaaggaactgtattacaaaatcacataaaagatttataaatatctaaccacagcaacagcttatgaactgactaagaaaaagtctggcaattaacagcataataaaaaatgtaacgctaaaattaggtttccacaagtccacccacaaattcgaacaagcattctaaagctacaaactaacggaacaactgcaaactgaaagaccgtcatatcaaatgtccccctccccacaaatcccctaccataaattccccaaactaaagctcacccagctgaaatgagcaacgagaaagcccctaaatttccgcgaaatcagcaaccgaacacagattagtcggggaagaagaagaagaagacgggagggagcccgcaggtgcgcacctcgactgtccagatgaagaaatccccttcctctgcacacgcatacgattccctcaaaacaagaaccaacaacgaaagctaccgtttcttggatccaaccagcgaccccgacctccccgagcagggaaggtaaggaggagcgccaccgtggggagcttgggagggtgactgaggcgagcggcggcgggcacggctgggtggcacccctgcgtgcggcaacaaacggcccataatttcaagcccacgaagagaaccgggtcggcccataaaactagcaggccaaagcccgaatagaaagcggcgcgcgcgagcccacctcggcgtcggtttcttcactctccacccatccccagtagaggaggaagcgccagatctccacacccacccgcgccgcagatccagccagagccatggcggatctcgccgtggcggcgccgccgccgacggacctcttcggcgagcccatcgaggcgcacccgccgtggttcaagcccgactccttcctccgccccgacttcgacccggacgcctacgtcgccgacctccgctcctacgtgcccctcgacagcctcgccgccgagctccgctcccacctcgcctccctccgcgccgagctggtcggcctcatcaaccgcgactacgccgacttcgtcgggctcagcgcccgcctcaagggcgtcgatgccgccgccgcgcgcatgcggcccccgctcgccgagctcagggacaaggtcgcctccttccgcgccgcagcagccgccgggctcgccgcactccgctccggactcgagcagcgcgcggctgccacggctgcacgggagcttctcgagctgctgctcgacacctcccacgtcgtctctaaggttcgatcctactccgccgctcctggttaaacgcgaatgtagcttattcctattagctaaatttccccatcagcactgcattggtagatccgactttatatgggatctgtgacatctgtctggaggtcaaccatcaaccttctgaaactgtgcccttccagtccccttcccatcgatgttcgcctgttcattttcatgaatcatatgaaagcttatagtgtttgactctagttcaaactaggaaattggagaggtttagcacttccattttaatgcagcaatagtacatcatattattgctgtgaacatttttttgtccctgtatgcggatgatccatatgctaactctgagtattattttatccatgaatgtagatgcaatgatgcatgtacatgaagaaattggcgtgattaaacctgtcatagtgctattttctaccatgttagaaaaattgccctatcttatgactgatggtcttctcagattattttgtcaaggtttccattggttcacaatttgcaacatcattcaattgtataaaccatcacctaaaggtgttactgtcaaggcacctgaaatccacattttcctgttgttcctccaggttgagaaactgatcaaggaactaccatccgccccatctgattcatcaaatgttgaggctgtttctggtgataagggctactcaggcaacgttgccacaccaccaaacatggatgatgggacagatgttagggagacacaaagcattctcttagaaagaatcgccagtgagatgaaccggctcaaattctacatcagtcatgcacaggtttgtgacactaactcaccaataaatactggtccatttgcacctctcactcacataccttctctttttctgttccgttgctgagaaaaaccattagggaaaaattgtaacacaaaaatgacattagttgtttctccggaaaggtttatttctgtgtcacaattgaccattgaaagtgtagtatacacagcaatacaacgatgtgatataacatcttgattaataactataagaaaaatgtctacccacatgtcatagatttggttgtcgcaaactgctgaagtgtcaacatggtttcatattggtagcttttgttttattgctacctgatgctaccttttgcatctcagtgccacttatatttatgattcttatcctgttacattatggcagtacagaacctcccttttattgaaaacatggagaagagggcccaaggtgctacaaaactacttgatggtagcttggagcgttgctttgtggatggtctagaacatcgtgatgacaaagtaatatacaactgtttgcgtgcttatgctgctattgacaacacatcttcagctgaagagatattccgtacaacagtggtgtcgccgttgatccagaagattgttcctcaaaactatgcaaaagtggttgctggggtatcttctgatgacctagaagatgattatgagcagataatgcaatgcgtagaaaaagattgcaaatttattttggagatatcctcgttgggtaattatgatagacgaatttcattaaaaagctgcatcattgcttagtattttttaagttgaatactaaatgctgcataaggacttagattgacacatcatctaattttctatcgattgatttgcagcaaactctgggcttcatgtttttgattttctggccaattcaatactcaaagaagtccatttggcaatccagaagggaaagcccggggcgacctctcctggaaaacctaaacagttcctcaaaaactacaaagcaagcttaagattccttgattttctggaaggtattgctaaattatgttgcattgtgattattgttttgtatttaaccagctaagcctactacaataaatactatgcttgctcgcaagttatgctggtttatacatttgggacagccattatataggactaacaaggaatgtggttagactgggttaaagatatacatatatgactattgggagttgctattgattgaatatttggtcctgtaggttactgttcatctaagcctgctgtaacaaagttccgctccgagcctgcttatgccgatttcatgcgacagtggcatgttgctgtctacttcacattgaagtaagcataaatatttaggctatgctgctgtcaaatgctcttcagaacttcatttctaacttgacttcaactggttcaatcataagatttcaggacattgctggtggtcttgattctgtgcttacagccacaattactcctgctggaatgcatgacaatcaagcgaagccgcagacactgttgttgaaacaaagcgttaagctcttagaaagtttgcaggcctgctggagtgacgatgttcttgttttctcccactctgataagttcctccgcttgtctttgcagcttatttcaaggtatagctactgcagaggattctttgccttatcttttatgatttaacctatggtgattgaccctttttgtattctacattttacaataaggtatacaacatggctttcttctggtttggctgcacggaaagcttctgatgggggctcaagttctcctgcggatgctgaatgggcactatctgtacctgtggaggatttcatttatgtatgtcatgtctacaatactccttgaattccaagtgtgttatttcagtcatctgaacctactgcttttcatccttcatcatgaactttttggcttaagactgaaatagtattgtcatcttagccagtgacattgagatggttgcatagattagcaataatttgagactcacactaaggtttaagactataagtgcttaggagggcatcccaaagatgacaccttgcacttctagcccaacaaacattccaggaacacatatactgtggttactggttagttagaaagtctacagttggtagcggtgtagcatatcaggtatgacttgtcccttttttttcatgtgtaaactggaaatagttgttcggcttgttcttcatgatgtgctctagattggaagctagtcaatattgattattacgtaatcttacccattattttgggccctgattctcatatttcttataaaatttgaaacatagaagattatggccatcaggcatattttgtgaattgcatttaaattctgtatttgatgcacaggtaatgcatgatgtaaatgctgtaataagcgagcttttggaatcaggccaatttgtggaacatgtaaaccaattgctagcatcatgcccaaccgaagtacttgctctcgtgaaacacagtatactgcaagctgttgagcctttaaaggagttgttgcctgctataatgaatgtcatgattatggtgatagttaaaaggtctaatgaggtgagtacacctaagtcagcagaagagaagcaatgtcatcatttcttactgtatctgtggttcatcactcgtatggtacaataagacaattttgagtcatggtccttctgttcttaccaactatatttctggttgattgtaggacttgaagcacctaaagggaataacagcaacatatagaatgaccaataagcttccagtaaggcattctccatatgtatctgggattttgcatccacttaaggtgaatggacatcctgttttacttctctgctttatgatttatgtttctcaaaagtgaagcatcaaaagttaactacttaactggtagcgtctatgtcctaatggctgcattcagtatgtgttcttggcgatttttaagtgccatggtcagtatctagtacccattagtctgatcgttatcaccctcaagaataacttatgttttgccattttgcaggccccgatatttagaaacatgtgtttatgctctttttgcctccatatttcatatgtgatgttcctctgttcttgtaggtttttcttgaaggtgaccgtattcactatttatcagaagatgataaagcaaagctgcgccgtggatcgacagataagatcacttcaatttattatgacatggtgtctgaagtagtcactgtggtaagtaaggaatgcttaactgcttatgagagctcatatctgcttattggtgaattaaaccatttttattgaatataaaggcaaggaaaactgaatcatcattgcaaagactacgtcaaggtgcacaaagacgagtaggagctaataccgatacctcggataacatcatttctgatactgacaagatctgcatgcagctatttcttgacattcaggtttgatatctgtcctttaattttatgctgataagggacatattatatataacggatataagatttattttagggtgtaaattttgcatcaaatgattttttttaagagggtcattgccttttggtttcatcaaagacccaactagtgcttatggttggcttattcaaccttaccattttctgtggaaaacaactttagcatgtaatctgaatgtttctatgttggccatccaatacattttttttttgcaaggaccaatgggtattagttatatgatcaaacatgatacctgtttatgatggatgcactgcaccacatctgacatttctttttttttttttggtttttcttattatgcaggaatatgcacggaatcttcgtgcaataggaatagatgcaagggaaatcgaaacattcagagctttatggcagtgtgttgctcctagagacaaacaggataacatccagttttgatgtaaagatcaatttgagtacatagaagaaaattgccttaggtccctcaatatccgtagatacgtctcgtgttgttcgtttaggatggatgttggaatgatttttatacatagagctctggattttgattgtttcattttggacggtctcctccggattatacaagggtcaagggtacatccaaaatttgagaagtgtatcaaacctcatgttgttggaaacacaccgattctgttgaaagattgttttagtgtcttggtatctaacctttttcttgttcacgcatatctgaagagaacatctattcctttatttttcttattaggcccttgcagttaccaccgtctttttgagtggctgcgtgttcatataggctcgcttcttctcaagtgaattcgataagatgcacatagataattccatcaaccgatctggatcaacagaagacaaatttctaattcagattctagagttcatgacagcagagcaggacactacttgacagaggactgacagaaatttttatttgagattacgagagtacatcgagaagctcagccccgagggagagtatgggttagcgagggatgcggtttgggcggctcagcgcatttccggcggtccgccggcggagggaaggcgcggttcgggcagcaaatcgcaaatgcggcaagggcggcacggctccctccaggtccggtacgcttcaaacctcttcatccccgccgccggcagtcttgtcgataatgctggtgcatggctagtcgtcatctcggtattggaatccggctaattcagatcctgcaatttgacataataatatattactccctccatatatttttatagtaatatttccaaatctgacaaatttatttttgataggtatatttcaatccaacaacctatcatcttaatgactttctcggatttaatgcatgactctctattcttccacacaagatgggcattgagaaatgtaaatattaataaatcgcttgtttacgaggaatgactagtagcatgtttaaatggatgataagtagaattatttatccttgatctgtgtgtcaagataaaaatatgactatcaaaagcagataaagggagtaactagcatggtgcctcgcgtggctagcgttcgtcgaatttttaatttcgtattttagttatttctaaattatattttttataagctttaaactctacttttaattttattattttctaattcaaaattcaaatagttctaaattgtaaccggtgtgaactttaatctcctctcccattattacttattttttaattacgaatttcagttatttttaaattagatttttatatgtactctattgttttatttttctccgattaatatgataatttcaagactgtgagaaccaaacgtgtagacttatttttctattgttttaataaaataataataatagatactccctccatctatttttgatatttatattttcaaatctaaaaaatttattttttgataggcatatttcaatccaacaatttatcatcttaatggctttcttaattaaatgcgtgactcttcattcttccacacaagattggctatatgagcattgagaaatgtaaatattaatgaatcgtttgtttacgaggaatgactagtggcatatttaaatggatgataagtagaatcacttatctttagtctgtgtgctaagataaaatatgactatcaaaagtagatggagggagtagtatattaatagggcaccccaaaatgtccccgatactacctgcgctgcgctcgtctcacataaacaattactcccgattgctgagtaggactgtaggactagttgacttctagtatcgatttagaccctgtttagatgggactaaaacttttaaatccctatcacatcgaatgtttggacattaattataaatattaaacgtagactattgataaaacctatctataatcttggactaattcgcgagacgaatctattgagcctaattaatccatgattagcctatgtgatgctatagtaaacattctctaattatagattaattaggcttaaaaaaattgtctcgtgaattagctttcgtctatataattagttttataaatagtctatatttaatactttaaattagtgtctaaatacagggactaaaagttaagtccatggatccaaacaccatcttaagaactttacagaacaagatctacaaatctattatataattaaaggaatagaaaaaggagcctccacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaataactgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaattt

SEQ ID NO: 5256 - DNA, 790 bp, Oryza sativa
tagggtgagaggcattgatacatttcaaatgatagtgagtgggaccctttatccaaaaaccatagttttttgaatgtcacccccaagaaataccgtggttccctaatattatagtcttgcacttgaagaattttcagtgtactccggtgctgctctgttttatatgggcagattgtgtgcctgtgtttttgaaaggaaaaaaaggaaaggctacgagttgagtgtgcaaagctaaataaaaatcatccttgatattttttcaaagcttagatcatatatttttgggaggaactccagaaatactaaatatctaaacaagacgtgtgttttcagccgaagtgtaaccttttgtggcatggtggtggctgatagtaccacaatggcagattggcaatgacagaactgcagaataatacagtgtagccatagaggatgcctttggtacatacaagcgccaccaaggtaatcactgggacgttttgttacttagattgcttacctcattgttggtgttgtgaattttgatgatcactgatggtaaagaagagcaggtctgacatgggatagcataagaggtactcgggtagccgaggagacttgccagtagagcccggttgtcgctctcgacggagagagctgatgacaatggggctacaggcaaatcatccttggctatcgaagatggcctcttacttccatgcaagacctctcttctagtcagtcatcggcacttgcatttgtggctgtgtactgatggttgcatgcctgggcatatatttataagaaagga

SEQ ID NO: 5257 - DNA, 643 bp, Oryza sativa
gctcaattctgccaaaccaatttcactcatatgcccaagacgcatatgccaaagattaatagcatcggaattagataatgaatcagaaattgtagcaacattacctaatatagttgtacctcgcaaatggtacaggttggcagatttaatatcagctttcatcacaacaagagagcctttagttaccttcaaaattccatctccaccggaatatttgtaccctttgcgatcaagagtacataaagagatgaggcttctcttcaaatttggaatatgccgcacatatgacaatgttctgatacagccatcaaacatcttgatctgaactattccaatacctgcaacctcgcatggtgtatcatcacccatcaaaacagtatcaccttgcacagcttcataggtggcaaaccaattcctattcgggcacatgtgataggtgcatgcagtatcaagaatccactggtcactagtttgtgcacaaccagcataagcaacaagcaattgtgcatcagacttctcatcaataacaactgcggctttaccttcctcttctttcttaccttttggtacatattttccggttctcttgtctttatcctgtagcttccaacactcagagatatcatgtccatctctcttgcag

SEQ ID NO: 5258 - DNA, 13527 bp, Oryza sativa
atagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctaaattaataataaagtgaggagtatattgtaccaaatcgatgcaaccaatcaaaacccatccacttagatccagaaagtcaaatagtacttacattcagtctccattttgcacaaaagcatttgctcatactccttgccttctccacccccacccagcaactttgcttccccctgtgttcttccttagctcgttccttccgatggcggagctaatggccaccatggtggtcgggccactggtgtccatggtgaaggagaaggcctccagctatctcatggagcagtacaaggtcatggagggtatggaggagcagcacaagatcctcaaacgcaagctgccggccatcctcgacgtcatcgccgacgccgaggagcaggcggcaaaacacagagaaggggcgaaagcatggctggaggagctccggaaggtggcctaccaggccaatgatgtcttcgacgaattcaagtacgaggccctccgccgcaaagccaaggccaattggcagtataagatgctcggcatggatgtaataaagctctttcctactcacaaccgtattgtgttccgttacaggatgggcaacaagctcaggatgatcctgaatgcaattgaggtcctaattacagagatgaatgcctttaggtttaaattccgaccagagccaccaatgtcgtccatgaaatggaggaagacggattctaaaatttctgaacattctatggacattgccaacagatcaagagaggaagacagacagaagattgtcaagtcattgctttctcaagccagcaatggggatctcactgttattcccattgtaggaatgggggggatgggcaagaccaccttagcgcagctcatttacaatgaccctcaaattcagaagcattttcagttgctcctgtgggtgtgtgtctctgacaacttcgatgtggattcgctggccaaaagcatagttgaagcagctcgcaaacagaagaactgtaatgaaagggctgaatttaaagaagttgtgaatgggcagaggttcctcctcgtattggatgacgtctggaaccgtgaggctagtaagtgggaagcgctcaagtcctacgttcagcatggtggcagcggtagctcagttttgacaacaacccgtgataaaacagttgctgaaataatggctccacctaaagaagttcatcatctcaaggacttgaatgaaaactttataaaggaaattatcgagagaagtgctttcaattcagaagaagagaaaaggcaatctgagctactcgaaatggttggtgatattgccaagaaatgttctggttcccctttagctgcaacagcattgggctctacactgcgtacaaagaccaccaagaaagaatgggaggctatattaaggagaagcacaatttgtgatgaggaaaatggaattttaccaatactaaagcttagttacaattgcttgccatcatatatgcggcagtgctttgctttctgtgctatttttcccaaggatcatgtgattgatgtggaaatgttgatccaattatggatggccaattgttttatcccagagcaacaaggagagtgccctgaaatcagtggtaaaagaattttcagtgagttggtgtcaaggtcattttttcaggatgtgaaggggatcccatttgagttccatgatataaaggactctaagattactgctaagatccatgatcttatgcatgatgttgcacaatcttccatgggaaaagaatgtgctgccatagattcagaaagtattggaagtgaggacttcccttattccgctcgccatttatttttgtcaggtgatagaccagaagttattcttaattcttccctagagaaaggatatcccggtatccaaacattgatatattcctcgcaaaatgaagatttacagaatttatcaaaatacaggtcattgcgagcattagagatctggggaggtataatcctgaaaccaaaatatcatcatcacctgaggtatcttgatctctcatgcagtgaaattaaagcacttcctgaagacataagcatcctatatcatctgcaaacgctgaacctttcccactgtagcaatcttcatcgacttccaaagggaacgaagtacatgactgccctccgtcacctgtacactcacggatgtgagaggttaaaaagcatgcctccgaacctcggacacctcacttgcctacagacgcttacatgctttgtagctggtgcttgctctggctgcagtgatttgggagagctgcggcagtcggaccttggtggtcgactagagctaacacaactggaaaatgtgacaaaagctgatgcaaaagcagcaaatctcggaaagaagaaaaaactgaccgaattgagcttaggatgggctgatcaggagtacaaggaggcacagagataatcataaagaggtgctggaaggtctcacgcctcacgaggggctcaaggttctgagtatatatagctgtgggagcagtacatgtccaacttggatgaataaactacgagacatggtaaagcttgtgttagatggttgcaaaaatctcgagaagcttcctccactgtggcagctgccagctctacaagttctttgccttgaaggactggatagtttaaattgcttgttcaacagtgacacacacacacccttcgcattttgcaaactgaaggagctaaccttgtcttttttttttgccgggtcggccgaaaggttcggtcgaccaaatttcattaaggaaaaggggaacaaattacaaatgggctttatatcgacaataggatgtcgagattaggctggggacaggtcccccccaatcaaagccatacacaaaagcccgaaggctacaaagaaagtatgatgtctctattacataatctgaaaatagcctccagacttccacatccaaacttcttctttgatgtcttccagtaactgctccacggtctgctgcttgtgctgaaaaattctggcattgcgctccttccaaatcagccaacaggtcaaggcgaaaacgctgtcaaagttgctcctgtagctgcttcgaaaatggcatcgtgccaccatccaccagcctatcagcccctctcccgcttgtcctggcagagggaaatccacattgacccatgctcgcagcagctgccatactcgcctggagaaatcacaggtgacgaacaagtgtaggcaatcctcctattcgcgttggcagagtacacagtgatcttcatggggccatcctctcttcgccaagttgtccgccgtcaagcatttgccctttgttgctagccaaagaaaaaatctgaccttcgacggagcttttgtctgccaaattagctgtccgcaaggagaaatctcacgagccatgaaaaagagatcataagctgaggacactgagaaagaaccatccggagtgagcttccagcgaattgtgtcctcctcctgactgagattgatttgttggatttcgtcccaaagctgaaaatactgcatcattgctatatccgagagagatccttgcaaatctctcacccatcgatgtcccaggagtccctgttctactgtgagcttagttctaccaataaaagtcgcaagggtgggccatctccaggcaatgcttcctccacctagccaattgtccgaccaaaatttagtgtctctaccattgcccacacagaattcagatgcagattggaagattttctcgtcatctgcgctcagtctgaagtcaacaagggtccagggcctatccttctgatgtaagcgattggctggccatttcaggcgcagcgctttgccgaagagctccaggtttcgaatgcccaagccgccattttccactggtgtacagacatctttccaggctacaaggcaatgtccaccactcacctcctgctgtcccttccaaagaaatccccgacatttccgctcgatgtccttgattgcccactttggaagttgcaatacagacatgaagtgaactgggagggccatgagaacggatttaatcaagcagagccggccatcaggggacaacaacttgggcttccaacctgccactttgtttgcaagcttgtcgagaattggttgcacctcagcttttgttggctttcttgtggacagtggtaatcccaggtagatgatagggaataattgaatattgcattgcaactcattagccaccacctgaagttgttcctgactgcattgaattggagtgattgcacttttattgtagttggtcattaatccactggctgcaccaaaaatctgtagaattgccttgactaccttggcttcttgttgacttggtttgaaaaataatactgcatcatcagcatatattgatatacttggaactgggcgtcttggtgctggttcagatatcagtccacttgctttcgcttgagctacaactgcttgcagtgcatccattgccagaacgaataacagtggcgataaagggtctccctgccgcaatcccctagccggcttaaaagggtttgattcattcccgttgataaggatgctggtttcagccgtgaggaacagagataccaaccataatctccacttggcaccgaaacctctccacttcagcatatccaatagaaaacaccaagacactgtgtcaaaggctttggagatgtcgagtttgagtagaatcatttccttgtgttgcctgtggtattgctgaacgagccctttaacaaagatgaagttttcatgaatagatcgacctcttatgaatgcattctgtgtgtagggcacaagttcattcattcttggggctagcctctgtgccatgacctttgctgctaacttggcgaagctatgtatgaggcttataggcctatagtctttcagcagtgtaggggagtctttcttggggatcagagtgatcaccgctgtgtttaacatttcaaggagccatggtgggacacaaatgaggtaaaaggagaagagctgatatttcctgaggttgaaaagctgtttatcgaaagttgccctaggctaactgccttaccaaaagcgtcaaatgtgatttcagaatcgtctagcggagttagcaccgtgtgtcgttctgcatttccagcattgaaggaaatggaattagatgatttggatatctttcagaaatgggaggcagtcgatggaactctaaaggaggaggtagcatttcctcagcttgacaaattaacaatcaacgagtgcccagagctgactactctacctgaagcaccaaaactaagtgtcttaaacatacatgaaggcaatcaacaaatatccctacaggcagctagcagatatactacttcattgtccagtctccatctgcatttgtcaactgatggcacagaaacaacatcggtggccaagcaacaagattcgagtgaattggtgattgaggatgagaaatggaatcataaatctccccttgaacttatgaacttaaatgggtgcaaccttttattctctcacccaagtgcgctggctctctggacatgttttgttcagctcatagatctgaatattcggaaagtcgatgcgcttctctactggccagaaaaggtgttccagggcttggtttccttgaggaagttaggtacagtatttatcaatgcaagaatctgacaggacacacacaagctcgtgggcaatctacaccagcaccaagtgaactcctgccacgtttagagtccctacagataagctgttgtggttcttttgtagaagtccccaacctacctgcgtctctcaagctattagacattagggggtgccgtggcctggagtccatcatattcaatcagcagcaggataggacgatgttggtgaatgcagaaagctttgcacagccggataagtcatcattaatatcaggctccaccagcgagaccaacaatcgcacccttccacgcctagaatctctagtaatatggaactgtgatcgtttggaggttctccatcttcctccgtccatcaagaaattggatatttcttgctgcgaagaacttcagtccctctcaggaaagctggatgccgttcaagaattaaatatagaatcgtgccagagcttgaaatcactggaatcttgcttaggagagctcccgtcgctgcaacaactcaccctttttgattgcgagagcctggtatccttgccgaaggggcctcaagcatactcatctcttacatctcttacagttagttattgttctggtataaaggtgcttccaccgagcctgcagcaacgtctggatgacatcgaggagaaagagctagatgcctgctacgaaggtaatctccactttcttcatttcttttaataataagaactagctgggtggtccgcgcaattgcgcgactagcacccgtataaaatcatatatttttttaatatgattttacttaaaatttattaaaagttatctcaccgtcttaagattttgaaagaccaaacattatcatcctcgggtttctaattttgtagtttttaaaagtcacatcagttgctaccccttacttttatcatattattttttattagctttttcgatctaccattgtttctattcattctcattgaaacctttaaaaattggattaaaaaattatagtttttagagtttatttgtcctgttgggctttttttataatttctagaagtctcgtcagagctgccattatactcctctacaaccatccattgcatcttctctttattgtcattgctattttaaaagtcgaatataattattatttaggtttttttttactttctagaagttccgccaaaacgtcagcgactttgtcactatactcctctacggctcgcccactgccgcccttctttattatcattgagattttaaaatctaacatgattattattggggtttattttctttactttttagaagcccgaacctttaaaaattgtaccttatagtttttagagtttattgtcttgttgggtttcatgttttttataatttttagaaatcatgtcaaacgctgtcaaaatactcctctacgacccgtccgccgcataatctttattgtcattgggattctaaaaattgaacataactatcgttggaattcattttttactttctaaaagacgcaacaaccatcgacgactctgccattgtactcctatacgacccacccgctgcctctcatttttattataattgagattttaaaaatcaaatatgattatcattggggtttatgtttttactttctagaagtccccgacaaccgccttgaccgattgcttcacgatctgcccatcatcctttcttttaatcgtcattaggattctatttactgttttattaatagtttttagatgtctcatcaaccgccacaactctgctcctccataggcctgttacttaattaatctcgtcatgtgttttagatggtcttttctttcaatagtcttatttttttatcaccaattttagttatttataaattgtattcctagttgaaatctttttttctctttctaatttcagaatttattttatttattattatgttcttttgatatttttattttttattttcaatttcagttgtttcaaatctttttaatttgcctaatttcggattttattttattttttattctgaattttaattaatctactattgggttcttacatgtactcttatttcaatattttttatatttaattccgaatttaagttaattttaaattgtattcctacttgaactcttatttttttctaatttcgatttttttatttttttattccaatttttaatttatctcgtattggattcttgtatgcactcttctttcaataatttttatttttaattctgaattttagttatttataaattgtattcctactgtcggtgacatgggatcaggagtatcatgactagaggtttgaggcagacacaatcgcccacgtggcctggcaccctcgggggacgtcgggcccgagggtgatgtgttcgccctcctcttagtccccccgagggggtcgggccgcacccgcctcggccccgagggccgaggcgccccgacccctcgtggatttttgctccgcgtgtatgggttaggtgagcacagcggggctcacctaaccacatttattgtggtttggctgagcgtgtcacgccgcatgtaacgcagtgcagtgcactcgtttatccggtttgtgaccagtcacagaccggtcagatcgcgggttaggtggcgacaggcgatctgacgcacgcctcgccccatcccgtcaggacgagggcttctaggcgcttgtccccagctggagctagcgtgttacctcccagagatggcacgttagtcctggttagatatatgccaggcttcatcctaaccattacaggcaagatgttgtgtgaagaagggccaacatgtagattgctaaactgacacgtggtggacaagaatgagcgatttgtgaccagtctgacactggtcatgtcgtcagcagacagccataatcccacgtcgcacctgcttccggcggaagtggaggtaggtatgggccgtcctatcagaaggtcattcggacggcaactatacaaatctccgtccatttatgaaaaggtagagtaagtccccacagaagagagggagatggtgcatgtggtatccccttaagatataaaaggaggaccttgcccacttagaggaggactggacttttccagattcggaacccagaacaagggaggggctggctcatactttgtagctccttcatacacagatcccccaaaacacaggagtagggtattacgcttctcagcggcccgaacctgtatacatcgcccgtgtcttatgctctttcgacggtcgcgaaccttccacatacagagagcttagaatttcaccctgagtccccggccgaaccggcaaaggggggcctgcgcggtctcccggtgaggagccccacgctccgtcacctacgtactcgaactcttctttttttgtttttctaattttggaatttattttattattattccaaattttaattaatcacgtattgggttcctatatggactcatctatcaatattgcatatttttaattccgaatttcagttatttttagattgactcttcttttctttttctccgattaatatgggaatttcgagcatccacagcaaacgtggtgcctcctttcatagctgttttgataatataatagatagccaggagctcaatttaatttggtgggtgccctaaaaggcaactctcggcttaagcatgtaccgcgatttattgctaaaagtttgcagtgtggtgtatagaatctctagtcaaccattaatacgattatatgtacagagtacaatgcacatcgataactcacttgtgcagtggtgtgacctaaacacttcaaatttttgaattgcatttgggggtacaaaagaatttagttatatctactgtagccattactattatgcaagctgaatgcacgtgctttactacgaataaataataaattataatattatctaaaataaataaaaaaatatatattaatgcgtctgatatggacagcagcttaaatttgtagaactaactgtcgcggtacttgaattgtattaacatttctctggaaactcatagctccattgcatgtagtttgagtatacgtagttccttctaatcatcttatgccaaacttgactatggaatgctgtggtctacatattatccaaccaatacataacattttttattactattatcttttgtttgctagaaccaaaggcccatcaatctgcagtcgctaggctgctgtgcttaaagtaacagattcaggaccagatgagtcatcatggtttgtaacatcattatacatgattgatttcgaatgaaatgctaaccactatccttatgctgactctctctgtggtgtgacttccttgcaggatcgttaccaaatctgcaactgatgggttattaattgtgtgatttgtgtctcatggtagaatgtattacctacctaccctttctcaagataaactccagtaaagtcgatcgtccggttggtgtgagctgctacaagaaggatgaagccgatgatccaaggccttgactttaagcagaaagctagtcccaggttgtaagctaaagaataacatgctggagcttaaactgcttcacttttttaaaatcctttttattttcgtgtgaactgcgatgtctttgatctcgttcatgctccatcataagagaatcacagctagcacttccatttcaatgatgtttttcctacatgacatgactgcagaggatacttgtgattgatcaacaacattttgcagcaacgttatctctcccattgttgatcaatggaattgatcaattgatgttcctacttattggaatgaatttcccattgtggaaaaaatggaaagactggtacaagctgctgaaaaataaactgtcgctactcaagttgaaacatgtgtgtaattatctgtcagctgctgcagttagaaccttaaatctgtaaatataattgtgtgttatgaaaatagatgcacaacggagacacgaatttttacgtggaaaacccttgcgggaaaaaaccacgggcgccgaccggcaatgatcactattgaggagttgattacaaacgtaggggaatcacaatgggaacgtcaccccttcccgtatggcttacaagagtatatataggggataatagaaggacacataataggatagacatgaagtcctactaggaaactaatccgaatatattgtgggcccaaaattcggatcacatatttaacaatctccaccttgagacgaatttcctcttgtagcataaaaacatcaatcaccaaagatacctcatgtaggtaaaatcaccgcgcgccaaatagtctctaagactatactgtaacaccaaccaaacttgagcaaagctcaaacttagtagtaggaactggctttgtcatcatatcagctgggttatcatgagtacttatcttgcataccttgacatcaccttcagcaatcacacctcgaataaagtgatttctcacatcaatatgctttgttctctcatggaacatctgatactttgtaaggcatattgcactttgactatcacaaaatatattaatgcaagacgtaactccacaaagctcagtgtacaaacctctaagccaaatagcttttttacaagcttcagaaatagccatatactctgcttcagtagtagataaggcaacagttgcttgcaaacttgccttccaactaacagcacatcctccaatagtgaaaacataacctgtgagcgatcttctcctatccaaatctccagcaaaatctgaatccacataaccaacaagtccatctctagatctcccaaactacaaacaagcactagatgtaccacgtaggtatctgaaaattcattgaacagctttccaatgctctttgccaggattagccatgtatctactgacaacactcaatgcatgtgataagtcaggacgagaacataccatggcatacataagtgaaccaactgcacttgaataaggaactctagacatgtactcaatatcataatctgactgtggatataaatctgaagataatctgaaatgtgcagctaaaggagtactcactggttttgcatcatgcatattgaaacgacgaagaactttttcaatataacctttctgactaagatataacttgccagaatgtctttctctagtaatttccataccgagaattttcttcgctgcacctaaatccttcatatcaaattcactactcaattgtgccttcaactttgctatctctgatttgtcttttgcagcaatcaacatatcatcgacataaagaagcaaatatatagctgaaccatcaacaattttgagataaacacagctatcataattggatcttctaaacttctgagaaagcatgaaagagtcaaatctcttataccactatctaggtgactgctttagcccataaagagatttcttcaacctacagactaggttctcttttccaggaacaacaaaaccttcaggttgctccatataaatgtcctcttctaactccccatataaaaatgcagtcttaacatccatttgctctagttcataatcatgcattgcaacaatactgagtaaagtgcaaattgaactgtgcttcacaacaggggaaaagacatcattgaaatcaatacctggaatctggctataacctttagcaactaaccttgctttgtatcttgcctcatcacttggagatataccttcctttcttttgaagatccacttgcaacggataggtttcttctcctttggcaacttcaccaatttccaagtatgattcttttcaagtgactccatttcatcatgcatagcagttatccatctattgcaatcatcagaaacaatagcctcaaaatatgtagaaggttctgcattaccttcaatttcttctgccacactcaaagcataagcaactatgttcgcttcttcaatatatcttcgaggaggtttaatatttcttttgggcttatcttttgcaatagaacgttttggagactgctgaatagtagaagaatatgaatcttcaatcacaggtgcatcttggtagatagaggcatgttcatattttggcgcatgccgtgaagtgatctagtgctccacgagcacactggatttgtcatgactctcaccaggaacattagtagaaggtttgttatgtaacattactgattgcatggaagacaacatttctactaatcgcatcctttttggtttcaggacaccataacttatagcctttcaccccagccggataaccaagaaaaatgctcttaacagctataggctccaattcaccattatcaacat

SEQ ID NO: 5259 - DNA, 2477 bp, Oryza sativa
  unsure (1)..(2477): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcatactataagccacttgctcctaaaattaaataaacacaacaaaattatcaaatcacacaaagcatacatataaaattgtcctatagaagccaatagtgataaggccgtgcctgtataaaaacacattgtggtggagcgctgggccttagaagtgggggagggagttggagggtaaggggagtgtgaagcgatcgggaggtcatgtgggagagtaggagatgccatttgcgctcgtcatggcagagtatgaggccggtggctcatgctgggtgtggagaaggagaggaaaatatggattgagatgggtccaattacaatagtaagcttgtgaatagagagacaaagtatttattaggggtatccagattcgatcgaacgggcaatgcatttcttgatgatgtggaagcacggaatatcaggaaatagctattaagtacactaagaggggatgaattatataggtttataggtttaatgaatgtaaatagagattgcaagatatatatgatgtgttatactgtagtgaagcagacatattggaaagtacgcaaagggttggagagtttttgcagattatgaagtaaacaaaccaactgtaaggttactctaaatatatttagaccaggaagtaatagaaatgctaaattaaataatagctaagaattctgtgtgtgtcaaatgcacaaattacccttctagatcaaaaaacaaagagaatgatcatcttcgttactaaagaaagtaaaaaaaaaagtaggtaagcaaatgcatcctatatctattaacgttatgggattcaaccgcttgcaggttgtctcaactttgaaatatgagtatgcgattgagaagctaaagagtactggctttggaattttagaaagatgcggtggtttacttgtagctatcaaagcgattgcagggcttttgaaccataaagagataaataaaattgagtggggaaagtaccaagtccttcatggtcagtagatggaatgcccgaaaagataaaccatgcaatatatttaagctatgatgacctagctagcccctcatttgaagcaatgcctcaataaccatttgattgttgaaatttggataagtgaaggttttgttaatggaaaatcaaatgaaccggaagagctaggaaaggagtattacaatgagttaattataaggaaccttatacaggcaatgcccaatagtgaatggagcatgcatgatgtcggtcgctcattttgtcaacatttggctaaagatgaagcactatcatctcaaatgggacaacttagagtcagtgacattttgaaatggagggagtatgaagtaaacaaccaactgtaaggttactctaattaaatttagaccgggaagtaatagaaatgctaacttaaataatagctaagaattctatgtttggcaaatgcacaaattacccttctcgatcaatcgcaaatctagcctatatgtattaacatcatgggcttcaaccgcttgcagattgcttcaactttgaaagatgagtatgcgattgagaagctaaagagtactggctttagaattttagaaagatgtggtggtttaccgctagctatcaaagcgattgcagggcttttgaaccacaaagagataaatgaaattgagtggggaaaggtactaagaagtccttcatggttagtggatggaatgcctgaagagataaaccatgcaatatatttaagctacgatgacctagaccctcatttgaagcaatgccttttgtattgctcactcttccctaaatatggtaaacccaataaacatttgattgttgaagtatggattagtgaaggttttgttaatggaaaatcaaatgaaccggaagaactaggaaaggagtattacaatgagttaatcataaggaaccttttacagacaatgcccggcgacaataataattggaccatgcatgatgtggttcgctcattttgtcgacatgtggctaaagatgaagcactaccctttcatatggaacatcttagagtcactgacctcgattcaaatagatatcgttggttgtgcatacagaatgaattagattggagtgcatggcaggaacaaaactcaattagaacgttattttttt

SEQ ID NO: 5260 - DNA, 9849 bp, Oryza sativa
ttctctatgccaattgaagaacttgaggcacttgtacttttcccgtactgacatacgtagcctgccagatggcatcggcaagatgaaattcttggagtacattgggattacatgctgtgaacaaatacaacaacttcctggtagcattataaaactagagcggctaagatctcttaaccttatgggcacaaacataaaaagtatacctaggggttttggtcgccttacaagtttgagaacattatactcgtttccagctcagatgggtagcagttcatcaaaagatgagtggtgtagtttggaggagctgggacctctttctcagctcagggatctccatataaagggtttggagaatgtatctgccagctcttccgctgcaaaggccatgcttggtgccaagaaacatcttgccatatggtggttagagtgcactgataggcagagagatgatggattcttgaaagaggaaggaatcatttctatagacgagcagcgacgaatcaaggaggtttttgatgagttgtgcccttcatactgcttagaacaactttacatcagaggatattttggttggcagctcccaaagtggatgacatcaaaagcatctgtgaggcttgatagattgacgagtcttaagttggatggcctgccttgctgcaccaaactccctgatggcttgtgtcagctttcctgtttgaagcttctacagatcaggcgtgccccagccattgagcgcatcgggcatgaattcctgcagatacagcaacacaatggtgattgccatccttcccgagcagcggttgcatttcctatattagagacgctagagtttacagtagtgctggagttggaggaatgggtgtgggaggaacacattcaagccatgccactcctgcatgagcttacactagacaggtgcaaattgcgacaacttcctcttggacttgctgagaacatgccagggctttgagtgttctcaaattgttcatggtccataacctcaagtctttacagaatttgccttcagttgtggagcttcacctgtataaaaaccctgacatggagagcatcagaggtgtcccaaaactgcaagtgcttagcattaattactgcccaaagctcaaactattggagggaatacctgcgctgcaaaagctctatctgctagacttcagcatgaaaacactcccaggatatctacaagatgtaaagccaaagagtttggtgctggactgtagtttgccactgcttggtaacatatcaatgggggcctcttgctctgactgggacaagatcagccatatccagcaaatcagtggatatgcaggtgaaatgcgcatcaggagaaggtggtatgtgttttacacacgggagcccttcaaattggacacaaatatcgtctgctcttccatatctagaggtaaacattactcattggtgtatacttttgtcgacgtattctcttcctatacattatggagtattttggtattcttttcttatgttttggaatctgtatgtgcatagccaagaatagaatctagaagcttaaactgcatattatagttttgcctcctctaattaatccatcactgtatgtgcaaactaaaatatagtttccctggagttagtgtttatgtagagtatatggttagcctctttcttttttctcaagctccgttgtcatataactaccaatatagtgttcacttgataattatttgcccactagaataaaatttactacagtaaattaacgtctactgacgaaaagagagatatggatggaacggtttggatgcaaggcaaagcacatgatgcgattcatcaccttatcttgcacatcatctctatgaaacgtgattattgatagaagatttttccttcaagcattacatacagagctagattatttttgtctgcttgaaaatttcctagagtgatatgataaggaacaacagattgtttttcaccaagtagctcttcggatgagcttgcttaattagaccacaactaaattttactgccacaggtctaaatcgtagtttgagacggaagcccttcatcagtagcagtgtgtggatattcctaattaacctgagttgtatcgcaggcattatcgatggtttgttgaaggacaaagagaggcgcgccaaggagttgaggatggtgaagcttctgtgtgccctcctcgccgtcgttggatttgtttccattctgccacattgttatggattattgttgtaagataagacgacgttgccgccgacggatctcgccgggctgcgtaggctccttgccaccgcctcgccacagtgaggcgtagagatcagcactagaagagaagacgtacgggaacaactgtggaggccatgcagccaccgccgtggtctcccacatcgccgtttggtttctctgtagctcaccggcatgacatcttcactggctgcctcctccccacgcagcagctgttagcccaatctgcctccgatccttgtcattgtcattacctgtgattattaattgttgattgatctgatatccgcctggtctgggatatggcctctagcgttactcgcttgtcgtgcttcctgattgttgatgtaatttctgatttgtagggatgcctaattgtgaggttgatgatgttatgttatcagtgaataattcttttatgaatactcattcatcgtaacaatacacgagtaaaatttatttttacgtcaaggtgtctaccaacaactcgattgacatgataaacgggtcgggagatcctacaagagagtcaacagcttctgccgccatcctcctttaggaaagatatgaaccttgagtccttgatgtactcatctttttttttttgagaagggtataactcaagacgcacacttacacacaccgcactcacaccatgacacacttacacacatcctccttcaggaaagatatgaaccttgagtccttaacgcactcatctttgaaaggtaaaacaaagggtatatataaattaacgatctacaacaaagatatatagaagaagctcctcgctcgcatgttcagtagtactccttgctgcaatagcccatagccaccacactattacatatgtaataggaaaaatgagatgacactatatgtgccggaaagtctagaactgacacctataatattttttccacccgaacacacgcctgcagggttctattcaacacaaacagcacctatgtggcaacatatgtatgctggatgttaataggaaccggcacctatatatattcctcctaaaatataggtgccggtttttttcttctaatcaacatatttaaaattagctatcattctagttttttgaaaaccggtacctattgagcggtaggtgaagctgagcggggtgggataagaaaccgaccttaaccattcacctctctcactctccctgtccttatccatttggcttcctctctccctctcccatctccctactctcaatccatcagcatattctatgatgtgaatttgtgactctttttttaaaaggattttgtgatttattttatggagcatcacctccgcttgaattaagacgagcctgttttgttttttcagaaatgtagtacaactcataggtgcagattttcaatctggcatcgatgagtccctctcatcaataccatctccgtggtgccggctgaaaaatctagctcctatatgggattccctactggcaccgaagtgagttccgatagtagtatgtgccacccactctctccaataggagtgaaaacggtacgaaaatcttcgagatttcaggctgctgtttctggtttgcaccgatcatttcagtcggtgcaggcaatagttggtgttggaaatggaaatggtaatatgttccaaaaatggtagcaaaatgggatggaggttttttcgaccgttttgttgataaccctatttgtctaataatttctatcaaaattccaaaacattcctagtgtcccagccagcccaacccatcggaagcccatgaattgaggaagcctaataagcttttagcctattagaaaggagaagtgtccaggggaaaacgtgttaaccctagagtgtggcatgtggactttgctgaactttggtcttttcaacttatcgatgttgaagaactgttgacctttgtaattatattgttcgtcggacttattattatatcatcaatcatcacatcatggtgttacgtgaagtgtgatggttcaataatgaagttataaatttatcttcatgcatagttaaatgtgtggttatgtcacactccgttatttccgacatgaattttcgacttccgaccaatatcggtagatttcattccgacagtcccgttttcaatatatcgttattattgatattgttatcgttttcgggtctactgttctgattccattttcgagaaaaaaatataaaaataaaaatggcagagggtttcaaaagaaaaaaaaagatcgatgaagcttgcacacagaagcaacaagcaacacaggcacagccttcaacaccaaagcacaaaggtaaaacaaatccacaccgatcgagaagcatatatacgcagatcaacacggccacagaaccttagaacacacaagccacgcacagaaactacctcgccccgttaccacacatgcacaaaagcaaacgacaaacgcgtagttcttacgcgctctctctcttctagttttaattaagccctaacacagcgtacgtataaacgtgcacttatcgatcgtgtggcggccttatctataaaagatttgcttcggtccaataaaaataccccgaggtaccagtacctcacgcggtaacaaattgttttcgatcgttggatctaacaatatccatcttactcagctagatccaacgatcagaaataatttaatactgtaaggcaccgatacctcgaggtatttttttttcaccggaacaaatctctatctataaataccacatacacgccagcttcagtctatcgcatcgctcacagccacagccacagtagcacacaccaattctgatctgccaccagcagctagctagctctcagccatgtcggccagcaacaacaagctgcaattcaccccacgtagctcgctatttcagggcaacgagatcaacttcagcatgctctacctgcaccacacgccggctggtccaagaccagaccagtccgggcttacaggcaataacagagaaaccggcttgggccccttggtcgtcaacaactggccggtgtatgacggcatcggccgcgacgccaaggtcgttgcccgtgcacaaggcctgcacatttacgccggtaactggcataactcctttagccttgtgtttaaggatgaaaggagcgtaatgtataccgttaactttttttaaacatatttgaccgtttgtctattcaaaatatttaattaattattaattcttttcctatcatttgattcatggttgaatatagttgtatgtatacatatagtttttgatagaagtttttgaataagacaaacagtcaaacatgtttaaaaaagtcaacggcgtccaatatttagggacggagggagtatattgatctgtatgtatatatgtgtatgcgtatgtatgcatgcatgcacgaggatggatacactactctagctcttttaatcacactataatgaaagctaagttctacacttgtattttggccattagtttttttctcaatcaattataacgtggcagtaacctattggtcgatgtggtgttttatgtatgtgctacacgttcaagggatccacacttgaggtgatggggatagtcgttgaacgaggtgagtgggctattgttgggggcacgggacagtttgctatggcaaatggtgttatcttcaaaaaattccacgaacagaaacaagaaggcaatattatggaactcactatccagggattttgtcctgtcttgaaagggtcacaggtaattaaggacaaaataatctatttttagctttgttaaatgttatgaatcacttgacgtgcaatatcaatatatatggaatatgcaagatttacatatatgcagagccttgtcaccaagattgggccttgcggcggaattgatggagggagagctcaagacatcacagcaattccaaagcggtctagaatccattacaatacatagcagctggaatgttgattctgttaggaaacgataggcgaacaaacgataaagaataataaatcaatcacaaaagacacgagatttaacgtggaaaaccctcccaaaacaggagagaaaaaaccacgggcgccagccagcaaaatatcttcactatatctgaggtgaggttacatcgtcgcacggcggcttacaagaggtatatatatagtggaaccctaaaagggatgatgatccgtacggcagaagctggcctttattaagtgcaaatgaatttggatcacaactcaacaaactccaccttgagacaaattccttcttgtagcatgaatcaatcctttaccctgaacacaacaaagacaaaaaaaaacactttcggcgccaaatagcctctcgggctaaaccactataccaactaagcttgagcaaagctcaaacttagcaacaggaacaggttttgtcattatatcagcaggattatcatgagtacttatcttgcatacctttagcttaccttgcgcgactacatcgtgaacataatggtacttgatatcaatgtgctttgtcctctaatgaaacatctgatctttggtgaggcatatagcactttgactgtcacaaaacaagttaatgcaagaatcaactccacaaagctcagcaaacaatcctttcagccaaactgattatttacatgctggcctttattaagtacaaatgaatttggatcacaactcaacagattcgatatcgtttatttacttggaccaagctggacagaagcacagagcaggtccatggggtggtcctggtggggatccctacatggttagtgaacttccaatacgatctgtatttgatactccctccgtttcacaatgtaagtcattctagcatttcccatattcatattgatgctaatgaatctagacatatatatctatctaaattcattaacatcaatatgaatgtgaaaaatgctagaatgacttacattataaaacggagggagtactatattttggagtaacaatcatctatccctttgttcaaaaatatataaacctagtaatttactactatattttggatagacgctcgcccagctcacaccagacactcacaattaatgaaaagaaaatactaatatattgggtagtaaatttcttaccatacttttatatttttccttttctttgtgtagattgaatttggcagttcagagcttctcaaggaagtttctggaacgtatggcctatatgaaggatggaaagttataagatctattaaatttgtcaccaataagaaaccatatgggccatttggacggtaggaaggaacccctttcagcgtcccggtgcagaacaactccagtatagtgggcttctttgggcgcagcgggaaatacctcgatgcagctggtacctacgtgcatcctatctaaacagtcaaaatcagcttcccgtgtttgagtttgaagtgtattttcagctacaaataaatatgctgatgggggttcgtccctttcatttctgtattgtgatgagtgatgctatgtagctggagtactgtcagcggtttcagtttgcagtgtgttgtatgcatcaataatgatcttcattgaaggttggtttggtgaatcaagttgtcattcaatgagtatatctatcaagctgaaattaatatttgtaatgccatactgaagattggttttagagagaatctattattctatacaactaagtttacttcaactcaacggttagccatcaactttgtcttccttagtaatatgccaccgattttgtcaatgttttctacaatataccattggggtggatatttttcaaaaaaatgcctaaaatgccctttaatacatagagggtttataattgattgacctactagaaaagtattgaaaaaatatgaaaatttttacatagcctccttaaatattatgaagtgtgcgtatattttaagactttcaatttgcatgtattgattttttttttgaaaatatcatttatgttcaatatgctaatagaatactcatgcgttgatgttattttatataaatcatctttcatatgacacataaaattatttttctaatccggctatgttttgtgtatgtgattcatctttcatatgccataaaaatagttttaaaaaaacattgaagaaaatcctaaaatatatacataaacttctacattctgtaagaagcctacacaaaaactttcatattttttcaaaacttctaatgagtcaatcaattatcaactcttgtatggcttgaaggatattttaggcatttttaaaaagtatccacctcagtgtggtacattatagaaaaaattgacaaagtcaatggtatattatagaggaagacaaaatcaatagcaaattatcgaagtagagtaaactcagtagaataaaatagattctctcttagttttataccatcgttgtgaagtacacgaggaatattatgcatgttgtcatgaatatgcatgtacacgaggaacactgcaggaataaccactaaaataataaaaaaagattagcaacattagttagtattatctgaatttcagatttatttatctatagctaaaataaaccagcacgtgatcagcagaaatttgtaacctcttctcttgctactgcatgctcctccatactcctattgtcttgttgtgaagttgatcatcttctaaggtttaatgttgaatgtgactggtatttctaagcatttctcttagttttgacattatacagtttttcggcactcccataaaaagaaaattcaaaaagaacttcttgcttctttaattcgcaacaacggctgaatctaattgtgcttgtggttggctgaaaagtaaacaagatgatatatccaacaacgcctgcttctctttttaatttaaccaaggtagatctcatgcctttctactaaaaagaagttgttgtggcaaagatgaaggatataaatcaaactaaaatggggactacctagatatcactcgaaagattttctttaataaaaatcacactaatataattaaagcataagtatggtgtaattacaattacatcatttgtatataaatcataacaagattgatagcttgctcatttggttacaaccacacggcatcaaccaagaggttgtggcgtttgccttcaattttttcatctcaatgcacgcatcatatggtcaggaattgcgtgtgatggctatggaaaaaaagaaaatctttcgagtgatttatagtaaaactgaacaaaatgggagtggacatagcgcagatgacaagatgcaggcagtgtgctgcccgtggcccatgtttgactctccaaaacatattttttttactcaataaggagagagtatggggaacatttttttttaccatgttcgataatggggaacatgatgacaagatgcaggcagtgtgctacccgtggcccatgttgaacctttttttttatggttgggattaacattgcgctgggagtgggttcattccgattatgggactgagtgacaaatcaatacctataactctaatataagtgttttgatttattaaaaaaaattggcccctataattataagggatccaaggtggcagtttttaattttaaacacgtcca

SEQ ID NO: 5261 - DNA, 16612 bp, Oryza sativa
ccacttacacccctagtgacggctgcacatgttctttttttactccatatatattgtatgtccaacttgttgacagaaaatgtatggcactattgctgatatggtttaggagtgtctattgctcacacaaacttactagatgggatctggccaatccaccaagtataaagcaacattccaaggcaaattgtagcatcctcaatgtttgttgcaaaattagagaccaagttgaacctatgtcagctgacaatactaggtaggagagacatcacaatgtataaatacgtagatgagtaatataaggtggaacctgccttaaataaaatccccaaacatgagtcatgccataattttaaaaagagaagcggaacccaccataaatagtttatacctagtagtaagcttatgccctggaagtggtagttactacctccacggtgtatcttacatgataacaagaatgtgtttactacttattatcttctattccactatattgtggaggaccttacgactacatcaatcatagtgagttaatggcatagtgggaggcaacaaatgaagtagtacatcaatgaaaaaagaaacagaggcttgtttgaaaaatcatattaagtagcgacaataaagtacatcatccatttttctccactatccagtctgtgtggccgtgctcgtgctcgcctctgagctagttggtgatatggactttccaactaggaacttggggcgcttgacatgcgtactgagctggctttgcaatagctgcaccagtttctccttaggaccacatttcttcagaacaagctcgttaaggttgaggagatgtaacactccagacaagccattatcatcatcgctcaatttctggcacctgttcacccaaagttgttgaagttcaggcatcgcacccttctcaatgttaactgtttcaataatctccaatccatcgatatcgaggaatatgagctttcggaatgtgccatcattgaatatcagtgacttctctttgtaggacttctcccacaagcctagtgaagctaggatgcgcaggtccttgaggcgatgaatgtcatcctgctttagttgtgtccctattagcttcaccttcgtcagatcattgagtgacttgatccatacaggaagttcgtccaacagaccgcacaacctgagtgacactagatactttggtggtgttgcatctatgtccttgttgttgacaagaaaatcaagtgactcggagcgcacctcaagccgttgcaacctattgaggttctttatcgagttccatagctccttgccttcctcctgaccaagacctgtgacccctagcctttgcaagttcgtcagcctctccagcttcccagccacatctttgctcttgcgcacattgaccacactcaacatgtgcaagttccttaacttctcgattccttcaggaaccattacactgaattgatccatgccagatatctcacaagattgggtgttgtaacaatataggcaggatgccaagttccccaacaggttggaattgtggttttccatcccaaactgcggcatcttttgtagcaaatctcttgagaaattgactccggcgagaaggtaacggagcttctcaagtttagcaatgccatctgggagctgggtgacttgcgtgtcttggatgtcaagcgtctctaggtacagaaggttctgaagagaagatggaagcttggaaatatctgttcctctaagacccagatatcttaggtgtctcagctttcctatgtgcttaaggtcttcgttcttcagattggccatatcttccaggtcgagaacacgaagcattcgcatctcaagggtaatgagagatgctgggcactctccaaataccgttagcgatcgaatcaatgacaggtttatgttctccaacttttcatccctcttcttccatctgttcacaaccaagtggcgtatcttactttgtggaacctcgttacagtgcttcttgatgacaaagagctggttctcatcgatggacttggacaggattatatggagcatcatgccatgaactcgacagcgatcgactttcaggccatggctgaccttggaagattggatcatgcttctgttgataagctcattgaagaagcgctctcccactacttcaacgggcatgtcgcggttattcgctatgtaaccttctgcgatccatctcctcaacaagcgggtgcgccggatctcgttgttctcggggaagatactaaggtataagaagattggcttcaggtgatatggcaggccatggtaacttgagacaagtaccttcgtgatgtcctggagctggtcggactccagctctactccaaggtgttcgtgcaacttcttccattccattcctgttttaggcctattggcaaggagacctccgattgtggatatagcaagaggaagcccccagcatcccttcaagatgcgactgatgtgcggtttcatgtcctccggcaaggtatagtttggtgttctgtagacctttaaatgatggaaatggaatgaaataattaaattaatgagacgagcagtgcgtaggccagcgtttgttaatgtttgaaaaatgaaaatgactatagaatgaaattgaaattatgaaagccaaatgtaggtgcatgaaggaatcttgaaaaaaaaatttactatttcggaatacatagttatacccgggtcactgaaatttcaggggaaaaaaggggaaattttcaacaatttcaaaatcttgataatttttgcataatatgaatataattttgttaatataaaaaaacatactttgcacagtagaacatccttcttttagaaaatggattaaaattgagcttctacagccggtagaacatcctaccaacacaccgaaattttggaatttcggatccaaaattgttaaccctgtctagaagtgagttatatgtatgggtgtcgttcttgccaatttcccactgaaatcggtcaggtgatttctggaaagttcccatttctggtttcctccaaaacttcacttcctatatgcaagggaactttatgagttccttttgtccgaataagatcctcgactctatttatccccaatcccctcaattttacacatgtcataatttttttaaaattttttaacaaaatagatcaatatgtgatatatcactttatacaagttgaagtccaacttatacatgtagaaacaatatcaacaaatttgactctgaacagaacatgtaattcctagtcaaatttattatttttgtttctaattatattggtcaaattcaattgtgcagtaaatatcacatgttgatctatcttaccattttttaaaaaaataatgattttttaatgacatgcacgaaaaaagtggacgtccccttgagagacgaaaatccatatgtggtggtgataaattcagtccgaccaaccatgccccactatgcataaaagttttttaaaacaccttgagggatgtccctatatttgtttgccatgcaaatatttatgaaacagtatgtttaaaaaatatcaataaggattacagtctctattactgcatacagtcgttaatctatgattttcacattaactatgttttacttaaaaaaggagtgattttatggtcattgagaaagtatccgtaggtacaatattattttaaatgtaaaatttagtacctccgatattaggagctatggaaatttgcactataaattttagtaacactcttggtgcctcttagagactttaaaatttctcaaagaaaataaatataaatgttactccctccatttcaagttataagatgttttgacttacaatgttaatagacaaatatagtaatatttatattactaaattagttttattaaattagtaattaaatacttttttataataaatttataataaacttagtcgaacttaaagttgtttcactttgataaaggttaaaaacatcttataacctagaactggaacggaggagggagtatcaactatcaagcaaagacatgcatgtacctttcgacaaaggagatccttggattgcttatcatccagacgtttcagctcgtagacatggccatgctcctcaggcgcgaggcccgcgcagtgcccggcgacgtccttacggcgcgtcgtgacgatgacgacgctgcccttgttgttcaacggcttgaggacttgccagatctgatcccactcctcctggctgagcaggtcgtccaccatgatgatgtacctcttctcccgcaggtagtcctggatgacgttctggtcgtctccggctgcggcgcccaagccgaggccgagctgcttcctcagccgccgcctgaactcgtcggcgccgtcgagcgggtgcggcaccgtcacccacgcgctgcagtcgaacacgtcgagcaccgccgggttgttgtgcaccatcctcaccagcgacgacttccccatgccgcccatcccccacaccgccaccacgctcggcgacggcgagccactgcagcgggagatcagatccttcagctgctccttctcgcctgcgcggccgatgatctccgactcctggaacgcgagctcgtcggagctcgagccatggccgccggggagcatggcgacgacgcgctcatggtacgtgcggctcgggtggtggtggtcgtcgacgacgatatggtaacgcagcctaagctggttgagctcctcgacgctggccttgagctcgcggatccggtcggcgatgcggccgcgcgccgcgagggggcctggccggagccaggagctgcccgtcggcgacgacgagatcctggcggcgtagagggcgaagtcgaggaggcagtcctcgatgtcataggccaggtcgcgcacctgcttcacccacgtcctcaagatgtcgttgtccccgcctccggcggtggcggcggcgtcggggtgcaaggaagaggaggccgtcttgatgaaggcctgcatcatctcaagctcgttgcggatgaacttcacttccttggggacgccgaggaagcgcgcgacctcgtcggcgacggcaggcccaacgctgctcaggacgacgtcgaggacggacctcgccaagctcaccgccgtcgcttccatcgtctctctgccctctcacgattagagcctttttcctggtttaatttgcttgcagagtgcgcacgacagagcgagatttatctgcttcttgttgatgcaattgagggatcattttatacaaaaactttggcgggaacgtgcgcgatatatatgcgtacccgccatttctttttgactgcctatatgtaatttgacaggaatctaggatctaaatcttgcaaattttataccgttggttcaaatttaaaccaaaggcctagattttgtcatagtcccatatatatttgcccctaggcgtcacggctagggatgaaaatggtgcgggtatttctcgaccactcgcccaactcaaggctcgtgggaggaatataggagaaaaaaataggataccagatactatccgagttcgaatccgaattcattcgaattttattgttgggttggaggtttgctccagaaaaatttggaacaaaacgtctaccgcgttgaagcccatagccccatggagttccacgaaagtatgattcttatcatcaggagccttttgaacgtctctacgatgagtccagattctatagcagtccaatctgaaatgaaagacttctcactcttgatcggagtcgtaaactaaaactacctcttcatcaaggttatagaaaaacttcgtcatctagttctaccattttgaaaatcaattctcttttcttacgggcatttcgagttacttgttgactcacgattgtgcctattaaaagtttcaaaatgtcctctataggatacgggatgacatgtatccgtctatatgtcccatattataaaacatgtatgaaaatctattacctataaacatgataaaagatcggctaatcactattttatgagctcacatgtaatattatataatttgtctcttgatgtatctcttttagtactttaattaccttagtatatttaatatctatgaattagatatacaaatagatatccgtttctgaatctgattcaaaggaaataatatgggatatgatacaccttaatatatataatttcaatgaattagatatacaaatagatatccatttccgaatctaattcaaaggaaataatatgggataggatacgagatgagtgatatgttatccggcactacccgtatccggttccgaacttaaagggaaatataggtttggatatggaaaatgttataattcgaccgtacccacccattttcacccctagtcgcagcttcttccctcctggcccctccccctcccccaagcactgccggcgagaccagccgaccagcaccaacaccaccatcatgtcctctggtgcccagcgccgccacttagggttcagaatttcggaaatttttttttctattggaccttggccccccgcgcggtcttcggctcaagttgtatgaggcagaaactcgtcccatacatgaaattatttcaaacagatttggattttttttttcattttttatgaatttggtcaattttgtactactttgacaaaattttattcaaatggtggaaattttctaaatttttatcaaatcggtaccccgaaatacattccgaaaacggtaaattaaaccctaccaccacctccctgtcattccccctctccccaaataccccgacgccaaccctgaaatctagtttgtcgaggtcgccggagttcatgactctgtgcacgaatcttcaaccgaatcagttggatcggaatcaaaatatgaaagattgttatagcaattccggtttttttaattagaacggcaacccgctaagttcgttgacatttgcttgcctcccatgcttaagcttccttggtaagctgtggaaatttcatgtacgcaatgatttaacaatttaaaactgaggtttaaactagggtactcaactttgatttctccccatattatagtaatttaatatgtcaagttgtcaacatgttagttcttgttaaggcgaaactgcatttttactcttttttttttgcggggaaaactgcatttttacttacctaaacatagcgtatagttctagtatttggttgttcaacctatgatggagtgctcagtggtggacgcagacatgggacggatatactcgataaaaacagctaattgcaacatatacttcctccgtattttaatgtatgatgccattgacttttcgaccaacgtttgaccattcgttttattcaaaatttttacgcaaatatggaaatattaatgtcatgcttaaagaacatttgataacgaatcaagtcacaataaaataaatgataattacataaactttttaaataagacgaatagtcaaacgttgaataaaaagtcaacggcgtcatccattaaaatatgaatgtagtattatataaggttttgggatttataccgaatgctctgaaattcgtctatttccatgaggcccaagacatgacctcctgttcattgatattgtttgacttgtatgctcatgcttccttgcaaatggcggaatattcatttttgctatatatagtttaaattgaggtttaataaagctaggatgccctccatattataatatataggaggctaacatgcatgtcaacacggttgttcttgttaagataaaaataacggcatcaccttaacgaagtttagttttagtatttgttgttgaacaaattaaagagtacccgacgagttagttgacattgtttacattgcatgctcacgcttccttgccaaatggtgggaattttttttctttagtttaaagtgagtttaaattaaattagggtatatataatcgggttggggtttctcttcatattataataatataggtgggaatgtggctaacatgtcaacattttttttacgtaatacctccttccgcgctaacataggaacatggctgttcttgctaagataaaactgcatgtacttaccttaattaatatactagtttagttttaaaatttgattgacgaaccaattaaaggtacttgacgagttagttgacattgtttgcattccgagctcaagcttctcggcaactggtggaaagttcattaatttttctatagtttaaactgaggtctaaattaatctgggcataaagttgggatttctctccacacagaggctaacatgtcaacatgttcgttcttgttaagataaatactactacaaaacagcgtatatatatgccacccttatcgatgccggttggaccaaagccggttctgataaggtttcctgccctctcatactcacgcgctctcaatcagtgttggttccttaaattaatgcctagctgcactgacactacgctggattagaccatctctgacgggttcaaacccttacctttgacaatgccataataactctgttcacctttgttgggtggacagtcacattttatatatgggcctgtatttttcgtcccatcagaggtgaggatcttcacaagcccacgtatgcttgtaacccgtcagaggtgagacacctgtgacgggtgcaaagtttacgacccgtcagaggcatccccttatctgacatacctactttggagccatcacaggtgactcacctctgacggactgatataccaacgctgttagagcttaggtcatctgtgacggtgtttgtttatgacccgtcaataatgaggtactttcaaaaaaaatttaaaatattagctagcttcaggatttgcttgccatgccctctaagaaatagatacatcacagatattccagccaatccccaatttcacagttttccacaattcagcacagatacatcacagaattaacatcatacacatgcattccaaaatcccacaaaaattacattgccagtcacatattcacaatgcacatgcctacctcacatttcttttgagcctatgaaggcacaaacttacccatttttatgagcacatgaagctgcaaacgaaacatggcagcctgagagatctgcttaactccagtgcgctaagggcgtgccagttggtttgatcctgcaaccagcaaggaaacaacaaacaaagtgagtgagccggtagccgattggccgatgacgtgtcgttagtgatcctagccgatatagttagaccagatcagctatggattgatgtgtaaattaagcacaaaccctaaatatgccacatcggctgtaatatcatctccttagttttgataaaatagatttaagacaatatcataaaaattgtcgatgtaacattatttagagcaagataggtaaataaaaataatgtactagctaatactctagtacaaacttatataaacaaattaatctataaaaatatatcaaataacgatcaactaccaggtttgataacctagccgatgttgatctaaacttgatatatttatatgaagtgatctgtctatataagtggcaaatatacataaaacatgtaaagtagcatctatattacgtaagatcggctgaaactccgatactatctctaattataattaattccaggttagtttttagggttctagacaatactatcataaagtaagtaatgaaacctaaagtctaaacggtcaagaaattaattacttttcaagatggtagatgccttagttaatctaatctagtaaggcaatttatccgatatcggcaagaaccctaaaacgagaaccaaccgatagagctaaattgagatactaagactagattaactaatacatatgataacagatggtcatgataaaaggattagaacatctaagatgatatattggaccaaccgatatagccccgatagctcaagccatcgagacgggttacttcttttcgagagaactcgccgaaaagaagaacaaaaagggtggcgatgcgccgaagatgtattggattgtctctctcttttacaatgatctggggtctatatttgtaccggagtacaaatttagtccattataggcacgactcaaactttcctaaagataagatacaaacaaagactacatcgcgatctcttaccaaatctctaacaaaccgacctaaatatcatagataatgcagcaaataggagttgttctaccaaggtcccacattttgcaaacattgcatgcaatttttaaacataataaaacatttgcgaaaatatagaattcaacatgttcgaaggaggaattgaataggacttgccttgctcaggagttactcaaatatctcttggtcgtgcacactctcatcaacagcaacaatcaatttgtcctctatttaaatttaaacatatattcaaacgaaaatccaatagaactccaagataaaatgtgatgcagggtgcatgaacatattcagtgtatagagggtgatttaatataaatttaggagaaataatcgcctaaatacgatgtcaaatgtgcaagttatcgtgtttctaagattttaaaatacactactattcaaatttaaattagtgaaaattttcacaacagtgatgctatgtttgagtgcgcagtattaaagagagagctattatgaaactaatccctcagggttgataatacttgttgttttggacaagggcattgtcttcaacaaacaactttaaccattattttttattataatatgtatataaatgttaacaaatatatgattttattgaagtattttttaagactaatatgtgaatatagtcaccatatttcaaagataaatattttagaaattattcataactaaagattttaaagtttgacctcacccttatccaaaacgacaagtattatcagcccggagggagtaacaaaatttggttcacgtcaatcggatctaaaatgaattttctatgattttccaaattttcagcattttatagtgcataaataattaacagaaaaccttttctcagatttaataatttgtttataaaagaaactaaagcaaactgtcttcaatacgttttcctacagggaaggcgcattttcgttctgtgtaatcattttaaaaccgtggggtccaactaaactaaagtttgcataaattacatgtaagtcctaggccaacctgtcagtgtctggcattgttcggaaagaaccctatattttatcctaattacagaacaaggtccttcttgttcaacctgggcacaggcagctcggtaggcagaggcgcggcggctcgggaagggcagcgtcgcggcttttgcgcggctttgcagtagcgcgcgcagctttgcaggcgtggtcggggtcgttgtgctgctgcgtcgccgcacgggcagaaggagagagagagaccggcggcattggagtggtggcgaggggcggcggcttcgggttggccgcggcgggctgcgaggtcagcgcctgggcgcggcagggcatcgggcagggaagcaccagccttgcctcagctttgccagcgggaatcgcgggcagaggttgcttggtcggcttggaaacgatgacctcgatctcgcacgctaggtgctcgatgaattgcctgaaaggaatagagggagaggagggagaaagagagctgggagatggggatggtggctggcaggtggggccaatggtccttaggcccactgatcagagagagagagaaagggagaagggatgaggtgaggggatttttctgggaatttccaagaaggctgagagtttgattaatttttggatatgctacagtgctcaaatgcttgcgcaaaaattactggaggttagtgtggtcaagaactccacttggtgaatttttgggatttttctcaagtcctgtttatttttgaaaattaaaacaagtttactaatttgaatcaaattttggatgttttcatccttttaattgagttgcaaaacttttgagatttatggaagtttatttcaagtgtctaccacttattttaattctttttatttgttaatatttattgcatgcaaaagtgttatgagatgcaaatcggttgtttttttcgtccacacttaatgctccatacatgtgtctaaacatttgatgtggtggaaattttggaagtttgaagggagctaaacacagcctctatctataaatagctgatgcatgccagcttcagtttctcacatccctcacagccacagccatagaccatagtactacaccacatcttctcccctacccaccagcagttcccagccatgtctgctagcaagctgcaattcaccccatgcagcacacccattcagggcaatgagatcaactttagcaaactctacctgcaccacacgccggctggtccaagaccaaaccagtccggggtcacaagcacaaacaaggaaaccgggttgggttccttggttgttaacaactggcaggtatacgacggaatcggctgtgacgccaaggttgttgcccatgcacaaggcctgcacgtttatgccggtaactggcacaactccttcaccctagtgtttgaggatgaaaggtaagcatatatttgtgtttcagtgtttgtgtctgtatatatgtgtatgcatgcgtgcgtgcatccttcggtatcaatggatgggttacacatacactctagcccctttaatcacactacaaaaataagttctacacttgcattttagaagcacatgaacattagttttttctcaatcaattgtaacgtggtagattaacattatgtatatgctacaggttcaagggttccactcttgaggtgatgggaatagttgttgaacaaggtgaatgggctattgtcgggggcacgggacaatttgctatggcaaatggtgtaatctttaaaaagttccatgaacaaaaaaaagaaggaaatattatggaactcactatcaagggattttgccctgtcttgaaagggtcaccgtcacaggtaagaacattaatctattttctatagctttgttaaatgttaagaagcacttgagataccatatcattatgggatatgtaagatgtacaacatatctatgcagggccttgtcaccaagattgggccttggggtggaattgatggaggcagagctcaagacattacagctactccaaagcgtctagaatccattacaatacacagcggctggactattgattcgatctcatttatttactttgaccaagctggagagaagcacagagcaggtccatggggtggtcctggtggggatccttgcacggttagtgaacttccattgcaatttttatttaacgacagtcatctaggagtacctcacagcccacaccacacacccacaattaatgaaaagaacagaacatatttggtgttaaattacttatacagtagttatcctttttttatgtagattgaatttggcagttcagagtttctcaaggaggtttctggaacgtttggcccatatgaaggctggaaagttataagatctattaaatttgtcaccaataagaaaacatatggtccatttggacgacaggaaggaaccccttttagcgtcccggtgcagaataactccactatagtgggcttctttggacgcagcgggaagtacctcgacacagttggcatctacgtgcatccgagataacatgtcaaaatcagtttcccatgtttgactttgaagtgtgttttctataataaataaatatgatgggatcctccctttcattccagtagtgatgagggatcctttctagctgaagtgtgtttacttctgaatttgcagtccttctgtcggtggtttcagtttgcaatgcattgtatgcatcaataaggatcttcgttgaaggttggtttggtgaataaagtcgtcattcagttagcaatgtgttgtatgcatcaataaaaatcttcattaaaagtttggtttggtgaatagttttcatccaatgagtatatcgatcatctaagctgaaatatttgtagtgcccttctttttgaagcaaatagtaccctatctaaggttggttttatatcaaccttatgaagtatgaaagcgaccgagttgtgtatgttaacttggctgctatttctcacatcacgacatcttggtatttgaaacggatggagtaatttatattcttatatttagtaaaggtatgttataagaaagagttcaatcatttatggcatcaaataaaaactaaaaattaactactaggattgcatgaaaactcttaaccacttcgaggggcaagatggggcatggtgaaaggcctcgttttcttttagtactagattcagcttatagaattgaaagaaaaacagatggcttaattctataggcggtttttcaacaaatggtaagatggcttgatgttgggtgctccaataacgtcggaccgggagcacatgtatactgaagattaacattggattatttgtaggaacacacaatataggcaaatacagtatactgaagattaacactgggttatttgtaggaacacacgatataggcaaacacaggaatagaaacaaaaccttatacgtacacacacgagctagcagctctcttattacccttataagaccacgttgctttatacatatagctacttatctatctattatatactaaaagtacattaaacatcctataaacgctcttaatccgtcatatcgcacttctgcaaacgcttctatgatgctacatggcactctaataaattagagaaattcctacaaattttaaggaaaacaaaacatctagttaatttaatttcccattgaaatagtattgaaatatccaaataacaccatatgaaacattaaataaagattaattacaacataaaaacttaaaatgtgtaacatactcgaattctcattgaaacattaacttctcatactattataaatgagttactcaccatttatcaaatgtagcatactatacatgcacgcgtgaaaatcgcggcttagcttcgtttgggattaattgtctgacgagttgctattgctagcctaatttcttccgcatcacaaacacaggagtagtacaagaattacttctttcccgatgaggaagggtgatcagtcaaacggattaatcgatcgtcctctcgtccattcaattcgataggagtacaggaccaatagcctctgagacaattaatcatacattaattggcatatgtcatccattgtgacgtcatccatgggtacgtcatcaaaattctcatgtgatgggcgtcatgacatcagggtctcacgagtaatttgtacctcagtcaaagagaaatttgcatatatgccatccttaaaaaccggtttcgctagaatgtcatcgttaaaatagaattcgctcgaatgccactctcaagctgtgggcattcgttacaatgcaattttctctatttcttacatttggagatcatttttcatccatttaatttttttctcagatgctttatcctctagctgcacgggttgaaccaaaccacatccactcgctctaagcaagcacgaggaaaggcaaccacgatgacgctgatgccacccaccacttgctccagtaccttcccatgaccgcgctggcgacaaccaccacctactctaccaccttccccaaccacccctttccccgagccgcaccgcctcccccgcggagccgcgtagcttcctcccgcggaacagcgccgtctcctggcactagagcgaggcgggcaagttgctagagttgagggaggtggagtggcgggctagtcgctggagtcgagggaggcggagcgtggcgggcaagtgatcggagtcgagggaggcggtggtgcgaatgcgacggagggagagggagcgcggctccgtgtggggaagctgcgtggctcggtggggcaggcggagcaggtggtaggcggctctggcgtggttgcaatcgccccttctcgcgcttgttcggttcttgaaaacgtagttacgattcacgagagagagaggatgttgtttcgttcaaaccatgcaggcaggagcaaaaacatccaagaaaaaattaactggatgaaaaatgatttacaaatgcaagaaacaacaaaaattacattgtaggaaatacccacagcttaagagtagcattcaaacgaattccattttaactatggctttctagcgaagccgtttttcctaaggatggcacacatgcaaatttctcccttgcctccacttcctccccttgctcgtgcctccgacctccgatgcatccatctcttccgccactgccgctgctacgggaatcgccaactcttccgccctcactggcaccgcagcaacttcctccctaatcaacatgctctcgcagaccgcgtcatcagtatatgcttcgtaacctctttcttcctcatggttgcattggttttgttattcttatgttgctttggcctaaatttatttgcgttactccattcaacagtgcattttgttgtttatttggggatttgatttgcatgccatatattaatatataagcgagcaatttgccttctagctatagggcttatttgggggacccc

SEQ ID NO: 5262 - DNA, 39665 bp, Oryza sativa
cccccaaacagtctaaattttcacctagactgtgaaatgatgtagctgtataatccagaaaatgaactagaagccataagctggatttgtcagcttctccagattgtcacctgctgcttctcaaaatactaagctcccccaaatagggccaagtcttgcctgcgtcgacaactcaaccatggttactaattaactttacatttgtgttggtgtcatggtgtgtgataatattgacagtacgtttttctctgtgtacacacataattttggagatgacaaaattagcatgcactcatctttatatgctcagtcgtatctctactttagaagaatgtggaattgaaggatggggcttaaacttctatgccttatgttgatcacctgcagctatatcctccacccccactccccccccccaaaaaaaaaaagagaataagttcacctgatatcccaaaactttacgtcgagtttgtctgaggtccccaatctccaataccagaaattctaccgctcaactattacaaaccgtgtaaaataggtctcaaggcagtatggaccaaatttaaccccggttttactaatgtggcatacagcaagccccacatgttagtgcgccgttagggcgttattacactgagtcatctctcttgttgggttggcgcgagtttttccccttctctctctcttcgaaaaccctaggttaggcggtagcatggtggtggcagcgatggcggcaaggagaggagtgcatgcgaggagatggcgagttcgtatagtgaatgctcttcgacttcctcccatcccaccaatcgtgctcccatcccgcctcatgttgggcccttcgagtaccacccggtggtgatgtgcaagggtggtgcgaaagcggcacggtggatctcgtggggagtcgacaacccaagtcgtcggtaccacaaatgtcacaatcaggttagtgttcttcgatttgttttgtttggttgttgttatgggagttgggatttagcttgtggtgaatttgcatgtcgaactttcagggcgccggctgcaatttgtttgattggtatgatcccccatctagcagtttcatgagagagccgttgtatgatcttcgagatgtcgtgttgtcactaagagggagaaggctgagcttgagcattttgttgatgaattgaggacgaaggaagaagagcagtgtgcagagattactgcagcaaggcatgaactagcagctttgaggcttgtggcatctaaggatgaagcaaaaattattggactgaagccaagtaggctagagaaacagagatatgtgcttctaatgttactgttgacatgtgtgtttatgttgtttgttttggtgttagtgaagaactgagctgtaatatgttagcatggtaagatgtatggtggattggtggttgttgttatgtctgaaatttcagtgaatgcatcaatatgttcttttgtttgtcatgaaatttgagtgaatgcagcaatatgtttgatatgagatgaaacatattactcatcttatgtatgtgcagaaatatttgacataagttgaaatgccatcaagtatgactgaagattcatttgagatgggctaagagtttttcaaagctacaaatattacatgtgagtttggcacacatattatgtggccattagttagccatcccatacacagcacatgacatgcccaagagtttggcaatgcatcacaaaatagctgctcaagtgtgcagaaatacatcacatcttatcagattcccatggaaaagaaacatcagtcgactaggggttgatttctttgtcttggcactagcaggttcttgaacttgaacaaacacacatgcttttccagaagtgatcctcactaaagcagttctagagctctgagaatgtggcactatggcctgaagattcacactggctgaaccaccttgtcgggttaatacccttgcactggctgctaccttcaccattgggttggttttgtttggtgcctacaagcagaagatacaattagaccaggtgaatgagagtaatagtttagtccaggaaatggtacagacctttttcacaggaggtgatctcctccaagtctggcaagcagatgtgctagtactgagttcaactgcctttcttttcctgctttggccaatgctgctaggtactgagttgttggatgcattggcagcattggtagtgtgccgagaagctgttgtgctagttcctgcatcagtgtacttgtgacagcttgatttgttatgcccagatttcttataggtcctgcacctgatagttgttccaaacttagaaaccttttttggtttagctagttcattgagctcccttctccttttactcctaggcttccctggcaccttgatataccctagcacattcagtgcctctctaccatcctctggccaactagactttccctcaatttgctctttcttctaataacctcaccatcactgccaatctcatcaaatgactcctcatcatcattctcagcgtagggggtgctattttcatctggtttagccctaccatgcatagcaagaagacttctgtacccctcaaacaccacatcattcaggttataagcctttctagtcttcatcttcctcttgacctctttgtaatgtctctctatctccctagcctcagcatcatcatcagatggagaatcatctccagctacctaattattgtgatcctcactgtcaaatggcatcaaagtggccagaggtgatgagttgtctatgtaaacaacaagcattttgtcactagcatcagcatcttcttgcactgctttgtcctttagttttgctctcatttcattggcaccattaggttcttcttacacagcttagcccttcccttcggctctaagcttgccatccttatcttcctcatcctcatattcttcatccacatccaattacatttcagcctcaccatcactatcttcatctaaacctacatcaataacaatagactccttggctacaccaccctcactgatacaatcaaacatgaacttgttgacgaaaaatccacgctcagccgatggtgtcggaactgtgttggcgcgaactaagtcgatgaacacaacgacctgggagatctgcttagctccagtccaggtccaaaaattgatgagatatgggcgtgccagtcggtttgatcctgcaactgacaagatatataaattgaagatcaaagagccgatcggctgataagccgatggagtagttccagccgatgccgatgccagccgatgcctatagggttttgaacaatcgactatatatccaatgtaaattatgatacttaagtaaacaacgatatatagacaatcgacttatgataataaaacaacaatataatccaatagaaaccaatcggctaacaatgatataatagaataagtgatccgatggttaaagcatacattggtttgaggtccaatgtcattaaatccaaatgattaaataaacaatgaaacctcgattatcattggctaaatccaatttctatgcaatccttataagccgatgcaacgtctagataacttatcggctgaaaccccgatgaaacccttattggcaatcaaaggtaggttagtttttatggttctaagcacgagtaaggtcgatgcaactcaaagtatgcaaaaaaaaaacataaatttcagagacgtcagacagacttgacaaaaagttcagagatgtcaggggaacttattccccctcccacctcccccccccccccaaaaaaaagaggaatgtggaatgtgctccacatgtggactctcggagtttgtgcggtattattaggggtggaaacgagccgagccaatcctggctcggcttgcagtggctcgcaacaaactagtcttgccttggctcggctcagttagggaaacaagctaaaacttgagctcggcccggatcctttcctggctcgagccagctcgagctagcttgcaagccttcctattgaaacacttcttcatatatattttgtaattattagaaaaagcaagaacaaatcatcaacatgtaaaatttaaataagtttatatattcaattcttcaaaatcttaatgataaatttcaagttgtcaaataataactccataaaaagttaagtaatcgatataaacacataatgggctaggctcgcgagccagctcgtgcttggctcatttcagcaacgagttgaaaaggaggcttgggctggctcgtttggttaacgatccgagccaagccaaccaagctcgagccaagtgttacgccccgaagtttccccctttgtagctttaaaatccgtttaataaattgcctgaagaaatggtttaatttaacctagagatgaaccttaatcaataaatgcgattaataattggaaagggcatggtgggatttttcttgagttcaccatgccacaatacattaacaggatttttagcggaattttcagagcctcgaaaataattttaaccaattataatcaattctatgcaatatataaatcccaggaaaatccttttcctttttcctctttttcttttctctatcttcctttcttgggccgtcggctcactccttaggcgccttccctatccttgctgggccggcccatggccgtgtcccattcggcgccgcatccttccgtcttagggtcaccaactagttggggccacctgttggccccttcttccacctccagccagcggcaaccgccgctgctgtccaccttctccgccttccgtgccccactccacaccgcgcccacatcactgcccactactccgattttcccgcacgcgcgcctccccgcaatggccgaatttggcttcgaatcccctcctctctctctgcacctccccatgtcgccggcgcaataggccaccctcctggccacgtccgcctctccctcacctataaaacgcctcccccgagccccattctctttttccgcgctcaccgccttctcccgcgctcttcccacgccaacccgagctccgccgcccaccgtcgatctctgaccgccgctaaccgccgctagagctgccgccacgccatgccaacactgcctctagcttcgccgctgcgagagctacctcggccgccgcctcccgtcgccggaaccccaccaaaaccccatttccctcgtcctccggtgagcccgccatttttctccatctctggccagcgatgcaagccgtcgtggtcgtcctctccactactaatccctctccgctctctccttaggtgtcgtcggcgcctgtccgccccttcgcgtcggtgggtcgtcgctgccgccttcatctcccgctccggccgccatgctcgccggggaaaaccccctccccctcctttcttctccctctcccatgtgcgccgctgcttcgggcatgcgccaccgccttccgctccgccgatcgccactggtgaccgtgccgccgccctcgccatagccggtcggccagcttgaagccgaggccgagcctggcaactgcttcctgccgccgtccgatcggccaaaggccgatctggaacgtcggtcccgtggatcggcggtggaccgcccacgtggtcccggtccacggtggaccgacgtcctggtgccgctatcaaatggggcccactagctggcgccactcccccctccccgagccactgacatgcggggcccgcttgccggcaccgccccctcctttgctgacgtcagtcctaggtattaccgtgcaataaatcaattaaggcttttccatttatagtaaaaacacagataatcttctaaaaatcataactaattcatccgagctccgtttaagtccatttaagtctcaataaattcataaaaatccctagaatccattaaaatggttttatttcctgtttcagtagacttatagcatgttttgcttgtgtgctttgtttgtcacatagattccggtcgtttcgtcgctccgcgatacctcaagttcgttgtagaagtctcataagtgcgagagcaaggcaagtcatgcattacaattgatcatattgtacttggtttacaaatgtcccgctttctattaaatgttgcattattttacaatgtcatgtgggatggatcctattactcggccatatattgtttcccttatgtcattgataacttgggtattaatttgattagatgttggtttaggaaatggttagccatgcttagatccactagttcacataatgtgataattacattattagacacttagtaccatgacgagctgcgtgctcgagacatccgaccatgtttcattagtcgtaattatccaattaaaatgtgactgaatggtgggctgtgggtgcatggttttgctggtcgtacccatagcatttaagtaccggttcacgggaaaccctggaagacttattgtgcttaccacaagcgggagtgggtaactgcttaacttgtagtatagcttgaccctttcctaggcaccggtggcgagggtgggcgtgatggagttgggtcagccggggtgtccggttgtccagcttccagattcaccgcagcgcacagggagactgcccactgcctgtttaggagtgggggtgaaacctcatcatggtgtggatggttaggggagggttatgcgatgggtctcgtcacgatttccccctttgcagtaacatagtggtactgcaggacatggcaacatgtgtggaatcgtgtcttgtgggtacagttgtacagctctgaccaaagtaaaactattcgaatagccgtgcccgcgattatgggcgatcaaccagattcaccgtgattagtcccatccctaatagttggcttgatgaattggtgttgtttaggtggttggttgggtctgttgcaacgtggtgtagcgttggacaatgatgattaatattgcttaatttacctcaacagctttactgcttttaaatgcctgctttatgcaaatgaacctttagcctcctttggatacatcttgcatcatacctcctcttccggtatgatttactgagtacagtgggtagtactcggtctctctcttccccacaccagagctggagttttctcagctggagctttctcgaagaagtcgacttcgtcgctgccgtcaaggatgcccgtggagtggagtcgtcacgccgccgagtcaaggatccatgcgagaggcagcaattaataaggtgcaattaataggggcaaattagtctttaatgttaaaatggtaaaactttaccatacatctgaacaccaacttgtaaaattccaatatcaaatcttttgccaccaaaacttttgcaaaaaaaaaaaaataccggagcaaatttatctaaacatggccttgttcatttcatcgttcttcgttagttgtcatatacaaatatccataaatgacacagcagttattgtactgaggtaacctaagaaaaacaagattgctcttcggttgggttaatcttaatttcagggtgtgtttagtttacgaaaagaaaatttttagatgtcacatcagacgtttgaccggatatcggaaggagtttttggacatgaatgaaaaaacgaatttcatcctggaaaccaagagatgaatttattaagcctaattaatccgccattagcatttataggttactataaaatttttggctaatcatggcctaattaggctcaaaagattcgtctcgtgatttccaagcaaactgtataattagttttttaaatttatatttaatgttttatgcatgtgttaaagattcgatgcgaacttttttggaaaaaaacttttaggaactaaacacggccattaatagagagcgtttgtttggtttcggtggactggaatttgattgcgggcagcccaacgaaaaattgataccatcgaggtcaggcccatgggttaacccttccccggagcttggagcaccgtcgccatcgctcgcgtcctgcccgccgacgccgccaccgccgctcgccggagtccccccgcgctagattgggccgaccaatcggctccaccgtcctgtgccctctgcagcagcctccgcctgatctggtaatctctcgcctctgttcttggattgctgctgcttcttgcgtcatgcgcgattcatcccctccccctcactccaatcccacactaatctgcgtctgagcttggaatccggtgagtcccatatcttcaacccctcgctggattctagtggtggagctggatatatctcaatcgataaaccctagtattaacttgctttattcctcattttgtaataaataaataaataaataaacaaataatcttgactcatcctaatccagagttatttttgtgtaaaaatgctagtggtctccattcactgcatcgccattgatgggtagaagggggtaagaaaggcaggtcagtggtgggtcacaaccagaggcctaaacccggttccaatttggagggggtacaaacgcgcaagcggcggaagcaagatgatccaagtaagaatgaattactagctagttaactcgcattccctcaaccttaatttcctctacatgacagcgattgttgattgatttcatagtagtatatgatattgctgatgcgagttatatgcgataatgctcaacaaattcagaagataatgatggaagctttcattcagcagcagctaatgagagtgatgagagtggacctgttcaaggaaagggtgcgaggagtcgtgtccctattgggccaaatcatcaggctaagttaccagattgtacatttggcaagaaagacggaaatgttgctgaggactctgctgatagtctctcatgtctttatctcggtagtgataggactgaaaacatcagcaacaatcaggctcctgtgcggtaagtccaacattattgttcaatttcctgtcctttctagtatcctttgatatctcatacagtgtaatgtgcagcagctctgttcttcatccaaccgatagtatgccaactgatgccatgccactgctgttgactccaacattggggcctcccattgatgctcctcagccagaaacgacagcggtcgttcatgagtccgctggagaggcatcgaccacgtcatttgactggtcgaagttaacagagatggggtaccgggcggtggaggtgatccagacttggagcagcgaagtcaagcttcttaaaaccatattcgtggaagagaaagacaggaatgagcatcttaagaccatgctcggggaggagaaagacaagaatgagcactataagaccatgctcgcgaaggagaaagacaaggccgagcaccataagaacatgctcgaggaggagaaagacaataacaagcgccttaagaccatgctcgtggaggagaaagacaagaacaaacaccataagatcatactcgaggaggaaaaggacaagaacgagcgtcttaagaccatgctctcagaggagaaagtcaagaacgagcaccttaagagcatgctcgcggaggagaaagacaagaacgagcgtcttcagctcagacttcacggggaggaaaaagataagaatgagctcctaaagaccatgctcgcggagaagaaagacaagaatgatcgccttcaactcagttttccaaagaacgaacaccttccacttggtcttcagagagtgcataccaggttggacgaatgcatagccttgatcgacagaattactcagaaagacacggtttttctggaaatgttatagaaggtggaataaagaagaactgaaggtgtgagtcgtagatttgaagtatggcaactttgcagttgagcaagctggctgtagtgtattgtaaaaaatggtcgtgtatcgcttgatttctgctatgttgccgttcagcacaggcacagcagtcttggcagcaaccaaagcgattttttgtaggaaattaaacttgggtatcaatgtgaaaagggaagtgctgaatttttggcaactaaagtaaacaacttttagaactaaaattcttctgcgtggtcaaaatttacaccaacttacatgcttgcaccacatcaaacatacgttctgcctgagaggaccatgtactccctctgtgccacaaaaagtcgaattctggagggaagagtttgtcccaaaaaaatcgactcttgcagaaaaccaaaaacatcccacaaaaagtcgaattttagaggggggagtttgtcccacaaaatatagactcctgcgcagaaaaccaaaaacgtcgtcttggtgtacatcgatgggcccatgacctctctctcctctcctcacattcacatcactcgagccttatcccctccccgggccctggcatctcgttctcttgcgagttcgcactcctccaaaatcccgcatccagttcccctcctcactccgtccatctctcccgctcctccccgcaccttcctccctgctccatgctgctcccgcttctcccgcctctcctgcttctccgtgtccacctagttgcggccacgcggatgcggcggcggagggttacgagcaaatagatctgatgcgggaggcggatctggtagaagggttcggctctccagcggcgttcatggcagtggcggagcggtatatggctttgattcaagagacgcgagccaaggggaggaagcatgttgtcttgcagttctgatccaggaggcggcggcgaccgcgacggcgggtggaggtgactcggatgcgacagcggcttcggaggtgtgtaaggcggtggatatgatgcacaaggcggaggcgatagatggatgcggtgctgttggcggatctgatgcagatttattttcttcgttgttcttggttcttctatgttcttgcttgtgaatccagagcatttcttctttttttttcttttcaaattggagaaatgtctcttctttatgtagtataaaaatccaacttaattttgtcccttttttatgagacagatgcctcctatatgtactggagtacttattaatagtgagggtattttggtatttccactttagtccttaacttgtattgggaattatgaatcgactctttccgggacggatggagccttaatcagaggacaatcaatcctccccaagaatcaaaatatgaaggcggcaagtgttaggattagagatatgaggggtgtttttctgctaaaagtggagtaggcactaggcagcccctgcagttaaatgcccctctaaacaaatgtccccaaaatctagcacagttggtacaagaagctacaggccttcccgcaaaaaaaaaaaaaaaaaaagaagctacaggcctaccccgtacggcagaagagtcacgcactcacgctctgtttttccccatccctcaagaagatcgattcctcctccactggtcctctccccttcctccaatcctccccttatctgcgcaggatctcggaagcaggtaagtctcatcgatctctcccccctcactggattcttgatttctcttgtgatagagccggataaatctcaacccataaaccctagtagagtataaactttgttccattaactttgtttcattgattcattccctgcaagcttcgcttgtggtcctaatccggagttgtttggcgtcaaaatgctggtggtgatcttccagaccggaggagcagggcccgattcatatccatcatcggtatcgatggcgagaggcagagggggcaggacgaagggaggttcagtgggtcacagcggcaagaggggcaggcccagcgccatggcggaggagccggagggaggagcagcgcgcaagcggaggaagcaggatgacccaagtaagaacgagctcgtgttagttactactcagctttcatttcttccacattgatttgatctccacatgtatattaattaacatatatgatgttatatttctgtggaaattgttttggtatataggagtacaagatagtagcagcaaattgttgattgatttgattctagtaccttcttttatcccttaagctctatcgaaattgattggtattcagaagacagcaattgttgattgattcgatgttagtattatagaaattgattggtatgcagacgacagtaattgttaattgattcaatgttagtatacggtaatgctgatgtaagttttataagataattatgctcaccacgcagaggattctgatggaagctttcattcaccagctaatgagagtggtgacactggacctgttcaaggagagggcgtgaggagatgtcccaattgggccaaatcatcaggctaagttaccagattgtacatttggcaagaaaaagagcagtgtcgccgaggactctgctgatagtctctcatttctttatctcggtagtgattggatcgaaaacaaaagcaacaagcaggctcctgtgcggtaagtcctactttactgtcgaatttcctctccagtatcctttgatttctcatatagtataatgtgcagcaggtttggtccttgtccagccgatagtaatgccatgccgctgctgactccatcatcgggacctcccactaatcctcctcggccagaaacaacagtagttgttcatgagtccgcgggaggggccttgagctcgtcatttgactggtcaaagttggcagagatggcgcagcaggcagcagaggggatccacacttggagcagtgaagtcgagcgccttaagaccaacctcacagaggagaaaaacaagaatgagtgccttaagatcatgctcgtggacgagaaagacaacaatgagtgccttaagaccaaccttgcggaggagaaagataagaacgggctccttaagaccatgcttgcggagagaaagacaaatatgagcgccttaagaccatgctcgcggatgaggaagacaagaacaagtgccttaggccaaccttgcagaggagaaagacaagaacgagcaccttaaggccacacttgtggaggaggaggacaaaattgggcaccttaagaccatgctcacagaggagagagacaagtgtgagcgccttaagaccatgctcgctgatgagaaagacgagaacgagcgccttaagatcaaccttgcagaggaggaagacgaggatgagccacttaaaggcatgctcgtgggtgagaaagacaaaaatgagtgccttaagaccatgcgcagcagctctggtccctgcccatcctttacattgactgatgccatgccactgctgactccaacatctggacctgccgttgacactccttggccagaaatgacaacagccattcgtgactccgcaggaggggccccgaccacgccatttgactggtcgaagttaacagagatggctcaacaggcggtagaggtgatcctgacacagacgagtgaagtggagcaccttagagccacgcttgtggaggaggcgaacaaaatcggggaccttaagactatgcttgtggaggagaaagacaagaacgagcaccataagacaatgctcgaggaggagaaggacaagaacgagcgccttaacaccatgctcgtggaggagaaagaaaagaacgagcgccttcaacttagtcttcaccaagcaaacaccaagttggggcaatctatgccctatgccgatgttttgggcattttggataagtcgattgacaaagcatttcagaaacgtgacatgaaaaaatcgtcatggaaaaagttgtagataaagtatggtacgatctgtgtaattggatatgcagctgtagtattttgtcatggttgtgcatcgctagatttctgctaatctgccgttcggcacagcagtctgggcagcaaccaaagcctggattatacctagccgcgtccgatagtccaagaccgagatgaaggagaaagtaatccaggtggtcagtgctctgatactttttctggagtgttaggtccatagttcaccttgttatggatacttgtgtgctgtactatgtacagccctgtatcaggattggtggcttcgagtaactattttttgttagtaactttagaacaaaatttgttgaccgaaaattttcgttgccaaatatttttcttgagttgacagttaattgaacttggacaatcaattctccccaagaatcaaaatgataatccttctggggaatgaaaagtattttctttgagttaagctgttctaggcttcacatgaaagattctttactgattgaagattgcaattctatgtttaatccttttcttggctagccaagcttttttcttcatgcataagaagcataaaccagtatatcagaaagagtgcaatagattatacttttctcgacaagaaagtgacttgtagaacatgtaaaattggatggtcatttatgttctgggctaaagcctgaagatgattcaaactgaagattgagctcaagcctgaaaattgtacgactccaattgatagttggggttgcaattcagagttggaggaagtgtagaggaaagggatctctaaatgggataaggcttccaatattcctcaagtgaaaataggtacctccaacattgtattttacttccagtctataagctactttgatccacaatttacggaccatttttctgttttcagtttcatactggttggtgctacacgtttcttatttattacgcatcctttcctttctactgttctttagtcaaatggtatttagcagtgctttttactgctctttgtttcttttcgttttattctgcaaacttgccattgtgttgtcttatgcctgttaagtgtcagcccctttctttaattttatctataaacatgacttcaaatttgtttctgtgattatttgcaaaaaaaaaaaaaattctgtgaaagtcttgagaaggataaacatttcccttgcaaaggaatttccattgtaattgtgtatttcacaaacagtgagggttaaatgttgtatccacattttctttctgggcctctgtaagcagttgtctatgctactgtctttgccttaagatcatattttatattttccaatgttcttaactttcgttgtataaccaattaatttactcctgacactcatcgatggataaactacaaaacctctgcatgtttaatcatgggaaaggaatgcagcaaaaggacttaaaatatgctgtggtaagtcattttgaagaaacatgaacaatctatgtgctcccttttacttttttttttagataatgagaatcaattcattgaaatgaaattacacccggcaaacgcatcaactagggatgcacacaacctgaaaatgaaaaaataattaagatatatacttttcttaacaggaattaacttctaggacttgaaaatggcagtcatcttagtagattaccaagttgaattccagaggaattcgtcatggcacggcgcacaccatcgagtgccaattcaggagatgaattaaactggccaagaattgcagcagatatgcacatcagtaacatcgccaaatgttaattacaaatttataggtcttaatcttctgcgtgcatgtcaatctctatgactgtatcttcatggatgagttcacctcgtccatcaataatcttctgaagccggcatgtaaattataactatatccagagacttatgagagcatgcatgaagcagtcctctgatttttggttttgtattcacctgactgtctgaagtgttggttaatttaccataattatcttatagataaggacagtgaaagctatagttagactgccacatcatgcatatagaccagttctctgattcatgtgcttattactgtaacgtttcttatcttgtagtttgccggattagtagttttgatgcagtcactccaattgcgatggtttgcaaaagcatagacgctacagttttgattattttgcctcaggtagaaacaagaaacatggatttaggtggacacagtcttttcttagcctgttcttgttatgttgcttcttgattggtattgatatggtccataaattttttttttgccctttgtaattatttgcggtaagcctatattgtcatcagatcactgaactcttcaaatctatcgtaatgtatatattcattcatgattcatggcatacatgcaagcgtgtgaatgaactagcttgtgtattactaatggtgcctttgttgattaggatatacttaaaattaatttatttatgttctttttctctgctaattggcaattctctttaatttgctattttctgtacaataactttttaataataggtagagatccggcatctatatccacaagtggatatatacaacccaaaagttataatcaggggtacttagaccctaagcttaacaattgaggagaaaaagaaaaagagttgctcccttcgttttatattataagtcgtttgatttttttcctcaaatttttttaagtttgattaaatttatagaaaaatacagtactctatctgtttcatattataaattgtttgacttttttcctagaagttgtttagattgatgctattttcaatcatactatttttgacaaagttgtaaaaaaatatctacatttagtttattgtcaaactttggtaaatacataagaaatcatgtcaaaattttggtaatattgccaacttggtaatgtttattttggttacaatctgaacaacctcatggtcaaacttagtttgaccaagtttatagctagaaaaatatagtagtaatttcaacacaaaacaaataaattatcaaaatatattcaatattagatttaatgaaactaatttaatattttagatgttactaattttttctacaaacttagtcaaacttaatagaaaaaaagtcaaatgacttataatataaaacggagggagtagtagactaagagcagttataatagcaagctataagccagctataaccacatatcaagaagaacagagaggagagagaagaaagcgggctacagatttatagtcggctgcaacacggactccaaaacatgtgtgtatgagaggtgggaccggatattaatggtatagtatatttttatagttaactattgtatgaatgggctattatattagctatagtcgttgttttggagccaacggttagttatactattaaacttagcaagtttaatagtatagccaactactagctccaaatcatatataaccaatgtaatagctaattcatacaatagttgcttactatactattaatacctggtcccacctgtcatatacacattacgttttggagtccgtgctacagctaggcacagatctgtagcccactgctcttctgtctcttcttttatcttttaaaaatatgtttatagctagcttatagtatgctattatacctgctcttaaggggaaaaaagttgaagaccttgctaatccttgcaacaatgatacaccacatcgctcgtttatctagaaatattgatgttagaattgtcctttctaacatcaattattgtataagtgcattttgaaagagtataaacgaaagcattgaattgggctcacttatctggggccatttgttgttgttggtagatgtgttgcttaccctggaattgttcagcacttcagctatatcttggtgcttactcatttctcttttttatggtttgtccacttattagtgtcacagttagatagctcactcaagaagactcggtataatgatagttacgtacttacacccattttttttcagactgaaacattctacatcgctatagccatgcattggactggtccaaatttaattaggcatgcatgaccacttttaattgtctcacacttgagatatttagcgaatcttcttgtgatgtgtcattatctagtcatatgaatttttaatttgcatcatataactgcaaaaatgaaaaactgtagttctttttttcgagaggctactgcaatcagctgaacaccaaggttgcaggtaaggttgcttacttgctttgcatcgctttcgttctcacagatccatcacaaaaaggtttatgtataaatagctaattaacacgttgcgtcaggaaaaaggtacacctagaataagtccactgtttgctggaactgccggatttatcataaaaaaatcacatcttttttcagctacagaaaacataaaggtggtagcctgagatactgacgatctttgcatgaccgggcagactcttatatttgtttgattgctaagtctgattgctcccttaatcagacagtaaaaaagatgttttgtaaaaaaaaaatacgttgttcagtaacctaaggtgcagccatttggtaactatgacattgacaggtaagagcaacattattgcaaatatagttggggactatacaaattatagtgctcttacacgtactgtagcaattaaaacagcatgtgaaaaaaatgttatatttctgtaagtcggttttagaaatcgacagattactcaaaaatgttactatttgagtatgctatgaaaaaaatgttactattcttttgagtaggctacaaaatccacagaaatttggcaagcaggggcacctctttccttcctgcctcttgcttcaatgatgtcaccctctaattgattgtcgtcgtgctctcaccatgcacttagggcaatagcaatgcgtccttcattattatgtccttcatttcgtttggcccgggctgccaagtagacctcaagaacttcaaaagacacaagacccacagtgcattttggccttaaactggatccataaaaatctgaagacaagaattccccatctttatcttcgttgcgtagactccaccaccgacgccatttaccgcctcgttttcttctcggttcccacggtgccgctcccctttgccacattaccgacacagctcctccccctctcccccgctccccttctccagaagcgacgctactctccctctcccactggcgacgcctctcttcctccctagctctaccgctccccctcgccatctccgcagcttgactgagctggagacgactcgacgacggacactccatgcccctcctcgccagatccgggataagagtcgccaaatctggccttggaaggtggcggtggcacgatgacagctgtccaacgccccccttcacggcaggggcagcctcgacgatggcggggcggcctcaacgaaggtggttgcagctcgacgacggtgggggtgaggggatggccgtggcttcacgttttggggcacggtctcgccaacgcgatttcgcccatctcctcacgtgtcacggggcttcgtcttgacaggttccgatgaggtacgggtgatcaaatgaagctccccgttcttcgcaggggctcgctccacaccgacgtgactaggaatcccaagctagtgaggtgaggccgaacaccacctcactatattgtgaatggccttatggtgacagagacatcatcattgaggattcttacgatgaattgtgattatccacgttatttcagttgtaaccattgggtcatttctttgcgagtaaattttaaataactataaccattctatcaaaattatcaattcactataattttctttagatatttgagaaaactaaaacaatagtatatgattttattataaagatacaactttgcgtttttgataagtttattccgacctatcatacctgcaatatgtttgctggtgttagtggggtccacatcatcatacacacaaagagggctaaaggtaccattttgtgataaaatcatttgctatttgttgtgattttgtgaaatacacataaaaaattatagcaaaataattgttttgacgaattaattatatttttatgaaaattactctttctttataggttgaaacacacaaaaataatatttcagtgagagaaatgttagttagccagctcagtcggcagcacagcacgtcaccatccagtttcccgtccgcgtcgatcaactccaaccacgtacgtacgcaaccaatatgcaagccacggagttccagctcggagagccacatgtcatcaaaccaaggaaagaatccacaattccgcatgccatgtcagcgagattgagacgcagtccggaggttggtttcaactgcaaggtctgatcttgtattctcgtttttcatgctcatgctaaacggtactacttgttattaaaaaacattgtatacatgtttttttagaaaattatattaaactatattttagccttttaaagttaatacttcattagttatatgctaataaactatctcgtttttagtgtgcaagaaataagtttacaactcatcttcccgaacaaagccttatatttactccctctgttataaaatataagtatttttggagtagtgctaagttaaactttttaaattttaactattaatagtgataaattaagaaagattaattatgcagatttgatgttactatatttattattaaacgaaatatcataatatgtaactctttttatttaaaacattttacttttatagatattgttggttaaaatagtatctcggagaccatgtcgatgtctaaaaatatttatattttaggatggagggagtatctatttccgttttatctcgctacgtcgactgatttggcgtcgcacgcgcgccgaccaaacgtactgaacctgaccacgacgacgacgacgacgacgacgtcttctgcacacgctaccggaggacgcgcctgcgccgcggctttgctttgccgaagctgccttccagcgtgcgctgctgccgactgatgatatatatctcgatctctcctgaaatatatacctgacgatgttgaacgattccaatcatttgccctgaacatttcctcatgaatattttcaccaccggcagatatattgatcggtcagtccacctgtaatctattttccacacctgaccattttctacggtaataattcggttttactttttccaatcgtctatatattatggatattatgggtaattgttatgaaactattatctcctgccagagataaatatggactcataccaaatatatggaaacgtatcctaatagaactcttcctattatgggtatatatattgagagagagggcttgagagtttggttgatgtatccacatctgagaaagcaataaagctgtgatgcctctccctatatccatgttcattgttcatctactatatgattgtgtgcatgagatcgtcgttttctactccggatcagcgagctaggccactagttattcaatacgttatcggcacgagattgctcgtacgctaatccgggtaagtgttctagtagatcaattgatttcggtactaatcagattgatctgttatctgtgtactgctcgtcgccggccaacacgaccgcccgcccgtgcgcacctgcacgccgcgctcgacgcgtggctaatggtcgccggttacgacgccgcaccggagcatgcacggcagcaggacgcatccagccgcgcgtgcccaaggcaaccagccgggcggctctaccacacgcagtacgcaaccctgcggctaggatccaggagcaaaggatcaagcagacaaacatacatgcacatgaatgttcagattggtttatgaaccaatctaatacatgcacgtatcgatctttaccaagcctataacaacatgggtgtgcaacgacgtgtcgacagtgctgggctatacacagctacaccatcacgcaactcgtcgacgccgcgtcgccgatacgctatgcggacgtgcataggcggatcggctacctttacatcggataaacgagataagtatcagtttcatctattctaatactctgcagtagcgagagtaatatgttagatcatgcctctagtcgttttattttctcgcatgaatagatgtatttgtccggcctttgcgccgactcttctcttgttatatcgccgaccacgaagtttgacaccacgcgcccaaatgcgcttaccatgcacacaagaaggtgcacatacataatccgttgaattgaacgacggattgttgtcccgaacgacgacacctaacactcggtaacacacgacaccacctagaagttgtcgtctttctagttaacatagtcgttaatctatgaatatattaacacactcgtcatcaccgatcttatggatcagcgcgcttgggacactctgtcggttgtgacttgtatgttaataatccatcatattgctatctgtatgaagtagatggtaacaaatccgagtcatcggcacctgcatgcgccgccgtcgccgtctgcacgtagcaacaccctgacgccaccgcatgacgtcttcccctatgtcaatggttgccgaatcaatccagagacattccctcgttgatccgccatctgaaacgccgactcgacggcctttcgaggccatccgtaacgcaattgacggccgccgcccgtagcgacgccgaggagcttacgcatgcctcccctcgccgccggtacgcacggcatgcctcccgcgctaccgcacgcggccgggacgagggttgaagccgccgtgagcgcccgccgccgatagccgtccgccatgccggcctgtatgccgagccgagtttcgtcgacacgtaacatggagctatgattgtcggacgccggtcatggcctgatgccaacgaatgccggtgtcggtgctactagatgttgcaccgccgctccgcctctaaccatggcaacttgccatactcgtccatctctaccgagggctcactagcaagtttgccattggttccatccatcgtctccattgaagaatggcaattggatcatacctcacccacttcttgtgggagaaggtcgtaatagcccattgggcaacatatgagatgggctggccaaattttcaagctagccagtataaggaggtgggccaagtagaaattggcctattaaaaggagtcggcacgaaccatgattttggtccgaaaacggtattttatttcaaaagtccttagtttccaaggcattatgcgaaactcggaaattatgcggaaaagtcctatggggcattagaaaaactaccgggaatatacattcgccatttatactttgaaccttcatgaattgggtttacgccaaatagagaagaattaatgatttataccttagtcccgtatttctaagtatttgctttaactatttagttagtttcttgaataaccataatcaatcctagaaacattgtttttaggcaaaagaacttccatgaacttgtgaaacctttattttaacaccccttttggaagcataatattatatggtttatttcctggcaattgtttatttggggtaattgattgttctgtgggttagtagttctgtaaattacacatacctttgaatagcagaaaatcatgttaattgctaggattgtaataaaaggtgtgtatagaaaaccattctttactattttgtactcgttttgtgcactttatttactagaagtaaaccggtagaatgttgcataaaaggacatcatgtaagtagttgcatgtagcaaatacatttgttgggcaaatgagtaatagaattattcatatatcttctctttgtctaattgtcgccacatttgtagaaggcataattatatattctccgtatagaataaatgtatacactcatcatgaagagagtatattattgacttagaaatatatattagtgcgtgactatcatagaagataaactaaaagtaatttatattaattgtttccaagtagatacaatgtcatcgaatttgcgaatatctagacgagaagtctatatgccaatatgccctgtaccaaaattatctatcaaaagactatgtacctatgcagtgtctatagttcatttgattgataatgttatggccatcttccacgtataaatgactttacaaatgaagtattgtttttatggatgtatgtaaattattttgagtcaattggtcatttgcatttgaagcaattttggcctagatgcaacatgtttagttgttagaattgatacacaagaagttgtattactgtcaacatgtgcatttgcacgcacatatatgacttatactattaatatgttcatgaaaaacgtgcatactcaaaatttgtggaaggaaaggaatttggtgtatttgaatttgatgttcaactcagggggagacgaatagtaatgacagtaatcttgcattcgttcttttcaggtcgtattttacaatacatgagttacattatagtttagattaagttcaatatgaagaacatggttaagctcatgtagagcttctttatcttttgctttaggcatagaagcttctgcattagataactgaatatttttttatataggtcatctcacattacctatattgcttttttttacctgtagtaattagttaaccttttgtggaataaaattgtgaattatatgtctaacattgaatgtaaatatttgtcttgcctattatttgaagtatttttggcggatgtattcttattatccactaagcctcaatcaaccatgtaggttagtagttctaagtgcattgacgccatattggcatacatgtaaagttgtttacttatgcacatgaacaattagaatatttatgtttaagcattgaagcttaaatatatccacctgcaaccacattatttcttttagaaaagttgtaccatgaagttacaacaaatatgtgggtttcacgacaactattttgtaaattttcttatgattggcgtgaaaaggggaggaatatgtgtattttgcaaattaatttcagaatatttgcaataaagaagcataagaaattctggatatgtggcaggcaaattggtgtgttataggtcaaatgctagaagcaaaaatagcccaaactattagcgaatcttatttgcgataattataaatgattgtcacacaacgaagtgtgttatttattggccattgaaaattgcatattcatcaaggaagtatgaaattgcatgtagctatttaaaagctattggtttacttgtagtaaacaatatcctaaataattaatgaccttttggattcaaatgattctgaatgatcaaatgacaccacatttactttggcataatgaataaaagttagacatgtcacctaattaatttattggcatattcaagaagaataaatattctcgtagaataatgtttgggtgatttgaaaagttccatgatggttaaactatgttcatagattaatgttttattgttatagttatgttcttgaagacatcatgaagttatataatactaacacatccatcttgtgatcatatctatgttgcataaatataaacacgaagtttattgatccaacttaattcaagaattgaatataatatgagtaattggatcaagtcttgggcaaataaaaagggctagaaaatagagtaattttgtcgactagtggatatttgtttgggcgtcattgtcgcagaataataaccctctatgaattgggataacctacagtattagggatgtgcaatttttcatgccattgcattaatttttatgttagctcactacatataatgtctttaccccctttattttgtataagtgcgtgttcaatcaatgaacatttccctcgtatatcaccaccatagcatacatatatgggcctccacatgaagttggggatacaaatggaccgaattccattaatccagtgcctatgataggggatttttgtgatatgctattagataaagatcgaatatcagcatcagggggagaaaagcccatgtgttaaagatgccttatattttcaagaagaaaaaagatctttacaagtaagaataacgcacaagccaaactaaactagaaggtttagtttattctcctgtaagccagaagcgggagcttgccagataattatgaattaaaggagtaattagaagttatgtttacttgtagtaaactttctgctaacagtggtataccccgggttttgaatagtatatccacaaatgcagagtgacatgttagtcaatgttctaaaatctacggggacgcctgcggattctaagatctaacaactattgtcaatgtacccattaataactccttacaactcctgtagagtaatcaccatgaaggtgaattgcctcatgaagaggttcataatgaagatgaaaacccagaattaaagtgcgcacatctatctaattctgggatgcggaacaaccatacatcatatgtttgggaaatgactaagatatggtttataatgaattaacctcacggaatgagtatgtggagaaaagaatagttgtcgacaacatcgcctctatgattgctaatatttttgtaatgagaatccggatccggaaccaaagtccatggcagatttgcatagtagcactcatatcgggtctattgaagaaagcaatgaggttgaaccatagtcgctaaataagtctatgtgaacatagaagttcagacttaataggaaatgaagtggtgaaaagcgacggttcatttggtcatggaaaagactgatattctcctactataaatgtattaaattctgttatatatatcactggcaaaaggcatgaatggataaatgatatgcagtttatgggttatgaaaatccatatgaagttttcactagaaagaaaacaatttcgcaacatatatataaatctcatactaattagtgtcatgaagcacactatattctcatgaagagaattgcaagactcgtagaagagtttatgatgactcacgaagagtttttctcctagaagtgagaatatttctcatagcagaaaaaatgacttccggaagaataagtcgatccctataggactacgctaatgtatgaattaccggttaatctctatataacaccgataactcgtactcccatgaagtggacaaacccgttcaaacgaatgaattggaaaatcacatccactagcatgcaagtgggtcggtagttttctacatactatgaaggtgtaagaatttatatatcatgaagatatacttattgatggtatttggcaatcttattaattcccctaatgccaaaatatagaccggtttagtcactctaagtggtttaagctaattgttgaagattagtgagacaatcaaattggtaatgattgataaatccactaagagaaagttgcataatatttaacctcttgtattgagctaattattttatacataccgcatatgtgtatcgttgcaacttattttcccatagtcctccgtaaggataaaactttgtttgtattgcacatttgaataagtggttatacatattgctcctatacgttgatttatttctcatgttcatagtagaacttatgaaataagtaaacgaaagattaaacattgtggtaattttattatcattattttacacattaataaaaatatggttatgacattggaacatagaagtttcaatggatgtctaattgagggggagcatatatgctaaacattgattatcatacttaagacttggcagtcttatatttgttttaccaagaattaatcaaattaatcattgttttgataatttaccttgaaggttactaccgctatattgttgtgttaatctaagttgattaatataataaagcatatagatcattagctatttatgaagaatagtcgatcttaaagattatgcgatcaagaagatcgtgtgttgtactctttttcccttagtgagtttttacttgaatatttctcacgcaaggtttttaacgaggcagcaagtgtaatataactagcgtgtacgatgtactcttttctcctatccttttctcctactgggtttttggatggagtttttaatgagacatgtgtatagcatggtattcacccaagggggagtgttatgaaactattatctcctgctagagataaatatgggctcataccaaatatatggaaacgtatcctaataggactcttcctattatgggtatatatattgagagagagggcttgagaggttggttgatgtatccacatctgagaaagcaataaagctgtgatgcctctccctatatccgtgttcattgttcatctactatatgattgtgtgcatgagatcgtcgtcttctactccggatcagcgagctaggccactacttattcaatagttataagtggctatgccagcctgcagatatcgcaagagaaagtttgactatgcataactggttgctagcttcaaaaattaacatgacatttatagttaatttaatagtttactcacatatataatagctataaatatatactacattattaatatctaacccaccgagccctaggactgatgaggacatcctccactattacccgctggcaaagacgcaaaaggcgggcggtgacagtgtgagcctctgaataatcccaccttgcttagcttgggaggaggaagccaccttaaaagggagagccacccttcccctattggactagtcttttagggagattgggcattttcccgagtgggtgtgtctatgaactgttggggtccgggcaaccttaagttattggacctcagccaaccccacttgggccggattgttatcaaggacgatggcggtgtcttcgacgttgcgatcttcctagagacgtcgtttccgaacaataatttccaaccaatctcttgtgcagacttttgtcctctccaatctcttgtgcagacttttgtcctcttgcggtggtgcttctgactgccacaagatgaccatgttgacgtctgcgtgtgtgggagaatggatccatcttctctctcgccctttccctctccaacccaaagacatggatgaagtcgagtgtagttgggatctgtttgttcttgggggttctttttgtctaggcgtgtggtgtggctgttttttttttcatttgtaggggttctttttaccgtagacgtgtgtgtggttgtttttttttctttcctgattatagcctcataaagctatatatggtctttttttcaactaatcaatataaaaccgcgcactatcttgtgtggttcgttttttaaaaaaagaacatctggactaccaaacgtgtatagtctcttagcgccgcttactaattttgttgcacttagctcttatgtttgtgatatatatgacgggttttgatctgatgagagtatgttgttttggtatcaacgtgtttgtgccaacgggataagcccagtgaaaaagtgtactaatctacgcaaagtagatgaccctttttttacaatgctttagctacgcaaagtactcaatctaatataaattacttattgtccgaaaggaaagaaaacttaatgaacttgtcaaatagtagtataatttactatcgtatttcatattataagttgttttaactttttttaagtaaaacttctttatatttgaccaatcttataaaacaagcaacaaacatatagtaactttttcaacataaaacaaatatattattaaaatatattaaacttaattagatttaatgaaattaatttagtgttttaagtgttgctagttttttcaaacttaattaaacttaacaaattttaactaaaggtgacttataatatgaaaattgaggaagtatttagttttaaacacaactttcgtgagctaactgtaaagtgtgtatactttacgtcgctctcatacaatgcatttatctaggtcttagtagtagacatttgaatttttgtagaacctgttggagtcatttaatgatttgtacattaaacaacggtgtctcagatagctaggcaaaattgtcgtgcaaccatgcatagttgagaacttatgttaaatatacttctaaaataattttatgatagttttatatttaaatcaaacatcggtgttgcaaacctatgtaaacggtgataagggatatataatgctatctagcatttcataagttggaacataacttatataattataaaaagaggtaaatgtgtttagggagtaaactaagtaattaagccattgtaggagggtaaagaaagaaaaagaaccttatcttaatttgtgtgtatgcacaattctaattctagtatcggatgggataagtatacaataaaaaatatttgttactgatgtggataatattttattgccagtagctagaatgtgtcctattgaactttaatttctcttatgactgaaaaacattgtatttttcttgcttggcaagccttagctaacaaaattaattaattaattagctagctagtcaaccagagcacgatcttctctctcggaagagagaaatagtactccctccatattttaatgtatgacgccgttaatttttttgataaatatttgacctttcgtcttatataaaaaaattatgtaattataatttattttattgtgacttgatttatcatcgaatgttctttaagcatgacataagtatttttatatttacataaaaattttgaataagacgagtggtcaaacgttggttaaaaagtcaacggcgttatactgtatacggagggagtattaattaaccatccaacctcgatcagtcggcagctggtcaacatgccaagatccagcttccccggccgcgcgcggtcaattcaactcccaagtcccaaccacgcgcgcaaattcccaagtcccaaagctacaattaacgaactctcatcatcatcggaaaacgccacgtacgcatgcatattcgtcatccaagacggtcacaaccactgatatgcaacattgcaacgacgacgacgacttctgcagatcacacaacgtactgtatatgctttgctcgtcgtcctgtgagcggccggcggccggccaagctcgccggcgccgctgctttcttgaattgccgtatagctgagatgttttgccgactgatggcttatgtgtctccaagtcgagtactattagcagctgccggttgtttttgaacggttctaactcttcgccctgaaggatttggcaccggcagatgtacagtttttctctttatttcacacctgaacagtcatgtgtatttttacacgcacatgcgtgtgtgtgtgttttatgatcaggttttaccctttccaacgtcaacgtccatttagagatgttatggtcctcgttctctccgtgatgaattctctcattagagactagctaagatggttgcaattgcttctccataacgaatcaaatgaagggagagaagtgtcccaatcgggtctctggcgggagcagggatggccctccatcccctatcccaattctttgcagagacgacccaattagggtcaaaatccaatgcaaagttttacattcgtaaagattcaaaccgagccatgatcagtataacggatgaatgataaccttgtgtctcttgccatatggattaattagtgggtatataataatttattaatatataaagtgtggatgatatgtgtatatattaaagatattgatatttgagatataaatgatgttttaaatgaggacgtgggcctagtgaacatttttaattccccgtgctggtcgggaggtaaaaatgttccacgttgcagttggcaagatggggaccagaaaatttctagcccataaagattgggatttggatatattttctcgtgtaaaattccccgctgccatccctacaccattcacgctagctatatatgcgtgtgggtaattgcagttaaacctttgggttggcatcaaaattggatattagaattaacgcgatgctctattttttttaagtcaaacatggagaaatcaggttggtgtttatatgacaaaattcataaatatttttttaggggagcatatatataaatattgtgtttgaatcaaacttatatggttaataagttgcaatggcttaatagatttaattaattgaaggataatcgaaccgtgcctcctctgtttccatcttttttttttcatttcaatatagaaaaaatatatttaccacatactatcacaaatttttttgacataactataaaaagatatttttgacaaaaatatcacaacattacatatttaaagtcattctatcataaaacaatatagttaatgttaaacttatcacaaaacaacatatttaatgaacggtattgcaaaaatatatatttattttattatcaaggtgatgcagaggatggaacctccacaatacttagttttgcgataaacctaatattgtgacttaaattcagtgtttaaatatataaatttgagatatagcagcttaaattcataagtttttattctacaattatgtggtttaacaatgcaaagaccgacattgtccaagatatgcataccaagttgtgtacgatataccatcccctctccttacatataaaaataccatgcatttactccataatttccacaacttgcacaaaccaaatttaaaatcaccaactgacaagaaaaattcaacagtgtgtacttgccagacagaaggaaaaaaacccacaccttttcgcagactcacagaaaaaaaaaagggaattaattgcatgtgacaaatacgcaaagcaaagcgtaaagtgacaggtagtagtaattcgatggtttccatcaccgtcctcacacacaaatttcaaaaaaaaaaaagataaaaagggatatatcctttgaccggtcaaacctcgcgacttcttcttccacctctcgctccgggcaactatatatatgccctaccgcgcgcgaacgccacaaatagcaaccaagaaaccaaactaaccctacccttgctgcgctgcccatttccgtcgccgctgtcgttgatatctccggcgatgctctgcggcgtcgagatcctctgctccgtcgtcgccgtcgtcgcgcgcgtgctcggcagggcgctcatgacaatctgctcgcccaagttctccaccgccgggctcatcggctcgccgacgacggcgtggggcggcggcggagccaagaagaaggtgcacatggagagcgagaagcagcagctgccgccgccgccgtcgccgccggcgctggtgctcccggcgttcaagaggaattgcaccgaccaggagcagagggcgccggcgacgtcgacaaaggcggcgagggggaggccgccgaggctggtcattccggctgcggcgccggtggcggtggcgcgcggcggcgtggacccgttcggcgggagggagacggacgtggcgacggagacggaggtgaagggggaggggttctgcctggcgagcaggagaggggtcaggcatgcaatggaggatggatatggggtgatcactcgtcacaagattgaaggaggctcccaattggtaaatttatgtctaattaatttgctcaaaaaattaggatcaaactaatttgaatgttggaaattttggggggcgattataaaatgaattaagagacaaagaggtatgaagatagatcaaggtggtatgaatgatagtagataatatggataaacataatttcttcagatatatggtgcttctatgatcccaacaaagctaagttgcacaaatctccaagcgtttttgttctggtgtattacaaatcaagcaattagcgtggctatacaacagttttacttattgaaatgcttaaaatagaacagaaatttgtatggattatttgccgtcttctgatcttcctaaaaggataattcaaggtccataaactaacgaaggattagtactcttcacagagacaaaatacactagtataactattttgaatcaacacacttttattatatatagtgattccataatctaatcaaaaccaaaattgcacaaacctagctaaaacaaatatttttcagggctcgatctggtcctgacaaaatagaatttcaagcttgtaaaggcaaaagggtaactatttggggggaaagagtatatgtttggcatgcttacaaaatttgaagtaactacaattcttaaaaacactatcaaaatttttgtagaccatgtgtttattatcttgcctaaattaaggagaatttgtagtctgtaaactaatgtaataattgttcctaactgttttgaatcaacacacttcaaggcttcaagctatatcaaagtgatcaacaatgatttaggcactctccgtagtacaatactacaatatattagtaaccctgttctttcttacatggcgtattgtcagcatcaggctcttccattaatatgtagtgatttcatgatctgatcaaaaccaaatgccacaaattaacctaaaaccgagattgttattgaatattttctagggctcatgatattgacaaagatatcatttcaagcttgtaactaggcaccatgataatattatttatagaaatataacgctaatacttaattcttatttatatctatttaaatcagtgcacttgaatattttccagagctctgtctctgtgcattgaaaatcaactataaaagatataacatgcatggctttctattactcataagcaattctacttgttgcagcaaatttatatgaagtacatatatacacattcaaaatattttgtataacttcccttgataaggacattcatattctaacctaaatactaagacctacaatttgccataaacaacaacaatatatatatatatatatatatatatatataagacagatagaggaaaacttgtgggctcacaaaaaaatgggatagcatgggcaacacgttcatcgacccacatgcaacgcacgctgattccagacaagaatcttttttttttaataaaacgacgcattttaccaggtctccattttgcttagccacgaaacttccaaaagtgcatcatttgtttcaagaagcatatatacacaataacgcataacgtgttgatcaaaccttcaagcagcaacaacttggttcgagacgttcacattattaattagtttcaatatttttcgtcagtacacaattaagagtaataatgagcatcggttaagtaatcaaaatacagcagtactacacacgcagagccacagccactaattgagactctcatgatctgtacgtctgattttgcaggcgttctacggtgtgtacgacgggcatggcggccgggccgccgtggacttcgtcgccgacaagctcggcaagaatgtcgtcaccgccgccgccgcggcgacgacgatgagccgacatcaagcagctggctcatcatcgccgtcgcagcaacgtcgagaagaagaggacgatgtcacggcggcgatcagggctgcgtacctgaccacggacagcgagttcctgagccaggtatattagtcaactacagttactgttccgtacgttgtaagtcattattttagttttgtgataaaccaaactataaaaaagaatcatcatcatctatagtaacatatatcaagatataaatgatagtggattatatttgataaaattaatttgacctgttgtatatgttagttgcttataaaagatcttttataaataaacttgataaagttaagtttaacttttgataaatgtaaaatggcttactgtgtagggaacagaacggagcgactgaatgacgtctagctgcttgattgcataatgtgcacatgcatgcatgtcaacactatattaatcttaattagaaattaacatgcaactgtacctgtaccaataatatacgcgatgcaacagcgacatacaactgcgctgctgctgctgccgctattgttgattaattagttggcgatttattaatcggcttgactaggtcttgcatgaattagcagatgaactttgaacggttcaaaacctgctatcatttttagctgtctgtttgtgaggcaggtttgatgccgatggtgttgatggccacgttacgcatgccctcacgtactgcaacttttaattttatccgtaatccggtccagattaattgagttccgttgccgtgttgcttctggtgtggccgacatcgaccgatagctatatcttgttttatgaacgacgatagctatatcttgtgattatcaagggagggactacctatatagtattagacagttttttaaaaaatagttttaaataataattatattgtgtaattatattatagctatataactttgtgtattatatgcatatatatagttgacatgctaaaattaaaagtattttatttcggtactagtacaactaaaagcacatatatattaattagtacaaaagaaatgtgcaactaacgtacttcgttttgatgatattaattaattattaattagctaatgttgatgtacattattgcttgttgtgtagggtgtacgcggcggcgcgtgcgcggcgacggcgctggtgaaggacggtgagctctacgtgtccaacgtcggcgactgccgcgccgtcctcggcagccgcggcggcgtggccaccgccctcacctccgaccatacccccggccgcgaggacgagcgcctccgcatcgagagcacggtacacaactatatatcatgcatggttcttgcaagattttcaatggcttccgtccgccatgatcgcgcgtgagctcgatttaggttttatttagggagcttctaactactgcagtttctcctaaaattaaaagctcccaaacagtccatcttttagtacagattctaagaaactctagttgtagaatctagaaaatgaactagaaggcagaagccgagaaaccaagcttttcccaattctgataagctaactactagccaactatttcttagaattttaagaattttaagctcccaaacaagcacttagtcgtcgctgttgccgatcaattaatgtatgtgcgatgcatttcagggcgggtacgtgagctgcggcggcagcggggtgtggcgcgtgcaggacagcctcgccgtgtcgcgcgcgttcggcgacgccggcgtgaagcagtgggtgacgtgcgagccggagacggcgcgcgtcagcctcgccgccgacggcgactgccgcttcctcgtcctcgcctccgacggcctctggtgcaaggtgtccaaccaggaggcggtcgacgccgtcgccgccgccgccgccgccgccgccggcgtggccggcagcacggacccgtgcaaggagctggccgccatggcgaggagcagagggagccgggatgacatcaccgtcatggtcgtcgacctgcaaccattcttgccggtatagagccggcaaacgtgcataccgtacgaaacaattttgatgtgatttttgttttagaagttatactacgaaaagatatatatccgattttgtctttctttttttttctcacttcagttgcacttagaagttgtaacttgtacatgtgtttgtaacttgtaagtggtttttgaagtgagcttgctaggtagatgcataagagattatacaagagtgactgtaatttctttcttacttatataaagggggcttacgcatgcacaccatcacaaaatgttcatgattgtgtttattttaatttaacattgcccaaaagacagaggctgataataaatatgtaaaacctcattaaattcgaaaacacactcatgtatgtgtagtggtggatataacgctactcaggtactcactgatctggctgctaaaaagctacttcctccgtttcatattataaaactttttagcattgcccacatttatatatgttaatgaatctatacacatatatagctcattaactattttttctataccaacatggctattttattgtataaatagtttttgcaacttacaagcttattgaattactggaatttagggaaaatataataaaaccatttattttagataatatgataaaccccaaccagctctatctccaacatggtgtatatgggccaaaatattttttagataatagataaaatccagcatttgctatcgccacttattacatatgtatggtttagaaactgtgcataatagtatctaacaaaagataaagagaagacacgttataaagccacaaaagaaaggaagaaatacaatttatttaaagagcaattatattagtaaatctccaattaaaattgatgaaaatttatataaccgtcgatcgtctctaagttccggcatacaacattaataaaatctgtatcctatatatacatttgtactggggcccaaaacaaaatatagttaaacaattcataaatgcattcaagcaccagtacatcctcatctgttgagcccaactgagaaaatccactcttagaggtcgaattttttttttatgaatgtgcaagagatttgcctgagaattcaattgtgggccgcaggatttttacctgaacccttttcaataaactacataaataaagtatataatacatgaacaattctattaattgaaaaaaagtgagaatagaaatcataaccaaattactcaaataaaaataatatcaagagggtgaatcctggagtatggaagataattaccctcatagtttagccttttataagcataagagaaaatttaaatttaaaaacataattttagagttgatttgaagttttttttgtcacggtttattttctagcatttgcttttaaatcgttgcacttgtataaaaattttaccataaattatttttttaattattaataagtagttttgatgggttggactggaaagtggagaagcaggttgctcaaggcaggggaataagtataatgttgtctgagaagttgagagtggagtttgcagggtaaactagttataggttcgtgcaatgcaacagtttgttaattctgtttagtgaaaggacttgaacagggtgggggttgattggttttttaaactatggtcgttttctagatatcagtttttatgagaggaaagcggtttttagaaggttttaagtaatagggatttaatcgttaataagccgtttggatggattggactggacaagtggaggagcatgtcgttcgaagcaggggagtggagagctgacagtacccacgagcagcagcacgctggaaggggaaaaaaaggagaaagagaagcagcacataggccatggccagcagcagcacctggagtggggggttgagggttcaagatttccagtattgcggttaaggatgtgattcaaactcgacgtcgtcgatataagagatctaaagacaatttattctgaaattatatgaccaaattaaagtggaccaccctaaaaaaataaggtggaccaaatcattttcccagcctgttagtcgcctcagtccatttccactaattgaaatcggaataagttcaccgcccgtccctcaaccacaaaattagaaatctctacccctaaattatacaaaaccgttcactcaaagtccctaggcagtatatatgggtggttttgctgacgtgacatcctaatcagaaaaataattaaaattaatatgtggggccacatgtaaatgagaggaaatggtgcgtgcccacatttatcccttcttttctctcttttcctctcctgattctctcgacggcgccacggcggcgggagaggagaaatggcggccggcgcgacggcgagcttggcggcagagaggagcagcgcgtggcgcaccggcgggggagaggagcggc

SEQ ID NO: 5263 - DNA, 15463 bp, Oryza sativa
cgaccgcctcctctcatcctcgtgcagcaccttctccatgtccagcgcctcggccgcggcgccagcatcgtcgtcgtcaggcgtcgggatgaacggcggaagaaggcgtgccgcttcacgccgtgggcgcagagccgcctgcccgggtccttctccaggaggaggccgatgaggtcgcgcagcggcgtcggcttgccgctctcccgccggctccgtctccggaacggcgtgcgcccgtacaacatctcgtacagcaccacgccgaggccccaccagtcgacggcgtagtcgtgcctgctcccagccacgatctccggcaccacgtagtcctctgtccccacgaacgagttcgacttcgccgccgacgagcagcacgtggacgacgaggaggacgaggccatcctggacgcggacccgccgtcgcgctcgcccgccgcccgcccatcgcccatggccgcctgcccatcgcgctcactcgaagaagaagaagagaaagagaagagaagaaaagaaaagaaaaaacgatgtgtaactgatatgtgggtcccacgtactttttttaatttttttttgctgaataggatgccacgtcagcgaaaccacccacatatactgccatgagaccttctttgaacggtttgtgtgagtttagggtatacattttttgttttgtggtttagggacctcaaaaaatctcgctgttaagttgagggtcctcgggtgaacttattccattgaaatctgatccaattggaaaatccaaaccattcggcccatttagcccaaaccaagactactactgtcatctacggccaagtggatgtacactgtactgttcatattgccctaccaaataattattgactaatctaaaccaatccaaaagggcaggagaaaaaaaaatgtcagcatcttgctaagagagaatcttctatagtttgtgcttggaatatcccctacctgccacatctgttccctcgctcatgtctcctccaaagccttttgattagatatccattatgaaattcgagcatttctagttgctatcatcactaatgataaggtcaccgataattaatttcctttgatgaaactggttccagatgctctcaatttctcctttaatgaaaagaaaaactacatgtcgctgtcccaaatgttctatggattggattcttccatgtcgtacctattgtgatgactttgacctaatctaatcataaacccgtcctattagagccacaaaaatgtgaaaataaaatgtttttatcagtatcataatttccaattaggtcgtcacatatattttcaccgtagaagttcagctagcttagtccaacaaagcaaagaaaacaaaggtggcgtgcatttgtaaactaccacggagataactacttccccattagtaaacgacacgctaattaaattaattaattaattaatgcgctctttacctaactttttggatttgtttaccaagctaatctatcttaaattcttaaatcacctgtactaaatttctccagaaaaatatcactaagctacaaagacacagccctttggagttgtttactaagttaatctcatcttaaattcttggttgtgttcgttattccagattgggaacttatccctttccatgacaaacataatgactcgttagaacataagtattaagtatgaaaagtttgaaaagcaactttattgtagaaaatttgttaaaaaaagtatagttttgttgttcgaaaaacgtgtgcgtggaaaacgaagattaaaggttgataaaaggcctatttagatctcggcaaaacttttcaccttgtcacatagaatatttggatacatgtatagagtattaaatataggaaaaaaaattaattacacagattgcgtgtaaattacgagacgaatcttttaaacctaattgctccatgatttgacaacgtagtgtctcgctgtttacagatggattctataatttgttttattattagtctacatttaatactttaaatgtgtgtccgtatatctgatttgacacgctaaaactttttgccacttaatctaatcacagctaaagatgagaaacgaactcagctaatcactcatactaaatttctctctcaaaataaatcgctaagctatacaaagagacaagaacccttctaagcaaagcagccagctaggaggaggagaaaacccaatcaaaatcaacccacgagctcttcctcccacctccatggccgccacccaccccctcctcctcctcctcctcgccgccgccgccgtcgtcgtcctcgtcgtagcggcgacaccggcggcggcgagcggcaacgggacgtcgacgccgacggcgtacgagatgctggagaggtacgacttcccgcgggggatcctgccggtgggggtggaggggtacgagctccgggaggacgggagcttcgaggtgtacttcccgcgggactgcgagttcatgctggcgaggacgtggctggtccggtacggcgcccgcatcgccggcgccgccgcctccggccggctcacgtcgctccagggcgtctacgtcaaggtgctcttcgtctggctccccgtcggcgaggtcgaccgctccggcgacactctcagcttctacatcggccccgtctccacctccttccccctctccgacttcgcccacagcccgcactgccgcggttacgaccacctccccgccgccgccgccgccgccgctgccgccttgtgattgggtagagatgggtagttcattaattaatctgggtgatttggctggggtaattacgtgtaattaatcacaggtgctcctggttgattggctattgatgcgaatggaatttacgccactatgggatttattttgagtatatcatttggtggcttctttatgaacaagtgttggatgcagatgctgtttgtttgtctggggttttttttttccttggtttttttggtagagattgatcattgggcttgtcacattcgaccatttcttccgtttgctctttggatttcatttcgattccatgccattcagataagaggtaaacaacagataagtgtactgtgattgaatggaaaatgcagtgagctcctcatctgctcaaggttatttgacggtgcggggtgaaagagctgtgattggttgagaagagatgtgattggttgagaagagaaattagatgatgcatttgaatggtcgaagatggtaattgattgagaagagaatttagacgataaagttgttatattttgaaacaaatttcaaatgggaagttgtcatagtttgtttctgttagcatccaaagctctatattctgtttttagaatttcaccaaataacacttccaaatagcaggtgtaaaacaaatttccagttttccgatgccatggcgttcagagatgagaatatgcaaggagcacctcattttcactcacaaggttattttgggtggtcaacacaagaaaactgtctttggatgattcctgattgggtacgttgtttttaacttctataatagcacaagaaatatcagttcactttagtagctgcaaataaagttgcttccattaaaagcaacaagaactagatccagttagcggctaatctcacatacaaactctaaacttcctcatttttttaagcatgtactttaaactgctaaatagtattttttttctaaacattctatatagaatatgcttaaaaatcaaataaatttatttttcaagtttataataattattattaattaattggtaatgagttttctcgttttacgtgcacgaataatctttcttcaaactcacaaaagaatgcagtctaaggatacattatatactgtactttctccacttcttctccccaactcacatttctgtactttatccacttctctccgaacacatattttccaatctgctaaatgatatatttttaaaaaaaattcataagatcgttgcttaaaaaattatattaatttattttttaagtattttatctaataatacttaattaataatataataacacattgctttattttacatattagggaggaagggttcccaaccttccaaaaaaatgtttcaaaaaaaactaagggggcagaaagagattttcacatgtttcagaaaaaaaaaagagattttcacatgttcccaatatgaaacgtagagtgataaattggtactccctccgtttcaagttataagacgttttgactttgtcaaagtcaaacttctctaagcttgactaattttatagaaaaaaagtagtaatatttttaacccaagactaatatattataaaaatttattcaattataaatttaataaaattatgttggttctacttgagttagttattcttagagtagtttgactttaatcaaagtaagacgtctcgtaaactgaaacgaagggagtaacatctacttttcccctttcctttctagggacctaccaagttattatcacaaaaaaaaaacaatgtaaaatcttgtgtatagacatggaaacgatgtattcaacaagctgtcttccgtgcacaggaatttaagctgacagaaaccaagacgccgcaaccttgctgtataaaactgcagaccactggcaggcttggtgttaacacagaatgtccgactatgctgcaccgagtaaacatatactacaagaataattagtgacagaatgtttttctttgcccaattacgctacagatattgaagattatatcaaaaacatgcatctattatttgtcaccgtacagtggacttacaagcagatctaactttgcaccgagtataaattgagtactgaatctgttcttggtatagtcttcttaataactctttcaagcgtgtgcactgctgtaaggagggtgtgctgcagattctgatagaaaatggtacacatcaccaggccttgagcacccagagtccagagaactaacccaaaaccagaaatctccaaacatttgatgacgatacgaccaacatatctgacaattggaagtgaaaaagcttatgtcaattgtcaattctatcatttgatattgcggtattgcctgcaacaaatgaagtttccaagataatctcatgacgactcatatactgaatttaggtggtgtttgggaagaagggactaaagtaccttagtactatctgatgttcttaaggcttttatagagaccacgtgaatggagatgtacagaattagaaaaaggtgacagaaaggtactatacagaaaagggaaataacaacatacaattcatttcttcactccaaagatttgagcagccggaataagccagctgcttcccttatccgtgagaactcaatgcagaaagcttgtacctcgatgaagaggtcttgaactgcaaagaatcatgcacaaaacttataaataagtaaaagatttcaataaatatagcatgcaaccaaagaaagataaatgaggctggaataaacgagttaaatggctttagatggcttaaaaactctatgaattacaaatttcagcaatcaattataccatattaacacatgttgcttctttcactaaatatagaaaagagtttaatcaaacaaaaactgaatttactttatgacgatcaatatgaacagttggcaacttggttactatcaatccacaaacaatttaacatacttgaatgattctttgtgaccactgtcacaaatccaaaaaaaaaatcctaatcatttacggttcacagaccaaacagcatatccacaatcaagatgaatactgagaaccaacttgagcaaattaaaggatcattcaagaaaaaggggcacgtctatggctagtaacagtgtaacacacaagagttttcaaagcaaagtaattccttgttttttttcaaaaaatgatgttttagacacatgcacacattaagaaaatgcaaaagttaacccccatatcatattcatgtaaaatttgtcttctctttctggtacactcttaatcttatcttagtgtttttggagacgttattgtacattaaggatagtaattagtgaaggtaaagaaatcaaaaggtttgtattatgaactttaaagtatcagtattttggatcaagaaagcagatatgtaaatgtttataatcaacataataatcaaatgataacagatcaatgactaaactgtatatatgagacaaaaaatgtatctgttccatagtccgcacacaacagtgcactcaccgtttatgatcttgtttcggatgagagactgaaggaaaacacaaactagtctcaccaacctgttctgcatgtatttatcctgcacataataaaataatcatactgaaggaacttcaagaaagtaacgcatttaacaagtgaggcagccacaaaatgcaaattacccatcacccaatgagcaaaaaaaaaaaaacaagatacagtaataaaattgtaacataaggatttttatcagagaatagagaaaccagtaggcaaacaatgctcttcccaacttagcaagcaagctactggatcaaaggacttaaccgaacaaatagaggagatggcagttgattggagcatgccattatataaagcacataaattattttgcaacaatctaaagcatgcaataagatctgccaattgcacgtacatttacttacaggcaccatcactacacaagtgcttcagttcaccaaaaaagtcagtaaaacaagtatttctacgaggaaatgctaaatctgaacttatcaaagaaacaaacaagcagaggctacatatttccatggaaaacgtagcccaggttaaatcaccaactggatcaaacagactgacataaagcattaaacaatctttgtttaaccatcagcttgaagtaagccacaaaactacagtaccctgctaacaaattctccaacaaatttaatttgaacgagcaaaataacaaacagaccttaacgttctgacatgattggatgcaattcgagatgtactcatggacaaactctgtcgggagttctacagcagtagtaagcctgtttacaacttccatagaatgcaggctcatctccatatgcacaagaacatctaagtaactgaaaaagaaaagggtcacaattaaaatatattaaaaaaaagtgttggtgatcatattgactagcaaagaaaagaaacagacatacccatcaatgtcaggagagttcatcaatttcgaaagaatttcaacagcaatgagtggattgtgttcaacaaggtcctaaaaccatgcataaattctcagatataagatatgatgaaatatggtaaaataagtaaacaacatttttagcaaccaaaaacacaacatttggcatgggtgcatacagggagcttttgtggagtcatcccgcaatgatacaccaacttcgagtcctttgccagttctattacgacttgctgtgagaagctgtgcattaattacgcttgtaccatatgaaaatatatagtaccaaaatgtatgcatgtccatggggaagggggtaatgaaaatacttgttaccataaaagcaccagcacctatgctaaacaaatatatattataaaaaagacaaaacaccaattaatagtgcttatacattcatgtttattagtgatccatagatgcaagatagctagcataaatacaagaatgtagcagagaacctcttgttgggaaggtgcaagtggaccttttaaggctcttgcaatcaaatctcgaatagcagcacctcgacttgtgtcagcacacatgctataatcccataatagctcgtgattgttgtcagggttcaaccattgtagctgtatgttcgatacaagcacagttgcacttagaaacagaacgggtacacagatgcaactcttggctggctaagacactctgttacctctccatcaagtatgtgaagtcttgggggtgtgggtcgtatccattgcggacccaatcttccccatgatttttcttggagtaaaccagcaagagcaaaatctctatcatcagaagcagattttggtttggttccaggtaatgatatgctaggcctaataaaaaaaaccaattttgtaagagaagaccaagaagaaaaatatgacgaattctagcaccacataacaatttcaggaggagttagctgagcctacatactctgacgaatttacacagctttgaggtacatctggatccggtatagcacatctaacagttcctgcactaaaactactggtctgaggctgagactgtacactattactgctgaatagcttctcaagctgttctcgtggaagtaaggcctaaacaaataaatgaacctttttattaatcaaactgatcttgaaacaattttatattatggaatcagaatttaacactctacctgagatgcagaatcagacccatttatgtaatctacagctgactgcttcagcacctgagacatacaaaccaatgccaaaataagcatacatatgtcagcacatgaaaggagcaataaaatcgccataatgtcctacaaccaatatgatttactaatgtttgtagataggccacacctcaatgttattgtttccacttgctgaagtcaacaaaagttggacaaatgcccgttccgatttttctgatgtttcatcacaggctgcctgttgatataataaaactataacttcaagcatgataaacaataacaatagaaacataagactctaacatagtaaataattctgcaaaacatatatattaaataattcttcaaatgccctagtgtacagaaaaaaaaaacagatatttaagtgttcagttctgtgttcttcatgtattgccatcatatgttacgaacaaagaaatagtatccaagttgataaaaggcaaagatccaacttccacagaaattattgaaccaagctggtgtagatgctacataaactatccaacccagctgcaagttgcaatagacatttattcaacatggtgttagtccgataagcagccgtggaggcatatcccactggtcagaaagaaatctatacaaaactatatagactagcaaatccatgatcttgacaccaaggcaaatatgctacaaaattattagggttacattttggaatactactccctcggtcccagaatataagaaagtgttagagttggacatggttattaagaaagtgggtggaattaaataggaagaggttgtgattggttgagaagtggaggtaggtgggaaaagtgagtggtggagggttgtgattggttgggaagggaatgttggtgaagaagttgttataatttgggacaaacctgagtgctaaaagctgttatattttgggacggagggagtactaccaaacatacaatgatacaaacattggcatgcacaattgaacttagtgttatgggatcaaaatcaaatgtcagatcctatgcaggtaaagcagagcaatgtaagaccctaattgacagtttccaaagtacaactgtttttgtagagctagaactagcaagccagatgcgatgtcaatttatgtagcgatcaataggagatcagaaaaagaacccagacgttaaagaaagttataggtctttcataacccttttctgtcaacaagatgtgtagaaccacgaatgaagaaaagatttggacaaaatgatactgttatgacatcaatctctagagtctaaaatgacaaccaaaaaatccagcaaaagagaaaccaggggcagcataaataattcattaggagcccagcttgcacatggcgcaggaatataaagatctatgatatatcctggccaaatggggcctgacagtcttcaaagctacaagttccgattctaaattactacaacaattcgcagttgcagaatcacctcagtaaaagcctcacaacattaacaattaaatttcattactgatcaaaaactaaaacaaaaacaataatattcttgtaatgtatgtatactagtagtctattatgcagtataacttaagggacagggatgggcaacctggctgaaggttaggcaagcacccagcatcacaaaggaaagcaaatgatagacgaacaagcttgtctgaattgacctatgtgtctactagtatttcaacacaactcaaagttaccagcatgcgtggtgttttaccagtttatatagcttcctcgcagcctatgctcatgtatttacttcttgaaaattaaagcaatcttgaaacatatcaaatgaccttgtaatttcacccattctgaattacatagagtgaagggggaattgggaacccttccatttcatgatgatccaaaatacaaaaaaatgaagaaaaaagtttattgcttacatttaataaaagtggaacatatgggtttgccggctccgaggaataactctggtgaagaatagcaaatgcaatcaaccgaccagtaggatgaagcatcttcttgtcctagtcaaaacgaaacaaaatatatcaaagtctgaacttcatttttcctgtgaaataaatttcagaactaaaagaatctttacaaaaacatgcatcctccaaatatctcttagcatggtcaagaataaacagacaaacagcataatcaagaaaagaattgcaaatgcatggtgaaataaagacaaatacacttttattgcccattacaaaggtcaaataaaaacaacaatgtgtctttggtcgagaaactggataacacactataaaggagaaggggttgcagttcttgtctaatggttaaaagcttagtgtccatcttcatcagaacataggaatgcattaacaaactcattaaatgatttctccagagaaagttccttatatggcatggaaggtttcctctgtcccctaattgttcactctaaattgttctttttcctacaatgcgagcacattcaaaaccattaccctcacattctactttcgcaagagtaatggtttaaatctacagtagtaaagaaaagaacaactttggtgtggtaaaccataaccacaaataagggatcatccgatgggcgatggcacaaaaggaactacatctttctttgataatctgcattgttttgttttcacacaaaaaatatgacttgtcatctctgttagaatccgtgcagataaatagatctctttctgacatgtgtttaaacagtgcagtttcattgataatcgagaatagagtcagctcaaatgcatgttgccagcagggataaatcgaaaacgctgaatttatctagctcctgttatgttgggaggaagagttcttccatgatatgtgtggttcagcattgcttttggaacgagaagtaaaggtactatcaggatcagactattgcatgaaatagtggaagttgagaataaggaacagatccatggtctcctctatttgtttttactcaacaccagacacttgataaatagtaattaaaaccaatcaagtaagcaatgctcacaccactgcttgttagtattcacttctgaaacagctgacaagtttgatagatcacaaagagcatgtttattaaatcgatcgaattataccaagaatgaagcaggtttatggattaaaaatgttaataatgtttctttaatcacactgattgttcacttgaaatggaaccctaattaagtgctaacctactcaagaacaaatgaaacccaaatatttggcgattcggtgacatcacaaaattgaccaactaagacaatggaccatacgcactcatacggagtgtagcatgagtccatccctacgttgtgtattgcaacccagatcctcatagacacaaaatcagcaaggcaatggagtcaaaattttcatcatctgcaaacatgaatccatccaaacctgatcaaactaacaacacaaggccataaagaaatttaaaaattctgcatctccgctctgctaaagcaaaacaatgccactaaatctagaagttgagcaacccatccgagatcaagcaattcgtaaccccaaaggttattaccaatagtacccaaatatagtgagctaagttcctccaaaaccccacaaatctgtgcctaacctaacattctctagcccaatccaaggcctaacccccagcaagtgaaaccccgaacgaagccaccaccgtaatttcacgtcgggaccaactggagcaacctcccagacatcgtaacacgcccataaccactaaatctaacttcccaccacgaaccctaagccgatggaaccaaaccgctccccgatccgtttccgcccgcgaagatcctggacgcaatctgacgaaagcaagcaaagcggtgggagggcagcaggagggagggccgagaagggcgtggggagaggggcagggggggatggggatggggatggggcgtggcccctttacctcgaggaggaacccgagcgcggcgccgacgcggaggcggcgctcgagggggaaccgcgcgaggaagtcggcggcgatgtcggcgagcgggcgggaggcggcggcgagcagcgagaggaggttggaccgctcgtccggctgcagcttcggggcgggagccagcgccgacatggtggcggtggcggtcgccggcgtcgtggcggccggcggcgaaatgttccgttcgcttttttggttttgggtttgtgttttttttccccctttgggcgagggattcgggggtgcagtggggttaggcgacttgggatgtggttcggatcggacgggtgcggctgtattcataatcgtacaggtcagctttgtttttttttccttttttattaaccatttttttaaaaaaagtttttttttaaagaaaaacggtataaatgtaggcgcccacagcgcgtgcacactcacctctataaacgcacacattgacaagttaacatggagtctcgctatcagcggtatgtcgcctaccctgaaagaaaattatccataaatacgagcactcgtgtcaaatctagaatttaaactcggataagctggttccaccacaaagaacttaacaagttgaactatgctcacttcgaacaaaaatgtagatatattgctaagccgaaaatattagtggagccttgagtactcataatttgaatttatcatagaaaatcgtaataaaatggcacttgccacttttgtctagctgagtttcatcattgtcaatggttaatatgttcattccctaaacctatggtaccaaagcattgaaaccgcacccttttttactctctctactctctctattagtggatggatgcctgacgagtagtcggggtggttccaaagttgggtaaatctcgttgtttctcctcagcccccacccccaccctcccacccccaccctcccaccacccaacctatcagagaggtgctggcatccaccatctttgtcctagtagcgactggtagttgtcgggctgttctctgacatccgacgatcgacccgtggcttcttggtgcaccaatgccatttgaagcttagggaacaacatatctgcaacaaaggtgaggcatgtggtggaggtgttgccggttgatcgatcctctctgacaagttctctacaactacgatgtttcctccatgatctttgtcatcgattcttcaatgtgtggttttgttcttctatcatggtaagattgtcgcaaccttccttcttggaggcccttgctaggtttgcatccaggctacatcaactacaaccacccttgctttctcgattgtcatcgttggttgaatcacacatgttaccagagcaaaggaagaactacctcgccttccacacaacaacaagacagaatcggtcactctcatattcttgaattctccgctttcccacttatagttggccagtgctaagctgggttggcccgagcacggccatactgtagccagcccaagcacggcacacgcattttgcccgtgtcatgcttgggccaacaactccacctatagaccggcatggcacgacatgacccaactggcccatctatttttccttacaaatttcataatgttccctatttttccatttttatcatatattactcatatttttccttatttttcctcctttttactaaattttccccatactttccctactttctccatttttttccttctatgttcttttatttcgctttttctactaatgggtcgtaatagtagtcatgcctgtctgacatggtgcgggtcctcattgcgtcgtggcctttgcctgccatcaggcccttgctgtgttgggctaggccacctgtttggcctactatactccctctcatacaatcttcttcgtgcctctggcaatggattcttaacaggtagctgaagttcaaatgtgtgccaacaacgccacaacatccacatcctagaggcccataaaggtttgtgaattggcttctcgtgctattctccggtggtgctgtcggtgtgttcatcaagttggccaaaatagagagaagtagacccgaagacctgatgtaggatcgagatgtcgactagaggggggtgaataggcgatttaaaattaaatgacacctaatcaaaactaacctaatttgctaggctcggtgagggacaagtctaactaagcaattaagttatgttttgcaatcctagggtgaaagtggctcaagtatatcactaggaaagtaaaacacttcctaagtctagtttagcaatcctagggtgataagatctctagtatatctctaggaatgtaaattgcacaaatgtaaatgcaacaagtaaatgagacaaggagacaagagatttttcaccgaggttcagaaactcgccggtttcctactccccgttgaggtgagcccaactccaccgctcaaccacgaagccaccgcacgcccccttcgtcaaggggtgggcaaggcgggagccggcccacagagaggactacccaagcctcgatcactcggggtagttcttccttcactccgaaggtggtgaactccaaaccactcacaaaccggcaccgggcctcctccataatcttctcggagaggtcaccgggcaactcctccacaagccgtctaggaggcggcaacctccaagagtaacaagcgatgacgcggctcggagatgatcaagtgccacactagctctacaatggaagcaatgcacttgactcttggctagaacaaccttgaaacacactaagtggatgaacataaagctcaagtgggtgtatgagaaatgcaaggggtgtatacaattgaattgggtgccaagagagaccccttgctgctggtgggggagtatttatactcccacccaccaaaactagccgttgaggacgaaatcccccaactcagtgctctgccggtctgaccggaggtgtgtggccggtcagactgtgctactctacaccagctagttttctagccattgtagccctgtcaatgggtcctactgccctggtcggtcagactgacatggggtggcc

SEQ ID NO: 5264 - DNA, 17105 bp, Oryza sativa
aacctcggctccggcggctcgggatcggccaccccagagcatgccatcctggccaaatggccggccggtcagaccggccaacacctgccagtcagaccgactatgaggcaatggtcagaccggccgtgaccctgcggtcagaccggctgcatcgtgtaacatcctcaaattttaaacaaaaatctgactgcatcatgctggcttttgattacttttgtgtgcttcaagattttatttgatttttaattggttcaagtgttacttccttagagccctactaatttaccctaattattccctttactctaaatcttagtgaatttgagcaaattctttcaaatttcaaactaaagattattttcttagcttaccctaatattagtgaggattttctttactccaaaccctagtgaaacccttccaaattcatagattaaattcattcttttctagggaaatattcaaaaattcctgaaaacactgttcattgtactcaaagtgttcgacaaaatgccaagcccagctagagcagcccaacctttacccaaacttgtgcaaagtccagaattgatccttagggaccacaccccactcaaaaaccgtggttttctttgcttcttcctccccttcacgcgcaccgcccaggcatccgacttagccgcacgccgtgtcgccgcgcgtcggctttgaggccgcccgcgcgtgcccgaccgccttggcgcgccgtcgcccgtccgacgccttcagaccgctgtcgccgcaccaatcttgacgacgacaaagccgggacaacctccgccgcaaggaatcgccgctcgacgtcgtgcgttcccgtccaaagccgccgccgagtgcgatttagcttctacccggggtgaatcgcgccaattcttgccgcacggttagattgaagataaacggtggtttcccctctcacaattcaaaccattcatccccgagccggccgttttcaccctcgctgccgccgcgcgtcgcgcccggattggcaccaacatgtcgacagccgatttcactcgcggtcaagtcaatctttcaccggtaagtattcgaacgtggcctcccaccactcaaatcgatcttgcccgccctctcacagcccctgccgccccagccatatccaaagatcgagctcatccatggcgatgacggtgtccgagctcatccgctcctcctagccctataaataggaccccaatcccttccttgtccatcatcaatcatcaacaatcaaagacctacaaccccgaagctctgcttcaccaatccatcccatcaaccaccatcgcccgtcggtcgaacaccttgtgcgtgatcgactccacacccctccatccatcctccgccctaaatatcccttataacaccttatatcaaccatgttctagtatactaagccctaaccgaagccctgcgccgagttttacctcgccacaccaagccgaccaccgccgcccccgcgctgctctgttcttcgccgccgagaagttttttcggccgcaattcttcatctcggcatatctcggtgagctcttacgttttaaccatctatgtactccctagattccattttagcaatccttttgcactatcataccatcctctgggctgccgacgtgagcacggccgccgccaatggaggcgcgcttgtcggcaagtattttccgcgccttgccaaaggtcggcaagctatcggaatccatccaggcactccatagatgctctagaacccctcccctagccatgtttaactcacatcacctcgatcaccatcacggcctaaccgtgccaccgccgccctagccgctaggccatccacacaacaaattaacccctccgccgccgctcgccgtcgccggagaaccctagttccctcccctcctcggccgcaacccctttccccctccatcgccgccgcaatcgtcaaccctagcgccgccggccgattttggggaacggccggaggtaggtagaagaagagaagagagagagactgacaggtgggacccacacacagtgccatttcacatttaattgattttcaaactttagaagtccatatcttttaaaacatagatccaattccactgaaacttggaccaatattcttctaaaatcattctctatctattgagcccctttttgctatttttgtattttattttattttctccatttttcttatctttggattttatttgaattccttttgaatttgaattttatgtctaaccctaggtcttgaggattcttctgactcaatagataatatcaatcaacctcaggacatcgagcaaggcaagttaccatatacctttgatcatttaagcctatattttacaaattatttatttatagccttttattctatattctattttacatgcataattcaatcatagaaacccagataatttagtattgcttactttgcttacaatctggttaaaatatcttatacttaggttgggacagtacgtaagatttggttgatttccgggtggctagtactgtctcgatcgatataagttttaccaggtacttatgtcgaacgaacgggtacgaccgcagtttctagaatgaggacagacctagttattatgttaattagcaatatggcacctctgtatagtggttcttatttttaagtcctcgcgcaggaggctactatagctgcgaagggcaacttttaaccattaccatgtacaggtaaatggtttgtgatactcgagtataaactatatggtatatttctaaaccctgatcgagatgacgtggtgtcatacgatcagttccccttaaatacctcgggaacgccagaactcctcttgctgctgttaacattacgttcagagcatatgaggatataagtttatggaacaggtgccacaattgttaataacttaatactgggccatgactaaagccgatgattattagcaagtcgtggactgcgggtaaagcgtacatctgctgcagtagaatatatttgaaactattcgaatagtcgtactcatggagttgagtaccgggactcatatggtaccctggttagaaatttaaagtctacgtatttacaaatttttgctataattcttccagattgtttattactgctttttgcaaagaaccctactatatgctaatgcataacatatttccatgataacttgctgagtattgtgaatactcattcttgctctcataacccctttttcagatttgggtcaagaggatgacccctttgactattactacgatgaccccgataatttagagagtccctaaaggttatacctccctagtcagaatgtatagaaacttccgctgtgtattaattgtgaattaattaagttaggtaagtacctattattgtaaaacccttagtattgtaaaactttaacatatgcaatgaaaaaccagttatattgtatgtatcaatatttactgatccagagattgatacattaatcgtagtcggatccaagtatttagtttcgggctccgacacatcggccggttagaccggcacttgggccgcggtcagaccggccctggtcacccagaccagtgacagcaaatgatgaacaatgaaatttagcacaagtctaaatgcaaacatgacctagtgtggaaattaaaatcatctctttgctaggtcattatccctcttaatagtacggcgaagctaaaaacaaactagcaaatttgatcgcccttcacctcgatcaatttaaaactaaatcactagttttaccgtcttcttttcttcgcttcacgccatcaattttaatccatcggttgtcatccatgcgcacacacataatgtgaacctaactcaaaatttatagcacaaagacaacggttagtccacaattagtgtttgtcattaattaccaaaattaacaacgggggcctagatgcttcacctgatttctttttaaattacttccgagcccttctatgcagtctttttactcaaagtgcaactttgcccattcttcaggggctttctctatctagctgtactcccagatagcttggacaaaacaaaattatagaggcatctactttggatttgtttaaaacggggcattgaaacataacgtatttggtcatgttttcttaggtttttctggtgctaacactacaatcaaatcaattttctgcaattcaatgtgttgttttttccccaaggtgaaaaagagtttaggggaagaaatgatgagtacattgcaaggagaaagcttacggggcaacctcataccttctcatcttggcagtgagattgctcctaaagtggggaagaatatgaagaggagggaagaaggggggggggggggttggacaacttattgatcaaaatatgattaagacaatatattaagtggcgagctaaagtcccaacgttgatgaaatgactccctaaccaacttctagaaattttaatgaaaaactgccccgtgaatagtaagagctacccaaccatttctctctcaccgcattaatttgttacctttttctgaaatataataatacaaggtgcatgtcaaagatttgtttatttgagcaattaatcttttctctttagtgaggtactccagtatataaattttgactaagcaatttcaactcatcagatgagttgcttcaagtattgctttgtggtatatgctattttccaagaaatagaatggtggataaatatgtgcttccaagcttctaaacggtattttttttagaaaaaaatttctatatatgaattgcttagaacattgttttatatccattttaaaccctttttatatttaataaattgattgtaccatcaaataattataataattataaaaacaattgagctattcagacaatcagctattcaacacaagaatggagggattcagactattgacaatcaaaactctttattataatatggaatggagggagtaaagtaattaaagaatggcttaaaatttcaatagatattttttggaggaaactttccatatcaatgatagaatacagaactctcacttgaagtttatcaaacattcacaggaatttaatttgtaaactttctacaatataatcttccatataatgaacctactatctatagaatagacttttcgtagggaattaaaaactttcataaagaaagtacaactttctctagatatatcaaaattgctaaataggcccatttacataggcatgcttgatcaaacaacaagaaacatttttttttattatgagaccgaaaactggtttagggcatgtttaaagatagacgtttcttagttatttagagattgttatcatgagacaataaatatctaacaattaatgcacaaaactaatttctattatctctttctttttccatcttgataagtatagttttcttttatgaacactaagagtccatggtaagccgctgctaagtcttgatatcgatgtttctttctttttttttctttatatttatgtcatctagcttagtatcttgttaagggtgagtttaaatataccattttctaatttctactctctcgtttttcacgcgcacacttctcgaacggtcaatggtacatttgtttataaaatttttctatagacaagtttctcaaaaaaacaaattcaagtttttaagttaatacttaattaataatactactccattttactactagcgtggatattagttttcaacccacaacaaagaacacagtccatttggctactattaatgaatctatcacaaagtattcgtagacaacagcatgcgccaattagcttttccctataagggctcctccacatcatcatgtaggcattgtaggtgtcaatttggtacttgttctgctttaaactccatcgctaaagcaaatgcaaaagactcttttccctttatcccgcacaagtgtgaagtcaagggtggctcagctcaacgctactaggaacgtgaaaggttcgttactagtactataatatggaatggagagagtaaactaattaaataatggtcgaaataaaactttctataagaatgatataatacaaaattctcacttgaagtttatcaaacgttcgcaggaatttcataaactttctacaatataatcttccatataacgaacttactagctatataatagactttttgtagggaattagaaactttcatatagaaagcaaaactttctttagataaaccaaaattgctaaataggcccacttacataggcatgcttaatcaaacaacaagaatttttttattatttaaccaaaaacttgtttagggcatgtttaaagatagacatatcttagtagttatttagagactattatcttgagactatagatatctaaaaattaatgcacaaaactaatttttaattatcattttgttttcccattttcataagcatagtttccttttataaacactaagagtccgtggtaagccgtttctcagatatcaatacataattattgatatcgatgtttctttctcttttttctgtttttatgtaatctaacttacaatctcatttttcgcttatgcttatacttacaagccaaaatttgaattttcaaccttaaatttggagttgattttggggtccttttatcgtaatttattttccaacctttacttttagatcgctaagaacacatatataaaagttgtattcacaaattattttttatttgcaaatatgccttgaataagccaaaccatggagccattagtatctttgttaagggtgagttcgaatgtaccattttctaacttatactctactttttttttacaaattttctataaaaaagtttctttacatccatattaatatgtttcaattcttttattaatactatttgattaatcatgcgttcatccaccactccattttactaactgcgtggatattagttttcgacccacaataacgaatacagtccatttggctgctattaacgaatctatcaagtatttgaagacaacagcatgcgccaattagcttttccctacaaggacgactccacatcatcatgtaggtattgtaggtgtcaatttggtaccttgttctgctttaaactccatcactaggctgccccatcactaaagcaaatgcaaaacactctcttttccctttaagagcccctttcaattaaaggatttatatagaaatttctcataggattgaaatcctatagaaaattttcctatttgaccctttgattcaaatgatagaaactttccaaatcctatgaaattcctatggaacgacacattgtatgtggattttggaggaaatttagcaagagcttcaacctcttggaaaatttcctttaagtctatatctctctcatccgattcctatgtttttcctgcgctccaatcaaacaacaattcctatgttttttctgtgttttacaatcctctgttttacacttcaattcctgtcaaaatcctatgtttttcttattcttttattttttcaaccctgcgattcaaagggaccttcaacctgcacaagtgtgaagtcgagggtgactcagctcaactctactagtaggaagtaggaatgcgaagggttcgtttcgtttccacaccaccattggtcaagtcaagctgcgcgtccaatcccacaactcactgacgcgtgggcccgggtcgtcctcactactactactgtgcagtgcagccagcactagtgctctcctgctctcctctgcttctcttctcctctcctctcctcaccgggagagtggagaccctcgagatgcccggcggtcgccgcggcggcggcgggcgtcctggctccggcagcagcagcaacggcggaggctccggtgagcacccctcccccgcgcgctcgcgccggcggcgccaccctctccgccggtaggattcagggcggtggcctcgtcgtaggcatgtgcgtgtatatgttttttttttattattcccgtagattttgtgctgtgcatggcctgctccgatccccagtttcctgggcctctttgatgagactatggtttactgcattgcattctgctccgtcagtaggaagtactacctccgtccgataataattgcatttctaccattcaaactttgtcccataaaaaatgtatttactataagatgagacccaacaaatggaatttgtaccccaactttccttttaattaatttgtagtagtagtaaacactatccggggaaaaaaagaaagtggcaaagcttttgcccttccttcagagaaaaaaatatattattattatttttttattagatatataaaatcgatcaggttagattcatcttggatctcatattttgctaggaggtatggtaagaaattttagtattttttcacactttgataaatatatcgcggtacttacttaatcattagtagcaaaccttgaggttggagactgtatgatgctaagtatgtgagttatgacttgataataagtatgctaagtagcaaacatgagaagttggttgcatgttccacagtacattttttagttgttcctttgtcgtacattgacacacataggaaaatatcatattactttatctaactgtttttgatgtagggtatagttgggttgagaagaagtcgaagaaatcggagaaatcagttggaaagggacaatgcgcaccatgtacttcttcaaatgctgcacctaaacctgctatggcgtggcaagcacggagtggcaatggatctttacaccctcctggaaatggtcgggttcaacattctgatcataggcctgctgccagaggcagtcctaggtcactgccacaaaataagcatacagaaacaaaattgcaagcaccgtgtccagttgtgactgcacctcttgcaaatggtttgcagtgggtacccaagtctcgctcatctggttctgagagcaatatggatgatgctcctacatcaggttctgaccctgaaatggacaatggtgcaacacacccagttgtgactgcaactcttgcaaatggcttgcagtgggtgcccaggtctcgctcatctgactctcaaagcaacaaggatgatgctcctacagctagttctgaccctgaaacggacaatgttgcaccacacccagttgtaagtgcacctgttgcaaatggcttgcagtgggtacccagatctcactcatctggctctgaaatggacaatggtgaggattatgattcatatgacgatgattctgatgatgatatggttgatgataccagtggtgactttgattctaaggcatctgagaaaaattttgagactcgaaaaaggcacaagctgttgaaaagcatttttgaacttctggagaagttaagtgttgaacagataaatgaaaagactaggcaatggcattgtccagcatgcaaaaatgtacgtggtggagttacctggtacaaagggttacagcctttgatgaatcatgctagaacaaagggttctaagagggttaagcttcacagagaattggctgcattactggaagaggagctgtatcgtacgggaatttcaatggcatcatctggcgagttctttggaatctggaaaggattgcgagaaaacactgatcgtcctatagtatggcccccagtggttattattatgaacactcgattggaacaagataaggatggcaaggtggtgttttctatttcttgctcgagctaaaaaatattttgcttttctatatcattttctgttgcattgtatctggaagttttttgttgtccaattgtaagtcatgttgtttatttactgactatggtgttgtattaggtcgcaatatttatttcttcgaatgttattgaattttgagtaaatttcataaaccccacctgttatggtccaagttacacaaaaccatagggattttgacacgtggcacataaccccgatggtcataaagtttcacaaaaccacactattagccattttgacatactcctatatcaaatattttaaaagtggatgtaacatttatatgatggatagaatcctcataaatttgagatatgattgtaaaactcaaaagtgttgtagatcaaaatcaaaatgatcaatagtgtggttttgtgaaactttaggaccataattcctgtggttatatgccacatgccaaaatctctatggttttgtgcaacttgtaccataataggtggggttttatgaaatttactcttgaattttagttatgggtaatgcacatggattctactaaacctaaattgtacacataactttatggctgtccactattctttctgtaatatctgatctaatcagttgtactcaatgtgtagcaaaattaaagaaataagactgatttgttttcatatggttctattgatttttttttatctattactacgtatcattaaataaaatgtaaatgcatccttcaggagcagttaagatggcaaatgtgatggtttccattacttaaatatcagatagctgtcatatgcattgcaatatcgatccatggacacggtttatctccattaccagtttattttgtttatcattcttatgttagttattattttatgtgccagcaaacatttttctttgtgttgaaggtttaaaatatttacaatattcaaataacataaaactgcaagaaaacatattgtagttattctttattatgttttgcttgcattcatactccactgcaaagaaacataaatatggctactaattaggattgtctaggcatacttggcccaaccagttgaaggtcattgtacaaaaacatccatttgatctatcttttaagctgtatgaagctaagatttacttcattctaatttatatttctcccttgacttgttccagtggaaaggtatgggaaacaaagagctccttagttatttcagtaaatatcacgtgaaggaagcatgccatgcttatggcccagatgggcacagtggcatgagtgcgctaatatttgaaggatctgccgtggcctataaggaggcagaacggttgcataatcactttgttgatcaaagaacagacaagtatgcgtggttgaatcataggatcgtcatacctggtgggaaaaggcaactgtatggtttcttagctgaaaaagaagacctggaggcgttcaatagacatcatggtataatgtttaacttcttttcatatataatgctctgaactctgtgcaattgtatgtgtttgttgtcttttgttataagcatttaaaatggaaacatgatccatacatgttcgcatgtttgaaaggtgaacattataaaatatcattttggaaccttttattgtacatgagagttggagtattgtcagaacgaaatgcatcacctgtatgactgtgtattcatctaatttcctggttttcctgacagattagctttgctgttgcatgtcaatttcaacataaattcagactatttttttttaaattttgtatgattttcaggaaaagactatttgaaatacgagatgaaatcttataacgagatggtggttacccaattgaagcagatgagtgaagacaaccaacaactgaattatgtgaagaatgagatggttaagacagagcgacattctaaagaagtagaagaagccttgggtgttgagacccagaaacttcagggagcaattgaagataatattattttgaagagaaaaaccaaggagatgctctcagagtgcgtggaacaggtattgattgcttaatagttaccctggtgtacatattttctgctaccacatgtatgatctgcaaccagaagtaacataactataaaaatctgcttggacactgcctcctaaaatcttaatacaaagatatgcatcgctcttacgtattcctgaaaaaaatctgcttggacaggcagtcttctgcaattaaaacgtttgccatagaatcccttttgctttgtctcatgttaaccttgttttgattttgtctcctttcctcaccttctatgcagatggagtttaatgcgaaattttatcatgaacaaattgaaagacttcgcaaggacaccgaggagaaagagaatgagtttgagaggttgctgcaggaggagctagcaagagctatagagtgtgatgttgactctgaaactacagaaaattgcaagctaaggtgtgaccaatacgtggttgggacttgggagcagttgaaaatttgatagtacttctgattattcttctattgatcaaatatagatatggtgtctctgtgaatggaaatgctccactccgatatatcactaatccaaaaatattttgtgcagggaggaacagatacaaagaatcatagattgccaggtgaaggatgcggaggagtttgatgctgaacaagatgaattgatcaaaacacacgaagagaagaaggcgaacgtcaagatggagtatatggcaaaggatgttgagctcgaggaggagctttatgccgctctcacaagtctgatggagaaacacaagccggacatcttccaaccgtccagcccttgaagagctgcaggcttgcagctcaccatatatatgccctgctcacaataatctcaagaggtccctctcccaaatgaacttcaatttacatgccgataaattgcttgaaatgctcagaaactctcccgagtggcgtctctgggcaattgtgttgcacccccaatttggtgttttgatctgcaatttttatgcatctgcaaaggtcaatttgattgagttgacaagaatacctgttgctcaactcaaagatgatgtgctattcttgtcaaacatataactctacacggttttgatttcacttgcaagtttgtgaaaataaaagtaaaacagatggttttactttgcaagtaaaagaatttcggaactgccaagtccgtccctaatatttctagagattcagaaacatcacatgtttttgggttactgcaagcatggtttgaagtttggacttcattttggaatgaaaaatctgttcgattgtcatgtatggaagcacatgctaccgtgtcatgatcagatgaaataggatgtcgtatgccgtatgtgtatggtgcagcagtgaattgtccatctcaactctttcgaacttgtaaaatcacatctgttgaaagaatttaaaacgcacaaattaatcgatcaattcgacgacatctacaattctgcacacctaaagatgacttaacatgcatgtgaattgtttgaacttcgaatttcgggcaagaatttggggtatcacaattcacaacatgtcgctatgcaatacccaaatcttgaacattacactactagaatatataatattaacaaggactaaataacgaggacaataaattcctagtcgttaatcatattttggagcagtttcggtagaaaattgggacgtgatgtgtaaccgacgaccacagcttacctcccgtcgttagttttcgttctttgtcatcgttaatagcagttttgatttgcctatcaccgttttatagtaagttgaataaaattttattcgtgtactcccgatccgataatctcgccccccatcttcttgtattcccctcgctcctgctgccgctcacctcggccgccggcgtgatgctactggcgcaaccatcggatccctgcgcacgagctccggcctgtcgctcccaccacccgtgacctccattgctgccaacgttggccgtgcgctctcaccaccaccatctccagatccttgccgaagtgctcccgccaccacaaccccaacggcggtggttcttccccaagttctcaccgggcacacgagggaggaaggaggcttgatttggtgcccccacccccctttggtagaatctccttctcttggcacaagaagtttctatcagttatatgtcctccccttctgcgctaatccaaactgagatcgttccctgctggtttctcctccaaatcagcaaaaatcaggaggttgagagctgattagtgattgctcgctggaggtgctgcctgggggctacatcgagcaaaagggtcacaacaggaaggtaatactatcaaatttgccaggtagttcatacgtgctgattattattaaggtttatttgcatgtctagttgtctactgtgctgcttctccctatcacacaatgtttgatatggtacgttccaccaaattcttgtgcttgtgatagctctgccactttcatgagtaattgaggattacaagcaattaattctattttgtaggtaagcatacttcagttgctagctttaatcaaggaagaaattcataactgtgtatcagtgtgcatgactacaggtaaccgggtaactgggaatgaattgatgccatcagttaagcaggctcaatgtttgatgtgaaattcagggacagcttcactcttcgtggtcctataatctttatcaggattggaattttggaacttaactataggattaatcattgtgttggtaaatgtgtcgccgtgtattaaatttctctttcagtttttagatcaagaattcgctctttgatcaactgttactgaattataatacaattgggcatatgtgtaggaactttgcaacgtttatgtgttgataattatgctgcccccattcatgacctcatccctagtcccccatgaagactctaccaggtgctttcttaactaaataatgtaacatgattaagagttctcctcaactgactgcctggcatgattttatcagaaactaatggatttttgttataagctattgcactgtttatcttctgcaggaacaaaattcaggatgatgcctcctggtccgaacagtttagggaaaactcaatagagccagaggatctacacaagccttctattcattgttttaaattgccatcagtttcatcaaacataattctatctaatttgtgctctgtattgcttgagttaattaatgaattatcatccaaagcataacttgtagtgaacttatttgctacaaagtgttatattgttccatttagctattgaagttaaattgttcttatttatatattgcagtcgaatattgtttaagaaataaatactaagtttgcaaaacttatcaattgataattctagactgtaactgtactaaagtattttgcttctcagtatccttctttttatatttaggtaactgaactaacatatattaggttatcagaacaacatcactggaggtaaattttgctctcaaataagttatatattacatgccaaatataatgtatattaactagtataatccttgccagtggtaggatttatgatgaaatggatgaggaaggtgcagtcgaagacatattgaagggttgtttctctatataatgattagcggttctatccataagacctccagatcgaagaatatttttttgtcatatgtaacattgaagctcgggtgtcccagttagattaggtatcacaatgtatccctgaatattttattacaatcgattcaagaatgatatcattattcttgtactgattgttttgaaatattgctatgttgtgcaataatatatgagattgttaactccaaaatgtgcacttgcaattatttccaagggagtaatggatcttattgtgaattaataatggtgttaatgatgtatcctgaaatttcctaatattagtaaatatgaacttagatgtggtcgtcaatatattaagaaccataaccagtcccagtcattaatacatttacaagcacaaaatgttacggtcgttaatgtattaacaaccgcacataaccatggtcgttaatgtattaacaattgcacataaccatggtcgttaataaagtaacgatgacatattgttcctgtcgttaatgaaataacgatgggaaaaattacgtggtcgttaatactattaacgatggagccttcaatgactagaactttgtagtcgttaatgaccacatttggacctttaacgaccacatttcccatcgctaataatcgtttctctagtagtgttaatcgccattgatgcatgggtaattgccctaccaatctcgcattcatgattttcacatgtctcaaacgtgaagagaacctatcatgcataaactcttactgtcactacataaatatcaaatcagggtgtgtttagttcctgaaaaaagttggaagtttgaagaaagttgagagtttggaaaaaaagttagaagtttggctgtatttagatccaaagtttggatctaaacttcagtctttttccatcatatcaacctgtcatacacacacaacttttcagtcacatcatcaccaatttcaactaaaatccaaactttgcgctgaactaaatacaacctttatgtgtgtgggaaagtttttgatgtgatatgatgtgatggaaagttaggaatagggggaaaactaaacacggcttcagtgccctcacatttcatgtgaatggatcaaagagggtactagcgaagtactataataaaatactacctccgtcccattttaagtgcggccatggtttttcgcgccgaactttggccatccgtcttatttgaaaagtttttgaaaaaatttaaaaacttgagccacaagtaaagtactattcatgttttattatctcgtaataacaaaaatactaattataaaattttttcaaacagttaaaatgaaacacagggagtagatcgataaaatcaaatcacttgcttagtcatgacaaattgattgctcacgattcagcttctttcataaataatgaaacctttgtacttcggcaacttttaaagattcttcataaaacagcagcaacacgaaccagacttctcatgtcttcattcaattcaacaccaacaactagacaaagcttaaaggtcccctgacaaagtgccaactctaagagtccccatccatcactcacagtgacatgtgggcccagctcctcacgttgaccgcagttgactcgttgacagcctcccgggccccaccagacagcgcgaggtgcgcctcctctttaaagccttcgtaaacgaggaaggcgaaaagcgggggggggggggggggggggg

SEQ ID NO: 5265 - DNA, 10975 bp, Oryza sativa
  unsure (1)..(10975): unsure at all n locations
ccacggtgaccaaacttaccttaactgaaacatggggcccaccagtgtggaccccactcgtcagctacccggggtaagcggggtggatcgggtgaggaccaaacgagcattccgtgcggccacccacccggtgcggttaccggcgcccccccctccataaaaaaccaaccaaggccacaggcgcgggtccgcttcggcttctctctctctctctctctctctcctcgaaaaccccaacacacacaacgcgaaccccactccgcgatggcgtccgccggcgatcgccgcggcggcggggggcctcccggctccggcgacgactccggtgaggccccgctcccgtccctctcccttgtcccggtggtcggatggccgatccccgcaatgtcggcggcggatgctgctcgttcgcgcgtagggtttatgggggtggttgggttgggttgggtttccccggggatcggtgcgtggttggcgtgcggggtttttgttttcgtgggggtttcgagatgatgtgtgttgcgggggggtggccgcagcgatgcggggggatttgggtgcgctgcgcgggtggattgttcgaggtgattggttctttcattttttttttgggtcgattggggtgtgtactgtgtagggggtttagtgccgtggtgctttgtgtggttgcggattcggtggtctcgtccatgtggttggttcatctgaaggcgatgggttttggtttgatttggttagtttgatccttctgtctttttagagcttcagagtttggtgttgttgggtatttttgggttcctttcggtgaggatttgtgttcactttctatttgaaaaaaagagagagatatatacgtattcaccttatggagcattcagttgtaataggtgggtttttatttgattttgcggctggttcattgtgctaaatttgtgttgttgaaataggatgccgtatgtgattattgtaagatcattgattattgaaataggatgtatgtgattattgtatgttttgaatgttcgcctagcttgctagatcgataattatgcccacatgcttattgtaagtttgtagctatgttaattttgcttccctgcgctcttaggtttatggtgtgacctccttaatttgtgattgatctatgcatgtgtgtgtttaggtctttactactgataaaattcaaaactcttagaactttgcaaatactacttcatgctgaatgattgctctactcagtctggtcagaattaatttacattttgtatagaactgttgatatttatctctatgaatattttgattggacataacattacgaaatatataatgcaatcctaaggtagtgtttacaattgcatttggagaccttttgatatctagtacatatttgtgactggagagagtgttcagtgttctgtattggaaccttttattgctttcatcatacataagagcatttcataattattaatcactggccttcatcagttttggtgtgtgtcaaggagctgcactcgtgaatctgtgcgtgcatgtgcatctgccttataatcacgtgaaaataacatgttatactaatttatgtaaatgccttgtatccagggggtggttgggagactgttgagaagagggtaaagaaaccagcgcaacaagttgggaaggggcaatggggacaatggaattctccaaatgctgcacctgcacctactgcaccacggagtggctctggagcttttcatcattctggaaacactttggttcgacattctgatcgtaggccagcaagaggcactcctaggccaccaccacaaaacaggtctatagaggcagaactgcaagcaccgcacggagttgtgactgcacctctggcaaatggttggcagtggggagccaggtcttgcccacctggtactgaaagcaaggagggtggtcttcctttgtctggttgtgatcctgaaacagacaatgctgaaggttatgacacatcggacgatgataatgatgatgatatgagtgacgatttgagtgatgactatgattctgatgcaagtgagaaaagttttgagactcggaaaaatcacaagttgttcaaaggtttcttcgaagtcctggaggcgttaagtgtagaacagttaaatgaaccaactaggcaatggcattgcccagcatgcaaaaatggacctggtgcaattgactggtacaaagggctacaacctttgatgactcatgccaaaacaaagggttctataaaggtcaagcgtcacagagaattggctagtttattggaagaagagctatctcgcaggggaacttcagtggtaccatctggcgaacaatttaggaaatggaaaggattgcgggaaagcactgatcgtgagattgtttggccaccaatggtggttgttatgaacactgtattggaacaagatgaggatgataaggtaacattttcatttgattgctgttgagtttcagtatagatctgaccagtttttctgcctgacttatatctttatgagcataacttttactcttatcttctattcatcattctgcaattacaggtcttgtctgccacattaaatttgtagtaaatatacatatttttggctattttcttgcttatttttttgtatctcgtaagaacattgagttgattctactgatttgtttacctattagtatcaaaagcaatgcacattcctcaggagcagttactatatgttgacttttgttactcaaatattatatattttttcttatgcactttgatataaattgattagcaagatttatcctcttcatcacacattttggttgaatttattatgttttgttccagcagatatttgttttctcaagtgttaaaacttaaaaaaaaaagacttcaaaattcactctctgttgtgattttcttgcatttatacttcattgtgaaagaataaaaatatgctgagcagtcagggttatctaggcgttgttcattaaaatgtatttcttattttctttattattgtgaaagaatatctgcttgatctattaaatgtgtctgcttttatgtttttattgcattctaatatctcctctttgtctcaatctagtggaaaggtatggggaaccaagagctaattgattatttcagtgaatatgctgcaagcaaagcacgccatgcctatggtccaaatgggcaccgtggcatgagtgtgctaatctttgacagctcggctgtgggctatatggaagcagaacgtttgcatgatcactttgttcgtcaaagaacagacaggaatacatggaacagtgctcacaaggttacattcttacctggtgggaaaaggcagctgtatggtttcttagctacaaaagatgacatggagacattcaatagacattgccacggtaagccatttaactatggtccaatacctgtacattaaattaattaacgctgtgtttttggtgcaattgtcattcatctgataaataactggctttcattacttttatctcctgaattctttctgacgccgattattattggtcacctctatgaagtgctcatgccaaatactagcttgcatttttatgatatgctgcatattcctgttcttcatcttcattggaatgtgatcacaattgatattatttaccgcaatatgtttctactaatgcttcacaacaattcataccttcatttcatttttattacgtagcatgttattatagtgtactcaatgctcatcagctgggtagctttctggtagtttatctctactacttgaaagcatgaatgtctaatctcattccattcaaaatgatatttcccttctgattgtaagaagaaaaattctatactcaaggacaatatgcaagggtaacttacctcttcggggacagcaaaggattagatctgtgcttctatattaataaaccttcagttatctattttctcctagaacatggaatcctatgatttatgctaggtatagattcatcatcattgggttcagcaagagtaatgtagcccattaataaaaaagaactgttaatgcaaaaatttaaatgatgctgatggaccctaatattttattacctttgtgcaatacggataggaggcatgtgcttgtcttttgtcttgtatcctttacctagtttcgttttgttgtttttttctaaataaaatacaccatttttaaagtaagaaagatactctagtttgcagatttctttcttttataagaacaattaattcctgagcattgcatttgggttacattcaaccctctacacttcgatagttttatttcttcatacgcattacaacctgtcaatctgtcattcatcatagcctctctgcatgtcagtttgacttcatatttgctatcctgttgatagtaaaatagaaggggaagtggtgcctgcctgtttgtaataaacaggtcctggcctcccaagtattttcacaacaaatgcaccacccatgtgactgtttatgtatcaattgaacatggccatcagtaatcttgattttcttagcttggctatcttatgattgttttattgtaacattaatgcaaacccctcttttatacctattgcaaattttcaggaaaatcccgtttgaaatatgagatgagatcttataatgagatggtggttacccaaatgaagcagatgagcgaagacaaccagcaactgaattacctgaagaacaaaatggttaagaaagagcagcactctaaattagtagaggatacattgagtgttgttacccagaaacttagggagacaatggaagagaatactattgtacgaaataaagccaaagaaaagcacttggagtatgagaaagaggtaacaattgcttaattggttaccctaatgaatatattttttggtaacatttgtatgagcagcaaccagaactgtcatatacttagtttacatatcagaaatattccgagagaacagatttctgcatttgaaacttgccaatttgccattgtcttgtacccttgttttgatttttgttcccttttcaccttgtggttttatacttcgcagatgaagtaccaggaggaatttttccatgatcaaatcgaaaaaattcacaaggccacagaggagaaagaaatcaagtttgagaagttgctgcaagaggagcgagcaaaggctagacaaagtgatgttgactctggaagtactgaagatcgcaggcaaaggtgaacaactagtttaatgtttttttgtgtgatgtcagttaaaattacgatccttagatcactcttctaggagcaacaaatttgaaatttccatttggaatggaaatgctccgcatcaatatataacctagtcgacattgtttcattgtgcaggaaggaaaagattcagaacttcatagactgccaggtgaaggatgttgaggaatttgaagccgaacgagacaaactgatcaaattgcatgaagagaagaaggtgaagctcaagaaggagtacctggcgaaggaatttgagcttgagaaggagctggacacagccctcacttccctgatggataaacacaagccggacatcttcaaatcctccacctcgccttcgacatgaagaactgcggcttaccatacatttcctgctcatctacaatagctaagactcccatttcctaagtacccgtaaaacttctagcgatgcgaaagcatcattctgtttgggtggatgcatgcctttggaaggaaacctgaaccagttccgtattatatggagtactatcagtttatggttgctgatgaactgatgactgtgcgctgcgcttttacagcaagcgtggaaatcgaatatatatctagtttatctcatcattctgctctgcgttgcatcaactgctgattgagtgcttacggtttcctattagcaacatatactatcttattgtgttaaccctttcatgttgtctttggcatgcagaacgcattttagcctacaaatacaatactagtattgtagtatgacatgcaagctttactttgcacatgttcgacaacgaaatgcaaaggaagatttgtttcttttgcacgttgttgacagtgcaaattgcccaaaatgtggccgagttacatcgcaagaatgatgcctagtaccgtagcgcactatccactatgtcaattcgtcatcattacaactggtttccaagatgttgaaattttggctgtgcggaacatatgttttttacactaaatacttcaatcctgtcggaataagataaaacgtttaattccaaacatcacattgttattgttttccccaaagatataactcgatagatgaaatctctccaaacccattcaaagagagaatggattatcttcttatgatgagacagtaagagctaatgggtcatccgctccacataaattctgaagtaaacgttatctgacgtcaaaactgaacttcattacagtcttaaaaactactccctctaaaaaaaaaaaaaagacaaaccctgatttccccaacttttgaccattcgttttatttgaaaaaattataaaaaagataagtcacgcataaaatattaatcatgatttatcatctaacaacaatgaaaatactaattataaaaaaatttcatataagacggacagtcaaacgttggcacggaaatccagggtttgtctttttttgggacggagggaatagcagcctagtttgcatcaggcataagcccatctttgctagaaaaatgctgcatttatacatcagacatacaataattctgtacaagttggaatcctagattttgaaggacgcccaaactttcaccaagtagcccaaaatcttgatgtcgctgaacatctgcatcatgctatggtttgtgttctttgtcctactcgtttactcatctgagtaagtgtcaaactcaaactgttgctcacctttatcagttgatgctgtccttctcctgagaaagaactggaacagtgtaaccgcagctaccagggctatctcagaatggtctgaagtgctagtcttgacgcagaagcggcctaggttcctgctgtttaggttagcgctgactgagactttcgatccgcggcccattcggaagtctgactgaagattggtgctgattacagtctccttctcgaacgacagagcggtggctgcgactgtgatgctctcttccctcacagggtaatctttccccctgaatgtcatttccaggccacctccatgtgccacttgcccgcagccaaccatcctcccagcattgccgaccaactgaactcgtcgcccgacagtgatggaatcctctaatttggcaccagtaaaatacttgctaccgaatttagtaatggaaatgcctcctccagtagtgttccagggcaaattgtggaacctggcatccccattgacagtacagaccagatccttatttgctgtttgcatattcatgctccctatcaaggagcggccattcttaccgctgtagcttactgaacattctgattggatatacaggtcttctttgtcctttctcatctgccccgcaattgatgcagtggtattcttttctaaatcttgagatacttcaaaattgatcccatcaaatccaatatcatggtcccatccttgtggatctaaaactggtctgaacaccatatcatcagtaataaggtaacggtagcgatggactggataatcagagtcaaaacttgacggaatttccatatctgacatgtgcacaacctctggggacacgctttcttcgtaatcatcaccaacagcatttgatgcatcaacattttgagcttcaacaagcttttgcctcctaattccctccttccactgtttctttaggtacagagtttcacgatagtctagttcatcaagatatgcagatctctgttcttttgacaatttttcatattcagatttcttcagaacacggaatggcggtagctgatcagattcatcctcatcatctgacacttcggtcatgtcaatgccaacatcttctgatcttgatgatggattaggtttaaggagtgatgaaagaagatgaggcagtgaaggcagtctggtatttgcttgtgacagaaggaagctatcttggaacttaagcaaggaatttgcttctgccaacaacttggtcgccccacatagcagtaaaagttctgatacccataccttcccattaggtaaaactctttcacctttggtgttccgtcggcacattggatgattgtcaacaagaactacagggttctccatctgtgtgttagaagcagccacctggatatgacgctgcaccacattcttgcaataacgggcataggagtcatattccagaggataaccatctggtccttcaggaggagatgaagagcagtgagtcatcacaaggacagtgttgaaccacatcgaagaacccaagatatcagttatgagcttcaacagcgggtattcacagtatctactgttaatatggtcgagtcgctcgaagtacaagacgatgtcaggtggtgatcttttaatgaagcgcttgacagcatgtaaaatcttcctgttcttcctctgtctatggtaatgaggcaacaaaccaggtgtgtcgataactgtaactcttattcctttgattgttccatcaatcctccttatcctttcagtagcaggagctaatgcattggtagcaacctttggttcatcaaaaatggagtttatcgtggcactctttcccacaccagtctttccaagtagaagaattcgcaagggcaggtccaaatcaggtccacctggtgcttcttgctctgctgctataactctggctttgttgatagcaaggttggttctcttggaatctgattcgccagctttaatcaagttggcaaggtgcaatctgtacagtacctgtgcgacaacatcagtagtgggaggcactccagttctgtgcacaagccgcaggaacttaatttgaagagcctcaacatgctttagtggatctgactttgtgctatcatgatctggttcataagatggactggatgtgacctctgaatctgatgcgcggatatcattagatggaaatctattggcagacacagtttctacaatctcattttgcatcacgcctgaatcacaagatggaataagggggcattcattatagtattaacatgagcataaatcaataacaaatgtgtcctaaagaccattctattggtaacatgaatgaccaacaagtaacagaatgtcctcccagcaaagcaaatgcatccacaccaatttggcagtaccacagcatataaattttcatcaagagcatctattggtactgggtaaactaatgaatcatgacacaaggccgtgctccaccgacgatggaaaaaagattcaatcctactgaattcgaagacataagatttcctatttcctaatcacaatagggcaacagttcctggtagcacactaatcgaccaccaaacattatacatgcccagaagaactagtattagcgaaaactatcacatatatcatgcaaaggcttgtaatgagcccctgcaccatttagtgaagtccaaaattttatcaatcagatttcagacttcagaggcaatactgtactcgagcaacatcagaaacatccaacaattatcatgcagcggcagactcgaaaacacatggcacagcatgttatccctttcagaacaagaaagaacctaaatagaatctgaaccatggaacctgagctgcaaattctaatcaatcaccataccaaactactactatcactaatcatcatcatcatcatcaagtaagtaagacagagagagtgcctaccatccccatcgcccccgggctgggcggcggcgccgtcgtggtgggcggagagcgagaagggcctcgccgacagcaccgacgagccgagccggtacgagatccagtccctgaagctcatcatcaccaatcaggaatttccacccaccccggctgcataaccagtaccaaaatcctcatcacctcgaaccaacccaaacaaacaaaacagaaaataataattaaaaaaaaccccaatccccccccccccctcctcgaattgaaggattcgatacgggaaccctcacgctacctggcctggtgggaggctcggagcccgcggcggcggcggcggcggcgagggggatgcggatgatggtgtcggagggagttggttggatttgggtggatgagaggagagagtgggtgcgtcggtccaacccagccggaaacggacagggtcgtccgcggcggcgagcgcccggatttgtcacgtctgcgagtgcgaggccgaccgggagatgggggggtcgctgacaggtgggccccagcgatcggtgcgagggtggttattccaggagtgcagctgtgcaggtaatcatagagcaggtccaataagcattttttttgccggtgataatacggccacgttggattctttcatgacctagaacatggaacagagattagaggagagagagtgtgagcccgcgactaattagtcgccggtttcacacgtgctccaaggcgagccaaattgaagtagcgctgctgcttgtcccccacaatactgctggactcataaaaatgaggcagagcgtaggtaaggcaggatgtcgttgaggcttcaagctcgtcggcaagcgactgtggctaggaaggaagcttggcgagcgacacgatgatgactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5266 - DNA, 587 bp, Oryza sativa
  unsure (1)..(587): unsure at all n locations
nnnnnnnnnnnnnnnnnnnnnnnnnnnnnnnnnnnnnnnnnnnnnnnnnnnnnnnnnnnnnnctttctagtactataaatatatataaagagcttgtctagatttgtagtaatatgaagtgtcccatccctctaaaatctcttatattttaagatggatggagtatattataggacggaagagtataaaaaaatataacaaacataaaagtatactaagacataaatttatatatgcggaatcggtagccaagtcttaattttgttcaactttagatgacgaaatatctatataattacctgccacgataaaaaaaatggtttctctgtttcctttttgttttttatttttgaaaattgaaaaagaactctacggaagcaaatagtgcgtgtggggccaggctgcaggcagcaagaagtggcgcatgatcgatcagcctgtccaggtgaagccttgtcgtacgtgcgtgtcggtggttggagtttctgcccattatcaggtggtaataatggcgaatttatattagttatatctaactattaactgatatatnnnnnnnnnnnnnnnnnnnnnnnnnnnnnnnnnnn

SEQ ID NO: 5267 - DNA, 646 bp, Oryza sativa
tctagaggatccccatagccgattagatagatctaacatgtatcggcaacaagatcttaacataaagggcggatttaacatgtcaatcaagcatataagacatagagtagttaaatcaggtaagatcggctgaaaccccgacactaccctaatcggcaaccaaaagcaggctagaaattgagattttaataacgacttataaggtcaaactcaactgatgcagctataaatatgaaaagaaggacaatatctagacaatcaagctgttggctgtttcatagagtggtagataccctgtataatctaagtcaacatagatatttaacctgattggttgccttccaataatagatgttagccgattgaaggttagataacgatattgttgaagattatacataatatatgataattcgacgaattacataaacaagattagagtatcataaagatggaagcactaatcccgataacgcaacccggcataacaagttttacatctagttgaagatcgaaactgatgcagctcaacccgaaagcaagaacttgtcgaaaaaaaacaaaagtaaagggtggcgatgcgccgagattgtattgaacgtgtgttgttgtattacatggggctcgggtctatttatacccgaga

SEQ ID NO: 5268 - DNA, 584 bp, Oryza sativa
tgcctgcaggtcgactctagaggatcccctacctcacgcggcgtactcgttgtcgatgatccatagtcttcgagcaggtgcaagactgatggttcgtggggatctatgtcgattaccccaacgaatcgatctgaaatcagcgtcgctccttgttccttgtgttcatccctgatggggatgcgtgactgctggaccttagaaggtggcgtcttcatggcgctgagaaagaccttgcagctcgagaggttgtgattctttgtcttgtgaattggacaatagacatcacgagttggagaggtacgctgaattccacgctctttgcaggcacgaatttcagcatggacgttgagaaagacccaacaggcttgcagggtgtgtttcctggttttgtggataggacaccaggaccttgtcacctcggaagtaatcctcgtcggctcgtgattcctgtcggaaagacaaggcttggccgcactaggatccttctcgggctcggatgttgtcgacgttcctatctccgcttcggcgggaggatccttcgacatggagtcgcctgggttgtagccactgcattctcgtttccg

SEQ ID NO: 5269 - DNA, 3127 bp, Oryza sativa
atttttttataagactagagaaaatgcatgtgcgacgcaacgggtgaaggctattctaatcttataattattataaggtttagttcaggtaaaactcaccgttagaattcgcttggatatattattttagaaaatcatgagttgttattaggagtccaatcgtctcaagttagcatgcgagttttttttaagagatttctatgcgactcctttggtatttctaaaatcgaacgaacttaaaaaccgactcatatacggatgacgtaccaaagttctggcaaaaacatcttcagtttttataatagtagagatataaatgggagaagttgttctgatatcgtgcaaaaaataattgtgtgaattaatgtgccatttggaaaattgagccaatgtggaattaatatatgtgtatatatgggtattacccaaattttggtaaaattgtttggcatatgtatatactccctctccgttttatattagaagtcattttgatattttactactaaatttatagaaaaaattatcaacatctaaaataccaaattttagattcattaaatctataatatgtttgttttgggttgaaaatgctactaatttttatataatcttattagtttgactaagaaaaaaaatcaaagctaaacttttattcagaaacagagggagtacaactttagcaaatgtttgacattgacatgctttgatagaggaatagcagaacattttttttaccagcaccaatagtttcgaaaataaaccattaacaccttatcgatcggaaacttcaaacacaacaacctcaaactatattatactcgttagcatattccccctttgattaattctgtaagaagcaatgacgaagaagtatgtaattgatgatcattccaacccatagattattctcatacggaacaaatgactcggtaaaaacataattaaatcggtgaaacggtgtacatgtgtgtggctaggtaagagacaccaggtcctaaaaggtattagcatggactaaaaatatattttattaggataatgtcatcaaattgttcccctgcaggttgttgcactaaaccgcattcttatccatggttcagctcaccgggacacaaacgccaagccatggtccaagaagatgaagagcctgctagagcaatttgctagaaattaatattggtttttagtagcccttttgcctggcaacttgcaagagctgagctgaatatagcagctaggagtagctcataattagtcattgctttagcatttaggggtagattaagtggtccattttgtaacaattgattgtacaaatggtctacagtagatggattcagatcccctggacggccaactaaaagtcacaggtccaagaaagtgaagggaagaaaaaagaaaagaaaagaagaagcgagccgcaagtttagctgattcaataaagtgtttcaagttgtccgctttatgccttgctgatgctgatgacttgtgttcacgccttctgtttcggataaactggtcgaattttccaccaaattgtatgggattatcaagaatatatttgtattttgagggctgctataaaacggaatctcgttgcaacatgatagacatatttcgttctatcaggataccgttgtctaggttttctgttgtattttctaatacaactatatattccctccgtctcgaaaagtataacgttggttagttcacaacacaatatataaataatccacactgttatgaagacagtccagtatatattatttcttatgatcaacgtggtaatttactatactagtaataatttggttattttacaaattagtcatttccaaacttatttcgaaactaaccgtgcagaaaaaaaaactttaacaaaaaaatatgccattgggtcagcgccaaccgtcttggtgctgatgagtccctgtcacgtaagtgagggggatcgtcctcggaaccatgtggatagggggctcaacgtcaacatagctaacgttggtatgtttaacctcagcgccaatgtctctggtgctgagaacatggcttaattttttattgaagttttttttggcacggtcttagtttcacaataaatttctgaaaatgatcaatttgtcagaaagaaaaaaaaaggtgtaataagagcactcaacaagttgtgaagttgccttgaaaaggatacaaattttgaagtaagaaattcatttggagcttgtattgacagtgtacaaatcccgagtatccagctggttttgcacgttgtcttgtgcccgtatggctttctcacttctcagtcaccagttggcagtttttgtttctcgaatagagacgggccggtgcagctttggttgggtgcgttgcatgccagcatccagcgacgaccagcttggcccaattctccggacatccgacacgtacgtgcagctaaaaagtaaaactacacgcatttattactccatattttttttgtttgaaatacctgtcaatggttatactattctctttttaactttgatataagtattttcttaaaaaactgtgtagccaccgtaataatgtgattgtgtcatactgtaaatataatcatacaactatcattaataataaattaggaagaagtttgtttttctttcacgaaacaatacataattaataataataatacttgtctagatttatataaaagtaaaacttttctagagaggtagtaattatatttttcttaaaacacagtacatatatgcgctcacaacgtgtgcatactcacgtatctttctaaatgcgcgcgcacaccttacctctgtaaggacatgatcacctcctaaagacatggctggtatattttattttgggattaacgaaatctcaagtatctcgttatcgattggtatcttgcgaaccactaaaataataatttacgtgaacgctagtgcacctaaatctacttagccgtaaatacgagcacctgagttaaattagaagccagtaaacccaaacgatcggtttcaccttaggctgtgtttagttcattaaattggggagaagtttagggaaagttggtagtttggaaaaaaagttgggagtttatgtgtgtaggaaagttttggatgtgatg

SEQ ID NO: 5270 - DNA, 8496 bp, Oryza sativa
ccccccccctccacacacacacacacaacttgtgcaagttgggcaggaatcctcatcatcctctccattctttggcttccccccttcttctctacccaaagcacataaaaaccacccaccctcttcttccttccctctcctccatcacctcctccacctcccttgatctcctcacactaaatctgcgatcttttttcccctctcgcctcctggcgattgggttcggcgttctcctcatctcttgttgattcttgcgttgttttttggggccaaatttgttggtctgatttgttcttgaagaagtcggcatgcctccgttccacgattacagaggtaggtaaacaagatgaggaattttaatggatttgggtttgggttcatgctgatgtgtgtttttgggtttgctttgtgcagatggtggtgttcttgtgatggagccggcggcgtcggcggctctgttcggcggcgtcaggtcgcggaagcgggcgcgggtcaccgccgtgccgccctgcggcttcgtctccgccgccgcggaggcggtggaggtggtggaggaggaggggttgactgcggccaataggcagaagcagcagcagcagcagcgggaggcgccgtcgctcgacgctctccccgacgagtgcctcttcgagatcctccgccgcgtgaagggcgcccgcgcccggtgcgcctccgcggccgtctcccgccgctggctcgctctcctcggcggcatccgctcgtcggagatcaagcgagagccggcggcggcggcggtgccggacctcaaccaggtgttcgtcgacgaggacgaggaggaggaggacgagttcgaggtcccccttggcggcggctgctcctccgagaggtgcctcgaggggcgcgaggccacggacgtcggcctcatggcggtggccgtcgccgacgcgctccggggaagcctcgagagcctcgtcatccgtgggagccacccgacgcgcggcgtcaccaacgccggcatctcggccgccgcgcgcggctgcccgtcgctcctctcgctcgccctgtggcatgtccctcaggtaaccgatgccggcctcgccgagatcgccgccggctgcccctcgctggcgaggcttgacatcaccggctgcccgctgatcaccgacaagggcctcgctgcaattgctcagggttgcccggacttgaaggtggtgaccgtcgaggcatgccccggtgttgctgacgagggcctcaaggcgattggccggtgctgcgcgaagctgcagtcggtgaacatcaagaattgcgcgcatgtcggtgaccagggtgtctccggccttgtctgctccgcggccgcatcgcttgccaaggttcgcctccagggattgagcatcaccgatgcttctctttcggtgattgggtactacgggaaggcgatcaccgatctcaccctcgctcgccttcccgcggttggcgagaggggtttttgggtgatggccaacgcccttggcctgcagaagctcaggttcatgagtgtcagctcctgcccgggagtcactgatcttgcgctcgcatcgattgccaagttctgcccgagcttgaagcagctcaacctcaagaaatgcggtcaggtctcggatggccgtctcaaggatttcgcggaatcggcaaaggtcttggagagtttgcagattgaggaatgcaacaaggttactctcatgggcattctggccttcctcctcaactgcagcccgaagtttaaggccctctcactggtcaagtgcaacgggatcaaggacatctgctctgctcccgcgcagcttcccctgtgcaagtctctccgatccctcaccatcaaggattgcccaggtttcaccgatgccagcttggccgtggtcggcatgatctgccctcagttggagaatgtcgacttgagtggtctcggtgcagttacagacaacgggctccttccattgatcaagagttccgaaagtgggctggtccatgtcgacttgaacggctgcgagaatctcacagatgctactgtttctgccttggtgaaggcacatggtagttcgcttgcacgcctcagtctcgaaggttgcagcaggatcactgatgcaagcctgtttgccatttctgagggctgtaccgatctcgccgaacttgatctctcaaactgcatggtcagcgactacggtgttgcagtgttggcgtcagcgaggcagctcaaacttcgtgtcctctcactttctggttgtttgaaggttacccagaagagtgttcctttcttaggcagcatgtcggcatcgttggagggcctcaatctccagttcaacttcattggcaaccacaacattgcatcgctggagaagcagctctggtggtgcgacatccttgcttagaggaacaacaactagttgctggaggtgctgggtcatccatctccagatgcaaatatacgaccgtagcggtagtactcctacttcagtcaagcttcgcagcagcagagttggtttcttgggtcctgtctttgagtcatggtggacttccttcgtcttagagccggttgttttccggggggcatttttagccgagtgctcgttttttgcaggtatcctcttgggatagtgcctgttccttgagccttcggctgccattagcgtggcacccctgcccctctatcccaaccttggtccttgttgattacagtcattacatcatgctgttttttttccattgcgtcgtgttcggagctcaaatattgtcaaagcgtgttcttcttttccggtaattcttgttagtcgcggacatcaacaccgttcgtagaaacttggctgctccagttcttcagtgtccaggtgttcgcgatctcttcgggtgcgtatgtttgttccagttcaggtcttgtgcggcttgcggtatcgtgggtagtgtgtgtgtgtgtgtgtgtgtgtgtgtgtgtgtgtgtgtttgtgtttgcaatgggggttgcttcttatggtgtttgtaggggtctcctgatattatccttggggatccggcctttgcaaggtgcattctgaagggccttgccattgacaaccctgtgtggttgtttttctactccggatccctggttttgctggcagattgttgaatgctgtaatctttgtaaccttcccagattaaataaaatgtggtgtttcagttaaactttgatgtgtgatttgagttctaatcatgtcatcacttgtttgtgcaattgtgctgtatcagtatgacagtatgcaagtcgattctctgtttgaagtggagctcgaaacttacggttttgcctgtgttgttgtgcctgctttgttttcctgatggatttgaagcggctgcttggtttcactgagatcaagatcttccagtgatgcttaattagtttcctggattttcttacagtggcacctggttgagaattttactgaagctgaccgccttactcttcaaacccttctgagaatgaaatccgtgcaaaattccaccgtgtttagttccaaaatatttcttcaaacttctaactttttcatcacatcaaaacttccctatacacataaacttccaacttttccatcacatcgttccaatttcaaccaaactttcaattctgacgtgaaaacacagccttcatgtgaaactcctacaaattctatgcatcctaaatgagccgttcaaaagattagaacccccataaaatacacatgaaattcgtgtattccaaacgacccaatgtttgaaagataaagacctggaaattccacgtgaaattcctatatttcaaaggagccatcattcgaaagatcctttgttccaaacgagctgcttcaagccggacaatcttggagggggtctctgtctgaaccaacttttccagagcatgaagtttcgctgccggattcgtcgtcctctcaaaattccaaagaaaatttttgctggtctttgctaaaactctggtcgtctagttcatctcacccttcctacctatgggctggcacatctccaaccctgcactcaccattgggttaaatgcatgcacttggcttttgattcccaacgctaacccactacgtcactggcgtgacgaaaccaccatttcgtctcttggaataataaaaaggactctgattttggtctgcattggaattattattaccaggcttcctctcttgaccttctttttggagaggctggacaggttcatctgaacctgggggaagagagagagagagagagagggagagagaagcaaagcaaccttttgggaaaggtttggagatagatttgcagtttttgagtgggaattagtttgaaggtaaatgatgcattggattagtttctgggtgacgtggccatggagaggagaggtagaaatttattactgcctccggttttgtaatggatgacgtcgttaacttttggatatacgtttgactatctattgtatttaaaaaatagtaattattctgctgtgagttattttatcactaaaagtatttaaaatataatttgtatcttatatatttacataaattttttttaatgaggtaaatgatcaaacatgtatttaaaaattattgatatcgtctattaaaaaatgaagggagtcctactactcccccgtcgcaaaatataagaatctagaaccgaatgagatattttttagtattacgaatctgagtttttatattttgggacgaaggaagtacaatttaacagccactaatttgattatggattggaaggattagttaaaggcttcttttaccgttctgtgtacctggctacccgccttgaatgatgtgacacaaaagataggatttttttttccatggttgcagtatttgagtggcaattagtttatatgataaaagatgcatgggattagtttctggttgatgtggtcatggagaggtagaaatttcatgacaatttggtaacagccactaatttgattatggattggaaggattagtttaaggcttcttaccattctatgtacctggcttgcatgatgggactcaaagatgggttttttttttccatggatgctaatctgctagactgctaggagtactagtttaactgttgctggacgaaacgagttaaactagtttcgtcgaaagctgattttgattttgaattttagaatttgatttcaaactgataccaagggttttcttcctcactttggttgctatatcttttttccaagaaagtcaaaagggcaagtaaaggagatgcgaaatatacctaagattattcttacgaatcaaattaaaaaaaatcaaaattaacttcagattataatcaatagatcaaaggcttaaaagttgtggtaggcaggtttcccttttcttttccatttctgccctggaaatacatataggattatatcacaagattaattgctctcatccttgagaacggctaagtgaagaagatccgacatacacgagagcatttcgacgttcacaagtcattccagtttcatggcagcaaaataaccagcttatttactactactacacaagaaacctatctatatccatgttacatacagactgcacaattggccgctatatggactatctacagttctatattaacaatactaccaaaacatctggtgcatgaaactagaatggtacactgatctactgaagaactgactcagctatgtggtacatgcagcgcctgcaagagcaacttcggtggacgggctaggagttgacaacctgaaaacctgaaaatcccactgatgcaggagttgcagctgcgttagcgccaggctagcatgtggctgtcctcagcagtgcggatttcgctgaaacttcaatcggtctccagattatgctttccatcttgttgcacaagttcttgtagaactgcaatgagtgtaaatctgagttagcaatcgttccggatggacgaaaagttggatgttgcaccttcgaatgagcattttgacacattgtgtgaaagttatcagtgtcagtcaggcagtgtcagtcatttttttagatttatgaactagtctaggcaatcatgctactatattcgattaggatacaagacgatatgtggaaagacagaccctgtggtattccagtgtgtcaccagcaacctttcgaacatcaaccatgaacagagaaggagcaacttcgaaaacctgcgaatgatgcatttcaaagcataagacagcatgaaaaatgtagtttgtgaatgacaaacagcaaaatgttgttccccaacaaagggcaatgtaagactacctgtagaacaacagcaaacgggctcattctgtttgaagatacaccttcaagacgcaactgcagaaaagagttagcaataagtatcattacatcaagagtaagaaatgagttgcttgttgaagaaaatgttttgtaattaccttgtaattctgagagtggaccttaagacccatagtctcagcaacaacttcaattgtagctactatagtctttgctggtttccttgagacaaaacgagtttgacgtttgacaaactcctacaaatataaaacccatcattattgcaacatgagcactccatgtgatgaaagttgcatcagacaacataagttattcatgaggactgcagttaatgcataaagcaaacaccaaagttattcatgacgtgtggcacactatgacgtatggtccacgtaaaataaaaaaatacatactaaacatgtctaggaagatctaatgtaagagcacaaacattgaaaagtgggttcttctttctgctatacgagaacattgcaactagaatgaatatatggttggtgtggtcaaatacttcacaaactaaacaggtgcaatttaaaccatggagattagctaagaagcaagcaatcagatgtttttttctccttttatgcagggtttccatttccattcaaatttggcaaaaaacagaagccgtctgccaccaaccagtacactaagcgataagaaaagagaatagacaatgggatcgatctacagtcggttaatccatatacagtggctagaatatagttccacataatactaacgccaattgaaatggatgttcgtttaagtcatttattataaacaagatagaaacccctgagcgaccaaccgtcactaaacccagtgcctcacagccttgtaagtaaatgaaataagctgacatgccagatctccgtacactataaacccatcagcgtttcaaatttcattgcgctaatggttctccaacagcaaaatggtcaaccataccaagagtgttaccaactaaaaggaagagtggaactatgaaattacctgctgtctatcaaataatgctgaaagatccaaaccttgagataatgtaatcatctcgaaggcattcatcacaagagggccaccatcattatgagtcacttgctcagaaacgtacttgtcctgaagccagaaaagttgtataaatataactatagaagcaaataggtgacagacaattggcaatataccaatggcatacacaaacctcaatattgtcaaaaacagcctgtacatcatccagatcaacattttcatcttcaccacgtttaatggctacataagtcttcttaaaccatgtgtcttcccttatctgttcaatagtgatacgctgcaaaatagtgaaaaaggcctaagaaactggagacggcaatttgcaaaagcaaacactctatgctggttgaagatctatgcgttagacttattagatttgattctagcaagattctgtcactggtcatgtatagttgtatacagtatttctgtaacatatatggcagcactgatatgaagaaattagtctttgttttctgcattctctcacataatttctgcagccatgcagactgagactgaagtattaaattggtgacaagagtactttggaagcttgaggtaaactttactataaaggatgatttgtttcttgaagatgcaatgaaacaacctagtgtgtgtacttacagtttttggatttgggtcgagtattctgtggataagcgatgtagcacctggagagaaccaataagggcatgaaaactgacctgcagtaatcttttaatgtaggagtaaacatatcaggtttcaatctcatctgagtagaacgattatgtaggtgttcacatcaacaatttagggaaagaaagacttatgctgcacacattagtaatgaagccaataccttatcatacagtgttggaagatcatcttcctcaaaaggaaggtatccagccatcaaaacatagagaataacaccacatgaccaaacatctgctgcagatccatcataaccattgttgctaagcacctaaaacattgacacatggtaaagcgcatatcatatatgtactaaaaaaatgcccctaatcttgtctaaggaaatggcttgaaatgcccatatcacaattttatgaactagttcagacaattaaaatcacaatagcttgaacatggtgaaata

SEQ ID NO: 5271 - DNA, 13524 bp, Oryza sativa
  unsure (1)..(13524): unsure at all n locations
ttcttgcatgtagtgtagctaatcaattagctccttgccaaaaaaaaaacatttcgtacagttcaatttaccatgcattgagagatagagagagagagagcatcatacctcaggagcaacataatttggtgttccacaagttgtgtgaagaaggcctactccctgaaatccctcaaaaaagaaatcccaatcagaacacttctaggatagaaatacagcatcattaaaagcaattactgagcttactttctgggccaaagtgctaagtccaaaatcagaaactttcaagtttccacgtgagtcaagaagcaggttttcaggctacataacatgcccaaaaaaagggtaagcatgagatattgcacctagtgaataggacaaatgatagccaagtgtctcttatcagtaacggaccttcaaatctctatgatatactcctttgctatggcaataattgatggcatcaataagctgctggaagtacttccttgcttcattttcacgaagcttcccttggcgagcctacagatatttgatcgcataggttcatattttaagaaaatgcacaataataaaaaaatgttcctttctttatattgcctattgggattatataatgggcctataatttactgaacagaaagtttctggtatatatgggtgataaaaagaatttacatatggagacactgccagattggcacaattcttatatttttttagttcaagtagaacagcagctcatcgttatttcggtagtgtatataatagactccttactattttatcgaacaattcgcctccagtgataagctccaagattatgtatatcttcgtctttccagctagaacctacaaaatcatagtaatggtaacaaagtagtgacacaggaagttaagatagccaacataggagttttgttaataatgaaaagttatataggacagatggcaagtaaatatttagcatacctcgtttagtctaactatattggggtgtcttacaatcttcattattgatatctcccttttgatctgtcaagtaacatgagaagtgagttcgtaatctaatgccgaattagaatggtttagtccttttttttgttatcatgattagcgatattgcataaacaacacaaagaaagtacatctcgcataaactggaaatctgaaatgggtgctcacagcaaaatcaggtaaaactggtggtcatcattgatttgcagaacagttaaactaaacaaaccaaatttatacacatgaaattgcaaacacaattggggagaaactaagcttcatggcaaagcagtaggcttaggattgtagaacagttatattaaacaaaccaaatatatacttgcaattgcaaacacaattggagagaaaccaagcttcatggcatagcagtaggcttaggattatagaacagttatattaaacaaaccaaatatatacttgcaattgcaaacacaattggagagaaaccaagttccatagcaactagcaaatcaggaagcttaggaaaagatttacaccactataattagagaacttgagcactttgcaacaagatgcatcctcaaaagatgtcgttggataaccatatgaaccaactatttgtagcatttctgcaaacaccgcaaatcgaattaagctacaacagaccaaattttggtaaaatcactttcaacacccaaccatttcaattctgcaactgagcttctgtcagcccaaacgagatgaaacaccaaacaaaccgctcgaattaagtttttctttcttttcttttttttttttaaaaaaaaggtattttcccctttgggagaacaagaaatttaaggctctccagttaattccttattcttaatcatcaaacggcaagagctgcgcgcaactcgcacgaattaaccagtggtgcgcattgctgtcgaggtatattcggaaattctccatccgccctcgtcgatgcgcggctgctcaccatttggcaaacagcaaagcagcagcggagagcacccaaataaaaaaaagtgtaaaaagaatcgcccggatcaaagcaaaggggggagtgcgaggagtttgatttggactcgtgcactggcgggggcggatgtggagggtagcgggaaaggagaagcgggggaattacctggtggagcatgcggtggttgaggatggtgtccttgtcgagcaccttcatggcgacggcggcgccggtgtcggcgtccacggcgaacttgaccttggcgaacgtcccctgcccgatggtccgcccaacctcgtacctccccacccgctttttcctccccgccgccattccctcctcccctcccatccgccgcgcggccacgaatccaactcggggggaagaggaggaagacgacgacgccgccgcgcgcgagctcggctttgggggggcttcgctgcctgaataccgaccatctggttgactgcttgcctatttatgggcttccaccccctccgttctataatactccctccgattttattttaattaatattttgataatcacacgatctaaaaaacatatatttgaccttatttttctattataatatatgtaataaataaatgaatgtttagtgttttgaaagacaaatctatatatgttattcttgttcttttaaactaaatacttttatatatgttgttcttgttttttaaactaaatacttttaaagttatggatagtcaaagttataaaagtttgacttcaatcttatctaaaacatcaattattatagaaccagagggagtaatcgacatttaacataataaatggtttcgatatatggttttgattagcatatattaagatttgagattacgatacccctcattaaatggtgtataggtaagaatagaaggacaattaagggtaaaatagaaataaatttaaatgagaagtgattatgagacaattagtactctattatgataattattttgtgacacatgtaaatcttagaaatacaattattatgggacggagatagtacagaataaaacgtcatatcataaaattaagattatttttttcacaaaacatttaatgcggagtatcatagaattatgtgctattacaaaactacagatttcaaagttgaaactcttagcactaattttatctccaaattataaaatgttgtagttttataataattttgttactaaatctgcaattttgttataatttatttttttgagaagcgtagtataaatccaggtgcccataacgcacacacactcacgtctataaacacatacacacataccctacctctataagcatcttcggaggactggaccagtatatcttgagattgatgaagtccatagacatcttgctgtcgatgagtacatcacttaccactaaaaaaataattagctgtaaatacgagcacccatgttaagtctaaaacttaaacccggatagactggtttcaccacaagggaattttgttatactttattttaattctattgttttgcgaaatttgttattaaatatgtaggtttgtagttttataaaatttactcatggtttataataaattttacagtatacttttaaaatttaaaatctacaaatttaaaatttaaaatatatgtagttttataaaatttactcatggtttttaataaattttagtgaactccatttaaactatcagaaactatagattgaaaatgatatatcgcaaaattatatatttaacattaaatttatcataaaactatatatttaataccgtatcataaaaatacataaaactatatatttaataccgtatcgtaaaatacatatttaatagtgatgttattaaaaaaacaactacgaatttttagcttgtggctttgggctatggcttcactgctgcgcgcagcgcgctgctaaatgcctgactgcttgcctatttaaggcttccacctgcgttctctaataattggcacggttaattctagctttttccttttgccataaattggttttagatgattatattatggtgaagaaatttgtatgcctataattactgcgcttaaaaaaagatacaagtttaaactaatgcggaagaagtattctatttatttacttttgcatgacctgaaaaagaaggggacagaaaaagattttgctcatgtttgagaggtcgctttttaattcttttgtgttgttattgtggtgttgatgcctcctattgtcctctcgctttttaacttgatggtgattagctcgatcggttgatgatgattgatgcgataaaagtttgtgatctctccgaatgagtagaaagcatgatcggtacttcagtaatggctgtgatgacagtaagcgtcaattgttttctttcctttttcttttcgatttcgattacgactcaacatgtatacacactcacaaactgcaagtgcgtcgtcttaacacgttgatcgccatgtcgagattagcgatatctctgagttacgaatttattgatatgctaaaaccatacttatatttgtatatatataacccgatgaataaagtcatacccctacaattccatgccatatcaaggatgcttctcgccgtattctgaaatttgaaacattttagaataaatagaaataattgtaggggtcataaccatcgacagtgcacaaacaaagtgaaccagaaatggttcgtgaaaaactggtgtgaaccatatcactagttcaaattgtcttcttaatttgtgatatgagaaaattttacaaaactttaaagtggtgtatcacaaaactatagatttaacaaaaaaaaaattatcatagaactacaactttaagataaagtttcacaaaacagtagattaagtagcaaatttatcccaatactatagtttcagtcccaatttaattacaaaactacaatgtccaacagaacgacagtgctagtgattgaaactttacaatatgaagttttgtgataactttaataccccctccgtattttaataaatgacattgttgacttttaaacacatgttggattattcgtcttattcaaaaatttatgcaaatgtataagatatataaatcatgcttaaagtactttgagtgataaaacaactcacaataaaataaattataattatgtaatttttttaataagacgaatggtaaaacgtgtgacaaacagtcaacggcgtcatctattaaaaaacagagatagtattaaatatgtagttttgtgaaactctaccttaaatttgtagttccatgataaatttgttgttaaatatgtagttttgtgatacaacacttcaaatctgtagttttgttaaatatgtagttttttaatgtgatattgaaccttcagcatcatatgattgtgtttctcatatgtctatattttttttactattgccaccacctggaattgtcttcacggcttccttacttacttgtttcgaagattatatttttatggcttgagaaagataactacaacatacaacttgtaagatgttggtacaaacaatagttatgcatcctctgatcaaccttagatggagatttttgtttttaaggttgtgcttctcagtagttttcttgtttttaaccaaactataattttgtaattcataattattcattctacaaacactgtaataattctctagggatagtttttttttctgcattccacaattcatctagatatgctttgtgcttctctaggccgttagatttttttaacattggtagagattcatcaaagtgcaatttgaaggccgctttgaagtggaggattcttaatcctataaaataattcctatgagagcctttgaaacaaaggattaaatcctatcactttctttgaaatttatatgaaatggacaattatatggtgatttcagagaaacaaggccaagaggtcctagttcatgttttcaatcttttgtctcttgcaatcctatgtttcttatgtgttccaatcaaacaccaatatttagatggtgtttgaatctcatgaagatgaagatgaagataatgattaagtatttcacgtaaaacaaggtggtaataacgcgtgattaattgtgttttaattattacaaacttgaaaaatggattaatctgatattttagaacaactttcatatagaaagtttttgtacgaaacgtattgtttagcagtttgaaaaatgtgtcacataaatcttctttttcatccaactcatgagttggagaaacgaacgggaccttaaagtactttcatatggtttatcttcctgtaggaatttaaaatctatgtcacttggttcctatgtttttttttcctatttctatgttttaaagggagctctaattaaatactatttgtttcacccaaaaaagagtatatgtgaatgtttgatattaatctcgatattaaaaagtgattggtaaataaaaaaacatgactattcaaagactatatggccctgaatatattccgataaaattaatatcagaaaaggaagacaaaattaaagaaataccattcagttgtactgttcctactggctaaagttatggacgagttgtagactctttaggctccccatttcacaaatgcatcttaaagctcattaaatttgtttgtagagttgcttttgacgtcttaagagtcaaggtgatgaaaatggatgcggctcctgcagtactgcatgtgctcactgacatatgggccttacagaccctcagccccacattcagccccacattgagtctgcaatactgaggatctggattggacgaaaatcgcttgctgttaaattagtatcagaagtcttatccataaaaaatagcatatatatgacactctaatataaacattcactatgtctatttattttgccaaagggcaaatgcaaatgtgaggctaaaccatgactaattttcaccttagtggtaaaaagccaagatggaaaaaatccctcaggggcaaaatgaaaaatgttggtacaaaataattctgcatttttgtttgtttccatgtgtgttcccacatatactcgtgtaattaaaaaatattatcaaatattactccacttgtcatagatatatgacattgggaatacttactagagggatattccggtctttgtgaggtgttgtgtgttgggttggtgtttattcttgatcttttttcggacacggtgatttatcctttctgatcatgttgatgttgctctatcttcactatcaatgaaatactgcaaagttcttctctttttttttaaaaaaaacaatgattagatggagtaattatttgtatatcctgtgtgtgttttaggttctcgtagaagtagcacgtcaagaaactaaggtcaaaagtctttttttcccctctacattttgtgatgaagaactagagataaatcaaagtcttagagccccttcgaaccccaggaaaggaaaaatatggatatagaaaaaaccgtaaaaattgaagtaactgtttattcaatccgacatgaagtgggggcacagnaaccagagnnaaatgtcctttgnctgcncgaaggaaaaaatgancccaaatgaaagttttgaagagatctaatctcttacttatttttccctataaaattgaccataggaatataatcctatacaaaactttttatctttttctatgaatcaaaggacctaaaaaaatcaaaaagaaactgagtgtcctccaaaaatcctttaccagtcctcaatttcgtcccttatctcttttctagtgcaatgattaattgattaggggcgaagtctttgacttgagttgcgccaaggacgacgatcgccagggcctcaaggacgacgatccactggtggagaaaccgtctgtagtcccggttggtaaccccctttagtcccggttatccaaccaggactacgaatttaggactaaagatagctatctttagtcccgggtgaaataactgggactaaagatccatctttagtcccggtttatattaccaaccgggactaaagatcggtgcaccattttttttttgcatggccctgtttgctgcatggttggttatatatatatatatacatatatatatatatatatatatatatatacatatatatatatatatatacatatatatatatatatatatgtgtgtgtgtgtgtgtaaatcatatattacatacacatatgtataatttaaagcacttaacattttatgtgcatatatatatgttaccaaaatatatattaacacaaaagtaaatgtgtacatatataaatatatatacatgcgtatatagtacaattcttttgctcggtagctatatatagctacgacttcgacgccggcgctatgtcagaagaggaaggaccgacgttatgaattgtcgattcgtcgtagtagaattcaccgtcgggattaaggacttcttcgttgaagaatcccatcggctgttcttgaacagccgtgataaaatccttgtgtggaagattatccctcatgtgaatacgctatcattcgaaaaataatgacgtatcaatacatgaaattaataaacaacttaacaaatcgatacgcaatgaacttttgaatggtttatgtatacgtacatcaagctctcgtgttgtgcatatttggtttgataagcagtgggcatactcgcatacgtagtagccgcataagttagttccctggtcctgctttacacactacatgagaaacgatgagagatttaatatactctttatattaactgtaattagagattaattcaatataattttggatcatgcatgtattcactggaaaatgaaacctccgtccaagtttttatttccaagtcccgcggaccaattaacggaaccgatcccaagccctacatatgcagttgcaagctatgattaattattacctgagatcaacataatagcaatagattccccgcgactttggaatagatggcattatattacctgtctattagtttgaagaccttgtcaaaaatcttctcctctttattcattgagtcgtacacagtgactctgcatgcgtccaagtcgaagaataacaggacccagtggaatctggaatatgcgtgagatgagatatatatatatgatcgaaaatgtacatgctatatgtatgggaacgaaatttgttcgaacgacaataaaaactcactctctgttgtacggcagtagtatgtacgtcttgaaatgctgctgcgttaggagatggacgagattgtcctctgtgtctttctcgtacttgtcgatcatttcggtgttgattttccgagggtcgatgaacccagtatcgtagaccctccgccgtcgggcccttcgaatctccattctacaacgatgaaaggaaagtattattgcttacatatatgccaggagctaattattgaacgaaacaaatcgaactcaaagatactcacaaaatccatgcgctcagaagagagacgtcgagggcgtccaactggtacagatcgaagagatccttgaaatggatccagagaacatcttctccttgcaagaagtcggggtttctgatcctcgctccgaacatctctctacccttggcgctcatttccatgtaccgttcatggaatttgtacatctgtgtcggtagggactgcagctgttcaggtttgacaagcggtttaccgagttcaaacttgtatgccacttccgccttcgggattggtgcgcctcgaaccaactgatccacagttagaccggtgtctgcaatgaattctgttatgccaaaatcttcaccggtcaccaatggctcgacctcttggtttggttgttctccaagctgagggactggtttggacttcttgtgataggctctctgaagtgttcggtcatagtccgatatctgtaacgcctccttgtttgttgtggacattcccttgaagaagttcttcacgctcgggtcaataggtatcttcttttcaggactccgaggcttgagttgcctcttcacctctcctgccacataagcatcaagctcctcttgactgcaatcgtacggtggctccttgtttttggtggcgtcaactttcgccttcttcgttgcccttgtgtgggcaggcggtggagcttggcgagaccttgtcttgggaggtgcaagccgacatggtggaggcggaggaggcggaggagtcggaggaaatggtgcagcaggaggtggcggaggagccggatgagatggttcaggaggacgtggcggaggaaccggaagagatggtgcaggaggagatggcggagccggaggagatggtgcacgagacgccgcttgtcacccaggaaggatgatgtaccgcttgcgccatagtatgatggcgtggcttgtgtctcgtagatgcgtctcaccgtctcctcctgggtagttcaactcgaggtcctcgtacgcggcttccaccagctcaacttcgaccctcgagtatcctgctggaatcggcctgcagtggtaagtcccggaagggtccgttgggatggccattcccgacgccaccttcacgtgatgagaggttatctattagtaatcaacctaagcagcaacttgcggaatgtacaagtcaaaaatcatcaaactacgagcataccttgattgataagttcttgaagggaatatgcagctcacatggtgtccgctgcgtgatctcatcaacggggcaggtggtttcgccctgggtttgcatggcgtccatgctctgtgatccgacctgccccattgaggcgcagctgctatgattgcctgatgggctgaccattgcaggatgaatgtgtagacccccgtttttataacaggaatcattcatgtaaacagtaccatttccctggatcaagtagtctggtacacacgagttcataactgaaataccaaatgcacatacacgagagtctagtgctaattattacaccataagaccttagacattgtcttaaatcatcggaccgagcggtccggaatacatccaaaagcagaaatagataaggcagcagaatttaggcagcggcatgccattgccacaggcaacgaccgtactaagacctactgagcgccatcgtcttcatctccctcctggtagtaggcatagggatcctccgaagcttcatttcccgcttctgattaattttataattgcaagggtgagtaccaaccgtactcagcaagccaccacagcaacaatgcatatgaaaggggtatttcaaaggatggctatggctcttttgcgtaaagccagttttgtaattcttttcacaagcctcagacctagcattgactgatcaaattttagtaccagtgtttgtattcaaacaatgacggttctgtccaccatccattgtgatcccaaggatagcttcccgccattgaatcgttatggttttctgaggacgcccactttcccccttctcaggaagtggctccaacagcatataaattcatcatgcaactacccatcccacacaagttaataacttagagactagccaagtgtaatacatgtcccggtgctcaataaccgcgagcacggctattcgaatagatttggtttactcacattgcagtggatgtacactttacccgcactccgtgactgcccaacacatgagcctcgtcccaacacatgagacgcatcacgacaaagctttttgataacctcgcattggcagtacccgctccatgaactttacatcctcttgcactctaggcgtacacggtttctagcagtgagaggagttctggcgcacccgggaaagaaagactcacacatacattaagttataattatgtttaaattctctcatggcagtcctaccgatggcgacaccactgtagacacccgcctcgcggttctaccaatggctgccccaccgtagagcccctgcctcacacatcaagaaaccactatgcatggataatgcctccgctcagctatctattccgctaggtctatacccatacgagaagtgcggttgtacgagggtcgtttcatgcttaacttcatggctcggtccttaattgaccagggatggcactagcctttttccggataccacccaaatcctccatccgccccagtcgaaatcatttgtttagtttcattttcctttcacaaatcatgtcatcaatatcatggcaatgtggcgctcatgtctccacatgccgcatctcaattaccttcccaaagataattgcccaagcatatagcatttgataaatatgagtatgcataaatctagagtagcatttctaagcatttatcatagttgactagggacttttacgtaaatcatggttacaaggatttaagggtaaacaataatcaaggcatggcataatcacaagtaggatgttcatcattgcatgcaattttatttgtaaacaaaacaattttgcaattgggatcaacatgttcaaggaatagtgatgacttgccttgctctaggtcttgtgggtcttggtcttcatccggatccgcggctccctcggtctctatagttacgtgcgtaagaacaatttgaattcgattagaattcaaacaaaatccaaataatgaccgaattgagaaacgagcgcgggaggtgaattctatataggctactttattcgcgaagtggaattattcttctacctaaaatatttgtgtttcttaagaaattttgtgatttaaagtcatgtcctaagactttatctaattatctagtccttaattacatctagatcactaccgcgaattaatctcttatagagtttactaaaaataatctataataatctataagaattcatctaattgtttagttcttaaataattgatcctataattaaatgctagtattttaggtatttaaatagcaagaatttatctagctatattttcattaagcctatgattaaattctaatatttttaaatattttaaatttccccctaaatttttcctttcctttctctccctctttcttttcttttcttttctcttttcccttttcctttctttttctctctctctccctttttcctctcctctctttctttttccctctcttctctccctcccggctcctttctccctctctctctcggcttcttgccctcccgggcggcgacgacgatggacgcaggggggggggcggcttaccgatggcggcgacggcgacggcagcgacggcggcccaaggcccggcgcggcgcggcggcttcgtgccgccggcgcggcggctctatgcgacggcgcggcggcgtggagacgccggcgtggtggagtgggtaaatgagaggaggtaaggatggagggaaagagtgggaatagtggggcttatataggggaggggaagagatagggggagaggggagaggggagacgcgaaggccacgcggggcgcgaggtgggggcgtgcggcgcgaggcgacgcgcgatgtgactgcggtggccaccgcgcgcggcgcggcgcggggcgcggaacagcgacggcgacggctcggcagcgg

SEQ ID NO: 5272 - DNA, 2809 bp, Oryza sativa
cggggcagggttagggttaggggacctcgtcgaacactttaggtgcaatgaacagtgccgttttctaattaacccgattttggcccatttattatttaaatttgattctttaattcccaaattttgcataaatgaagtatactcaatttttgtgccattccaatccatggattcattctagattaatttattccatgttttataaatttttattgtaatttacttgaatttaattagagttaattctcatcccattgcttttttttttaaatttgatggatataaatatggtcgtaataatattttacacatttctatcctcaccaaatcttattttaaattgcactttaattatttactttgtcaatttactttttagggtttattcctaactaattatccattattcgcgatttataaactccgaaatcaaaatccaataaaataatcgaataaaatcggcatgatgcaatttatttaaaaagttttttgaaggcctatatttttggaattttgatttttgttggtcgaattttcagggtgttacagaatgtacggctggggatcctaggaccgatgtgcggccatacgttcatccaccttccttgccacctcctcttgcatgctgagctcgtagctcgataccctgtactcaagatctgcaatcttcgcctcggtatctctcttgctcctcatccgactcctgtatgtgtggatgtcctccttaaatccaatcttccagggaatcacgcctttccctcgtgttcgtcttggatgctcgggagtctatagggcgagtgacagctcatccttctctctgtcgggtcggaatctctctctgtcgggtcggaatgttccctgagaagaggctaccactgcgtccgttagtcgactggcagcctcgcgtatctgatcgctgaagacaagggagccatcaactgggttaagcgttccaccgtgagcatagtaccagaacttcgatcgttccagccaattagcggtggccggttcgatacccctctcaagcaagctagcctccatctcctcccacttcggcatcgcgacgctatatccgcctgaccccaagtggtgatggtacttcttcttggcggcattttctttgtttctggccatcatcacttgcccttgttgccctgtcttgtaagcaacgaactcgtcccaatgatcccttagctttgggaatacgtcgaagctcggtgttaatcccttcaggatgtatttcttgtagagatctcccttgaagctctggaactgttttgccattttcttcagagtccactgtttcattatgttctccgtacctgcgggtagcgtgaacgtctcgagcattgtggttcacaacatctctttctctgagtcctagacaaagctgtcattatccccgcgtgcccttgttctgcgccagtacaccatgctgacaggcacgttgtccctcacaacccaaccgctgtggcgtacaaaattcttagctgcttctgtcggggcactaggtcgaccgtctttgtccacctcagttatgatgtgctgaccctctatcttcttcgcggcacctcgttgtccgcgtgccctcttctgtccagcagagggatgacttccactagcctcctcctcatcgttcccctcctcgttcccctccgcatccctctccacgttcccctcctcgttcaagtactggtttggatcctcgttcccctctccttcgttccagtactggctgcttccctctacgattgtatcgtatagtatctgttcctcatcgcgatcagccatctgtgcatacaaaaaatatttgttaggtatataggatgtatttgcgtaccgtaatattaaaactctgctaatcttatattaaatctctaataatcttatattaaatggctactaatctcatattaaaattgtaataatcatatatatatgctaagtctaacaatcttatattaaatctctaacaaacttatatttaatctataataatcttatattaaaattgtaataataatatatgtatgctaagtataacaatcttatattaaatcgctactaatcttatattaaaattgtaataatcatatatatatatatatatatatatatatatatatatatatatatatatatatatgctaagtctaataatcttatattaaatggctactaatctcatattaaaattgtaataatcatatatatatatatgctaaatctaacaatcttatattaaatctctaacaatcttatatttaatctctaataatcttatattaaaattgtaatagtcatatatgctaagtctaataatcttatattaaatggctactaatctcatattaaaattgtaataatcatacatatatatgctaagtctaacaatcttatattaaatatctaacaatcttatatttaatctctaataatcttatattaaaattgtaatagtcatatatgctaagtataacaatcttatattaaatcgctactaatcttatattaaatcgataacaatcttatattaaaattgtaataatcatatatgctaagtctaacaatctaatattaaatatctaacaatcacttctttacatcacttgcctgcgcgaattccttcgatggctagctaccacttcggcttgagggacgacgacgacgtcttctctgcaacattaccaggaaaatgtattagtctaaacgggccaagttacatatataatcatatatgtattaccagtaaatcgtattagtataaacgcgttcattctcacacttttagtacaagtgcattcacgtt

SEQ ID NO: 5273 - DNA, 8893 bp, Oryza sativa
  unsure (1)..(8893): unsure at all n locations
nnnnnnnnnnnnnnnnnnnnnnnnnnnnnnnnnnnnnnnnnnnnnnnnnnnnnnnnnnnnntcgagatcgagatagagagagagaggcggcgacggctctcacccaagagatgcggcggcggcgtctgcggcggaggcggcgaggaccgccaagcgacggcgagagacgacggcggtgtcggcgcggggttgccctaggcacggtggcggcgaatgagaagccgagatcgaacaatgtctaagtgttggtggagaagacgagggcgcaccgggaatatatatacccccggatctttagtcccggttgttgttaccaaccgggagtaaagatattctttagtcccggttgttctcaccaaccgggactaaagatcttttctcgctatttctaaattctttttaaacccggttagagttaggaaccgggactaaagataatagcagctgtgtcttgaatttcattgcatatgtgtttctaaaatagtaaataatgcattacaattatttaaagtcgaacaattaatgataaaaccttcgaaaaattattgttgtatgtagtagaatacgtggatataataagcacatgaatgatttaaaattattaaaaattctaataattatatataattagcatatgcatgatattaaattgttaaaaattctaattaacatatgtaaatagcacatgcatgatttaaaattaatacaaaatctaatatcatatataattagcatatcatgatattaaattgttaaaaattctaattaacatatgtaaatagcacatgcatgatttaaaattaataaaaaaaatctaataatcatatataattagcatatcatgatattaaattgttgaaaattctaattaacatatgtaaataccacatgcatgattttaataaaaaatctaataatcatatataactagcatatcatgatattaaattgttgaaaattataattaacatatgtaaataccacgtgcatgatttaaaacctttaaaaattctaataatcatatataactagcatatggatgatttcaatttgattaaaattctaataatcatacataattaacaaaaaatctaataatcatatataactagcatatggatgatttcaatttgataaaaattctaataatcatacatatttaacatatgctatacaacaattgatttgtatggatattcagtacatccaacatagtttacatcgtgtatagaacaattactgcaatacatcggcggtgacggttgaccgcacgtactttctcctcactattggtccttccttgtgatcgctacatgagtaaggggtgtcttcatttgataggaggatgctagggtcaatcgtcaccgtgaaagggggttacccatcaaactgatcgtaatcctcgtcagtcttgtcctctactccgacgatttttttttttcctgggagaaccacgtggcgcttcggctcgtcaggccctttgcccttttttcctttgctagacatgtccttgacgtaaaaaacttgggttacatcattggcaaggacaaaaggttcgtccgagtatccaaccttgttaaggtcaactgttgtcatcccaccgtcatcaatcgttacgcctccaccagccaacctaacccattggcaccggaacagagggaccttgagaggtccatagtcaagttcccatatatcctcgatggcactgtaatacgtgccagttgtaccatcgtgtcccatggcatcgatacgaacagcactgttctggttcgtgctcttcatgtcttgggccctcgtgtagaatgtgtacccattgatttcatatccctggaatgtcgcgatcgagccagatggtctcctcgccaggaaggccagttgttggttaatcgtctcgttacccatgagatgttgtcgcagccacgtggagaaagtatcaatgtgatgcctagtaatccatgcatcagacttaccgatgtttcttgcgcgaactagagccaagtgctcctcgatgtaaggagccaccaatgaagattgttgcagaaccgtgaaatgggctttacggaataaattgttgtctaccgtcattattgctttccttccgagagtcccctttccccgtagtctcccttcatggcgtgattcaggtaccccgattgggcgaaggtcttcaataaattctacgcagaattcaatgacctcctctgttccataccccttagcgatgcttgcctctggactagcacggttacgaacatacttcttcagaacgcccatgtacctctcgaaaggaaacatgttgtgtaggtacaaaggaccgagaataccgatctctttgacaaggtgacaaagcagatgcgtcattatattgaaaaatgaaggtggaaatatcaactcaaagctgacaagacattgcaccacatcattctgcagggcttttaatctatcaggatcgatgaccttctgcgaaattgcgttcatgaaagcacatagctttgttattgttgcccggacattgtctgggaggataccccttattacaactggtagcagctgtgtcatcaacacgtgacagtcatgagactttagatttgtgaacttcttctccttcgtgcttattattcgctttatattcgtggagtatccagacggtaccttgatgctctccaagcattcaaacatacttttcttctctgccttgctaagagtgtagctggctggactcaagtaatggcttcctttctcctttggttccgggtgaaggtcaccgcgttgttccatatgcttcagatcattacgtgcttccagtgtatctttcgactttccatatacacctaggaagctaagaaggtttacgcaagattcttagtgaggtgaatcacgtcgattgcgtggcggacgtccaagaattcccaatagggtaactcccaaaatatagagttctttttccacatcgccgcgtgaccatcttcgctctctataggctggctaccaggcccctttccaaacactactttaagatctttaaccatagcaaacactgttttcccgctgcgatgtttaggctttgtacagtggtcctccttatgttcaaagtgcttgcctttcttccgtaccgggtggtttgctgcaaggaatcgacgataacccatgtacacaaccttcctacagtgcttaagatacgtactttctgtttcatccatacagtgagtgcaagctttgtaccccttgttggactgcccggataggttgctaagtgcaagccaatcgttgatggttatgaacagcaacgctcgtaagttaaactgctcctgtttgtgctcattccacacagggacaccttccttcttccacaacagtttaagatcttcgaccagtggtcttaggtacacatcgatgtcgttaccaggttgctgtgggccttgaattataagcggcattattatgtacttcctcttcatgcatagccacggggggaggttgtagatacacatcgtaacgggccaagtgctatggccgctgctcatctctccaaaaggattcatgccatccgtacttaaaccaaaccgtatgtttcgtgcgtcctttccaaagtctttaaattttctgtcgatgtttcaccactgcgaaccatcggcggggtgtctcagcatcccgtcctgttgacgctcttcagcgtgccatcgcatcattctagcattccccttgttcctgaacaaacgccttagccttggtattatagggaaataccacatcaccttagcaggaattctcttcttcgttagctgcccgtcaacttctcctggatcatctcgtctaatcttgtatcgtagtgctttgcaaacagggcatgcttctaggttctcgtactcctcaccacgatataggatacaatcatttggacatgcgtgaatctttctgaacttccagtgctagaggacagactatcttcttagcctcgtacgttgtcttgggcaacttgtttccctccggaagaatgttcttgacgagtttcaataaattaccaaatgccttgtcactaacaccattttttgctttccattgcaagaactccagagtggtatccaactttttgtgcccctgctcgcaacctgggtacaacgatgttatgtggtcctctaacatcttgtccaatttatgggcccccttttcactttcgcaatcctccttggcgtcctgcaacatctgaccaagatcatccgcaacattgttaccatcagcatccctttcctcctcgcccgtttgatttccttcaaatccagcgtactgagcaaagtccggaatattgtcgtcttccacttcatcttcttccatttcaacgccttgctctccgtgggatgtccaacaattatagtttggcatgaaccccgactcaaacaagtggaaatgaatagtcctggatgcagaatactccttctgattcttacacttattgcatgaaaaacaagtaaaacccttttgcctgttagcttcggccactctcaaaaaataatgcacgccgtcaataaactctttggaccgccggtcagcgtacatccattgccgatccatctacatgatatgaaaaaaaatcatacacacataattattcgtacaataatgacagtcatacaataattataaaataattacaaactctttcaacactcacacaataatgacatatcattattcatacaaatattatgaaatattacaccgaataattatatatttactatttataaagttttaaactaatattaatgtgttgtacttattttaatttttcattttactttgttttctatcattcaatattaactttcactatattttccttctcaactattttataaaacattctttagcaaataaactaaatttctatatattctttcttctccacacaaattttctctcttatcaactaacaacaaaattttggagacaaaaaagtgtgcaaaacatagctccaaatgtaatatgaaaaaaaaaacattttagtatgaagttgctaaccttttaggcacctccgatttgtatataatcaccaaaataaattcactagaaattttggcatgacctcccctcttttttaaagaaattttgaagcttgctcgggctggaggaggaagaagacatatatatatataggggtgggactttaggcccggttggtgttatgaaccggggctaaagatcgccgagatctttagtcccggttggtattaccaaccgggactaaagttacgatcgggactaaagatcccgggggggcctgacaggccctgacagcatttgaaccgggactaaagatcaaatatgcccgttaccctttttaatcaggactaaagatcatctttagtcccggtttttgttgcaaccgggactattgtggaattagcccgaccgacgaaatatggtttctccaccagtgatcaagtgtcaactgaaacactgttgtctttgactggagagagcacctacagtgcagctaaaaattgttccattccgtatcataaaaattgttttaggtatgtcctaaattaaacttcttcacgtttagaatgagttttataaaaggcgtagtaacgtctataagatcaaattaataagttttattaaatacgtctttatagtatatttattttatattaaaaatattccttttttttaaaaaaacttggttataccttagagaaaaagtttgacttgggataaacttaaaaaaggcttatggagtagtaatatggaatgcaggcagtaccatgcaggcagtaccacagtgaatagattaaaatcgaagttagatcgatcccatcatatgtctagttcaataaaattaacttaaatgtatatttaccaaaaacacttaaaaacaattttaggtatatatatataatgtaagttttatttattcagttacgtgtacgtctattctgcggatggatatctaatatgcgtaaatcatgatatgaaaaaaaaattccaacattttagcatatgcctacaggaccactgaattttttcgctctaactaaattgaatgtgcttaatttaataattgtagatgcgcacatatagataatcttttctaaagccatggcttatataaaaacgtacgtgctggcgaattgctgggaagctggaagcagatatcactcacgcaatacacctcgtccaactaatttagccgtataaaatacaattaaacagtagtgcctgtgccaacttgctctaactgttttattaattgtcagtgctagctagctaggttaatcgcgtgcgtttgcgtgagtatacctagtatattacttcctccgtttcacaatgtaagactttttagcattgcacacatttatttaaatgataatgaatctagacatatgtatgtgtttaaattcattatatgtatttaggtaatgctaaaaagttttatattataaaacagaggaagtatgtattaatataattaaaatgaattctagctatatctctcgtgctgtcgtgcacgctttctcctgatttagcgtgtgaagtcagtggctaacgtttttattgatccaaacacttgcctgacaaatcgagagttgttctgtcagctgctaaattgatcgatctgttcggggcgcgtggatacaagaagctggagcccctctcctgacctaagatatctattaaaattgtactataaaattttacaaattagaagataaaaataaaattatgtaaattatatttattgagccttaagcttagaaggattctggttccatatttgttaattaaccgagttcatctcagggtttgtttttacaatctactccctccgtctaaaaaagacaaaccctggtttccgtgtaccacgtttgaccgttcgtcttatttgaaaaaaatataaaaaaaaataaaaaggtaagtcacgcataaagtattaatcatgttttatcatctaacaacaataaaaatactaattataaaaaactttcatataagacggacagtcaaatgttggtacgaaaatccagggtttgtttttttttttgggatggatggagtaattgttattataattaattttattagaaaacatagatcaatcatatttttaattagaaaacataaaatttcatatgagtagtactcgcttcattttatattataagatattgcgattatttttaatctaacatcgaataattttgatttttttagaaaaaatgttactatgttattgtaaacttaattttgtatacggaaagaaatcaaaacatcttaaaaaattaaacggagctagtagttaccggttttaaggttttaagggttgtataattcataactaaggtttcgtaggtttgtcatactttttttcgagcttgtcaaaagtgaggcaatcaaaatcctgatcacacttgagccagtaaaataaaagatatatgccacattttataagtcactaacatatatatgggacctatattacagaaacgtaatattgtcatgtttgtggcaacaacgcaaacacgcatgtcaaaatatctaatcacagattgttataaaatacggtaatggccaaccagacagtttcttagtaattagcttcaccgcttattattgttatgaaataaatagatgatcacatctatataaaagatgggatcggtaaccgaaggttgcgcacaacagttgtgtcgtacccctcgccttctcggcgctccttgacaacgggcacgatggttcccaaccatcacgtctatggtggccacccattcctgtataatcgcattgattaataaagtacacaactattctctcgctcccacaatctcaattccctattcaacatattatcagaacttcactcttcgcgagaagaagaagagtagatggagaaaagaaggtatgcgtaccttcgattcctttctcggccttcctcgccgcgatcgtgttcgccgccttcgccatctcctcctattcaacaattttcatataatttgacgtgacttttaataagccttcaatcgtacatggaagctagtgacacgatcgacaaatcaatgccaattaaaagtccacaaatttagcaacttaaataaataagtatttaattaggtctatgtacacataacattagaaaaattggcacgtctaggaaaggtgactgatgaagataatgcattgttcttatcattgacacgtcaccctaatttggttgtcgtaacttcacacaagtacacaagtgatacatgcattagttcattactcccccgtcattttttttaaatttttagcttttagatgtctactccctctatcaaaaaaaccaacttaagagttagatgggacacaatctagattcgttgtactatattgtgtcacatccaactcctaagttggatttttttttttacgaagggagtatctttttaggttatagcgcctactagatctcttaataccatttcatcttttttttattttagccatcaaactattagtattctcttcttctcctaagtttctctcccttctcattttccctgtgaaaatggatggtgtgtacttcccctgtcttataatacatcaacataatatcagatagaacatatatactagtattatgaatctggataaatttgtagcactagaatgttttctatttgatacaaattgttatatttttaggatgtagatagttttattttaacatcttccttgtaaaaaattacatcacaaattctaaaaaatacatcacagattcccatcacacacaaatcaaatacatcacaggataaatcataaattgtaaaaaaaagaaaaaaaagaaaagnnnnnnnnnnnnnnnnnnnnnnnnnnnnnnnnnnnnnnnnnnnnnnnnnnnnnnnnnnnnnnn

SEQ ID NO: 5274 - DNA, 4036 bp, Oryza sativa
caattaatgtattgatggcaagctcaagaactaacaagcaatcagtcagtaatccacacaaaaaatatactaattaccaatcatccattttatgaaccatacctcaaattaaatttgcagcatatatatggatgaatatcactccaaattttgcaacacggattatcacctttcagtaagttacacacatgcataacacaatattcaactattcataactattgttcacaaatgcattctgacatatcatcatgtaactattgttcacccatcaagtagcagtattcctatatagcagttatccatcagctcaaatagctattacataagagttcaagtgcatagcaataattacataatttagatgtaactaaggttcttgtaggtgtattgaggtcccaaaaacaaaccaaatcatctcttttatggttcttgtaggttcttgattttttttacagcacctctgctagccctttttatggttgcctgcaaaataatggacagagtaaatgaaatgaataatcatcagtagtgtacagagtaaacatatctagtgtacagagaaccacagaagaatatatatagtccatggcaattagaatagcataacagataaatttagtgaagagcaaatggctaattcaaagaccctgtcagaaagaaaattgtagcctgtaaaactaccaagagagcaccttcaaagaccctattgatgagtcagtaatcagtacatatatgagaaaggaaacaatagaacttctatgttgtaaaaaagcacaaatgcattaaggatctgatttgcaactagtagagatactgccttcggagttagtaaatctgaaagatgttttaggctacaagcattggttatcctttctaacaaaacaataccaattgttcagcttataaagtgcacactaactattgggtatatatcatgatgatggatatagatgcaaggcatggcaaattaagtcagagaggcaatatatacacaaaaacatgttgcatcatgtacaaattaagtacctgctcgctggttagtctttgctgtcttcttgtgtaccttcttttgtagctgtacattattaacacctggaacattttctgcttacatatgaaaagagatgataagaacttgatatattcatataccttaatcttattaacgatacatgcaaatgtcgaatgaaataccttcaccagctaagggcatatttcgaggatcattagcatcaacacctccattttctgcatttgttcgtgtcctaggctataatattggacctccaactactactccatctgtccctgagttgtctacaagaaaaattctaagtcaaacattttgcatgcattacatgaaacaacaaatctcagccatctaattatatgaattggtaaaaaaaatcagatcatgcttcattaaaaacaaagcaaaatcctgaaacttaattgaacatctaatcctataaatatcagttactgaaatgtttgtaatgccgcacttgtgacttagcagtgttaagctaggaaaattcagagctaacatagcaacttgaggccaggtcaatattcaagctaacataacataaaaaaaattatgtactccatctagcagaaagagcagcaacagatgttttctagtatgcccttttcagaactcaggcttctgaaaagtcagaagacaaaattcagggaatgagaagtgatccaaaaagcaaaacagatattaatgcctctgttaggcccaaaggacatatagaaacttgtagccacacacagcctctaacaaatagcatgcatttagaatcaaagttcttaatttcgacaaatgaacagagcaaggccacaccttatcggtggcacttccagaattagcatatgccatgaagaccactatgcagacaacaacagatgtgctaaattaagcatatataggattcaacatgaactcatggtcacagatcaataccaaaatgagttcaccgtattttcaaccttaatcttaattaactgcagccagactgaacttacctcatatatgtgtttgcagagtataagcggattatgagtttataactgcaggaatacaaacttagaaatgcagaggtgtatacatctgcaatatgtaattaaacacaacaccagcggctgctaggttttctcagttctggatggttttatcgtttatatttaccagcacacagtttagacaaaaaagcacccattgtactataaaaaacagagcgaaactctggaactttactgaatatctaatcctacaaatatgagagcaatatatttccggggcacatgcatcatgaggtctgttgaacatcaagcagagtgaactaggaggaatcttatgatttactagtgaaggtcatgatacttaaccttagcagcttaagaatcttatgatttgttctaattctttataccacaaagggtgcaaaagtttctatggaaagcagttagaaacaactacagtccatactagactggatagttacatgatccttttctgaattctttgatcataaagtatgagttccaagatacaggactaaacagaggaaactacccatcatatagtatgagtttctgaattctttgtatcaaaacttgaaaggaaagggccgaagaaatcaaaggcaaaaggggaaaaactgcaagagaaatgcagtccatcagtattgataatcactacccattcagcaacaacaagcagagtgaactaggagacctcgtcggcgaccgcgtcgaatgtcgtcctgcccctggacctgcgcacgcacaagtccgacgccctcgcttcctcctcctcctctacccggcacacaccaccacctgcaaccaacaccaaccccaacacccaagtcaatcccccagatctggacgggcgccccccaaaccctagcccgtacaaacctgggcgggcgcgaggtcgactccggcagcgcggtggatggggagagaggagcgaggtggcggcacgccgcggcggaggaggaggccgcgcgccgcggcggtggatttggcggaggaggcggtgcgcggtggaagggggagaaatggcggcgcgcggtgcgagcctagggttttcctttttggggtggattttcttttcggcgtggtttttttttttgcgcggatttttttgcgcttctttttttattttactgcgcaccgatcacctcgctctatcctaaccgtgggatcaacatccaacggacgaaacattgctgacagataggttatcattaagttttcctgacatataattggtttccactcttaataatattgctgacagttattttgacccaataaatatttggaattgctaacatataacatgtcttattacatagtattgctgacatataatttaccaaaagcctttaccaacaaatagtctatcaataattgtttatctttaccgacagatgtctgttggtaatctagtgtcatggtgtagtgttataaccgggactaaagatcctcgagccctgatacggtctgacatggaatcaaccgggactaaagatgaactttagtcccggttggagttaccaatcaggactaaagatgatttttagtcccggttggtaacaacaaccgggactaaagatcttcctcttataaaccgggactaaaaattatttttaattccggtttttaatggaaccgggactactgtggatttgggtcgaccgaccaaagatggtttctctacaagtgataatgggaattttggcacatatatattatcaataagacaaaggtagaagtaaaccgtcattgtgcctaaaaagtaagtttaagtaattggtaatgagaaatttggcacatatattaagccaaaggatactagtaaagccgtcattgtgcctaaaaatcaaactaagtttaatattgagatattgcaaacggtctagcattttcagctcaaggacgtaattgttgcaaatttccctcactgccattcctaatttaggtcatttttactgtacacttattaaatgccagt

SEQ ID NO: 5275 - DNA, 14405 bp, Oryza sativa
atattaaggcaaaggatactagtaaagccgtcattgtgcctaaaaatcaaactaagtttaatattgagatattgcaaacggtctagcattttcagctcaaggacgtaattgttgcaaatttccctcactgccattcctaatttaggtcatttttactgtacacttattaaatgccagttgaaattaagaaagagataaggcgtggttaagttatatgcgtacttgaattttccatttactatgagtatacgtgttcctctcattaacgattacactcttcatgaaaattctctctctttagtcttcaaattaatttgtctttctcttagagactttatgaaatggggataattacaggtagaatacatgtataaccaataagaccttagatggcatgtgatcagatgtttaggtagtaggtactgcgattgcttgcatagtcatgataaagtactagaagttttcaatctttcagaaagtacgagaaatatatatataggtattaaaattttacactaaaccgatacactttaaatatggtaattaaagttatcctagcaaacaattgcatagtgatgtctagcagtagtgcaatggttcacattcaatccgtggaaggagagcactaacctaaccattgaagttgaggctggccccaccacctggacggcattgctttcatagtcatgttaggacagataataattaatccatgtaagtcgttggtttgatcccggattattttccatatggactagcctacaatattaatcctatcaagcgtcatatgatccctagtaaattatacaatttaagctaatttatatgatattaataagtactccctccgtccctaaacatttgatgtcgttgattttttaaaatatatttaaccattcatcttattcaaaaacatttgtgaaatatgtaaaactatatgtatatataaaagtatatttaacaataaattaaatgatagaaaaagaattaataattacttaattattttaaataagacgaacggttaaatatgttttaaaaaaccaactgcgtcaaatattcagggactggcgaaatatatcagttaatagttagatataactaatataaattcgccattattaccacctgataatgggcagaaactccaaccaccgacacgcacgtacgacaaggcttcacctggacaggctgatcgatcatgcgccacttcttgctgcctgcagcctggccccacacgcactatttgcttccgtagagttctttttcaattttcaaaaataaaaaacaaaaaggaaacagagaaaccattttttttatcgtggcaggtaattatatagatatttcgtcatctaaagttgaacaaaattaagacttggctaccgattccgcatatataaatttatgtcttagtatacttttatgtttgttatatttttttatactcttccgtcctataatatactccatccatcttaaaatataagagattttagagggatgggacacttcatattactacaaatctagacaagctctttatatatatttatagtactagaaagtgtcttatccctcaaaaatctcttatactatgggacgaagggagtgccaacttaatactgacatttaatagtacgatgaatctggacaccctcctatctagatctgttaataaaattcgttatactaagattttattcggtattagattgatatattatgggacggataaagtatattaaagaaaataagaggtaaaggtgggataacctcgagcgctcaagatccatttcggattggcgcagaaatcagctgaaaatcaacagagcgtccttgaattgtcgttttccatcacctccgttctgttcaggtgatcacgtcgccgtttctgttcatgatgtgcaaccacaccatccagtggatgatcagtgatcacttccatgggatcagatgatgagagaactctgcaactcgagtgcgcacgcctactccctccctccaaaaaaaataaaaaaaaaagacaaactctggtttccgtgcttaatgtttaactgtccgtcttatttgaaaaaattatgaaaaaaattaaaaagataagtcacgcataaaatattaatcatattttatcatctaacaataataaaaatacgaattataaaaatttcatataagacggacagtcaaagttggacacgcaaacccaggtttttttttttttttgacagagggagtatgtgagtggctgtcctgtggagatcgacgtgcaattcgaacggcagggattaatcctatggatttcaggatatgaacatgtcgaaacagaactttaatttctttcgaggagtatgactaggcaaacacatttttatacgatatctccgtttttaatatacgatgccgttgattttttaaaatatgtttaatcattcgttatattaaaaaaaattatgtaattaccatttattttattgtgacttaatttactgttaaatattttttaagcatgacttaattctttcatatttaaaaaaaaattgaataagatgaatatggttatcaaaaaattaatggcatcataatagatgtagtacgtacttagtcatcgactgtgcgtcacactaggacgatgtctgatcaacgtggtttaattttttttcttctcacatattttttttatcggttagtcaacattatttttggaactacctctgtaacaatcgatagaaaattctccaagaaactgtcggaccacgtaactaggatccaggtgaagcataaattacaaaatccaagatagctcagtgggaagtatgtgcgcatgcaattgttgggtcaagggtttgattccagcaatcacaatgcgtgaaacttttttcctatgtcaaacacaaatctcagcatatcaaacggcccaaaaattgaatgatttagaacaaaaatctatcgcaagttaattatagcagcttcattttttttgagcggttttctattttttttaaacgaaccacacaagacagcgcgagtttcatatattgataaaacaggagaaaaatacaatctatagtcctggaagaccacagaccagaaaaagaaaatacaaccacaccgcgcatctacaacaaaacccactgcacgagcgaaactgaaggtcttcgagacgacaccttcgaaaagggtacgacaccaaaggtgccgctgtcgcctgtcccagagggccaggacaaggttttcacatgaagaaagtaattgggagagacaagaaaagcggcaacaccccaagaggaaaaaacggcacccacaggcatcgttgttgccggcccgaaggcagagctttcgcccaaaatttgtctctcccaagaactgaactcctacacgctccgcagccaccaccagcgaaaaccttcgacgcacggccaccgcaccggcgccacgccgccagtcaatcgccatggggaagctcgaacctcgacacacaccggctccatccacgcagttgggttggatggggagagggtgagagagaagaatggatgccctctcccccacactagcctgcccgacgtggccaacttttgccgacaaagtcgccgtcgcaagaggacatatgtctaggaaggggaacgtcgagaggaccgtggctccccctgacagagtaaccgctggctccgccacgaatccgttgtccgtgtcacctcggaccaccagaccgcttcgccggcgccatgccaccctccgcaccgtgctgttgacccatccgccacagtgcacccgccgtccaaaacgatgcggcactagaacgtccaccgaagcatgatgctctcgccccaaatccggtggaggggaccgcatcttgcccgggggaaggcagacgcccagctgtcgtgcggcgttggctgcccaccgcagcttgggctccgctgccgccatcaccaccaggctccaccgccgccaccactcagccccgccaccagcccccaccccgccgccagcacagccaccgtgccctgccaccatctcccaccccgcctccagcaccaccggatctcgcgcgcgccgcgccatgcacgccgtcgccggtcccgccgaccagctgctgccgccgcctacgcgtctccgtcgactgctgtcaccgccctctcgactccgtcggtcgccgtcaccactgccttccgccacaaacctcctcggcgtcggccacctccgcccgccggccgcagccatccagggggactggatccgccgccagagtggccggatccgtcgtccctcccaccaacggtcgcggtcgccgcctcccacgccgcctcctgccaagagcggcacgcccctcctgatctggccgcgatagggccagatccacctccggcggagccggatccgccacatccggcccagatggcgccggacactgtcgccgtcgtccgctttgctcaggtcccgccggtgccctagccgcgcttctcgagagagggagaaggtcccgccgccgccgtccttgccgccgcgcagctttgccggcggctgctcgggcggcggcgaggcggaggggaggaggagaagtttgtggcggcgcgcgcggtgtcgccgcccgtgtcgccctggggcgagcgacgcgggcgttggggaatagccaaacatctagtgagcggttttctatatacatgagattaggatgggagggaagatgatgattgtgcttttaagacagtagagatatctccctgcaatgtgcacaaacaaaggaccttgtagagtatgaagtgaacatatcttatccattaaatgtgcatgtgtgtagcatgtgctctgagaaatagttcgatatgtgatagtgatatgatatgtatctaaagttttctataaattcaaattgacaaacgactattcatctgagtcacaaatatatggataagatcgaattggatctacgtataggagtcttgtaaactgcatgaacgaccttacccggccgtctatacgttgatagctagggaaataatggatgaaattaaaagttttccgtctatcattggaattttctgtactacagggtggctatttgaaaaggtaattaagtttcagaaaagaaagtagctatctgatagattcaagattgcatgcattttggctaacaggggttccaaaagcatcattccaacccgattcatcaagatcaattgggctttatcaaaggaagaaatatctctgaaaacttcatctatgccactgagctactacaaacctgctaggacaaaagatgttgggacagcttcaattgatccttaaagctcacggcatcccacaaatttggcaaacttggattgcaaacatactgcagacatcaaaatcagcagtacctcctaaatggaatacatggaaaaatggattaaccgcaagaagggcctgcgccaagccggatttttcacaatttgttccttttgaaaaacttatttcataaataaactcctgaaaaaacttattctagaaatgcctttttggaatgccaaaggcactggcgtcgtcgtccaacgagaagcgccgtcctcctgccaccgtagcagggcggcgctaaggtggcagggggagcacgccaatgtggctggagctgccccccccccccctccacgccatttttaattttgggataatttttttaggggtctatctgcgaaataagttttttaaaaggatcaaattggcatgcatgcaggtcgactctaaaggatccccccatctctccctgcttgttcattttagtttctaatgtgctgcaacaactcatgagacaaaatgaagaattcaagcaatctaccacagcagtcctgtgccaccatacagtatgctgatgacacccttatcatttatcatctgccgtgcaacggaaagagatgctagcgtcctaaagaaaggactggagcttttcgcatatgctacaggactacatttaaacttctccaaaagcaccatgataactcttcacacaagcctagtggagaaacgataaaattgcaagacagctacagtgcaaaaaagaagaactcccagtgtcttacatggtcttgccactatcaattcaaaagctgaacctgagagacctgaaccaaccattgcaaaagctgacaggtaccttgctgtcgggcaagcagtgtgccaaaaaaattttaagtatacggacacacatttaaaatattaaactagactaataacaaaataaattatagatttcgcctgtaaactgtgagacgaatctattaagcctaattaatttgtcattagcaaatgtttactttagcaccactttatcaaatcatggcgtaattaggctcaaaagattcgtctcacgatttacatgcaaactatgcaattgttttttttcgtccacatttaatgctccatgcatgtgtccaaacatttaatgtgacagaaaagtttaaagtttgaagaaaaaaagtttgaatctaaacacagccctactcagaaaggatcatcttgagtcaaaaataatgcattccctcgtcctaaaatatatatactacatacgtctcaaaataattatatttaaaaaaattagagacagattagcaacacacaaatgactataataaccctatttaatatccacaccgcatgcatactttttatatgtaaaacttgattaaaatgagggctaggagatttggatagagagatgggaggctaggcgacagcatatatatcttcataaaattaatttgttaggtcttgtctcattagaaatattctttttacaaaatttaaatattagaaatacaattattctaacggaggtaacaactacttcaaattcaaaatttatgacaaatataacaatatagtaattataaaaggtgacttcccactaaattaactatacatatactacacttaccatctcttgtctttatcataatccaaaaagttgacaagtttttatatcccatgataaccgtgttaacatggttatactactatagagagagggaatactaccgaacatccgatgacatcatggtcggctgtgatgacttgtacaatcaatgcacgtgtggctgagatgaattagcacaaattactcccttcggtttcattttaattgacgttttagacaatgatatggtctacaagatatatctttgacattatttttctattataatatatataataaataaatgcatgctttaaaagacatatatatatatatatatatatatatatatatatatatatatatatatatatatatatgttgttctagttcctttaaactaaatatttttaaagttattgatggttaaagttataaaagtttgaccttaatcttgtttaaaacatcaattaatatggaacaagaggtagtaaaccaaaacaaaattattaatagctctaggagtctagctcatgcgtgcatgtcttccatgtcccatctctcgatcagcttgattaacaaaaggatatgattcattaagcgttttacaggcaagggtgacgtgaaggttttggggattaaatggaaggccagggactaatcaagcctaacatccggttttatagagtacagtatgtttaatcaacggaaaatttctttgtttgggccggggctttgagcgtgatgtgactaaaatgtaatcaattaacgccccattcttttatgtccatattttcttttggaagtagctatccaaaatctaagcgtaaaaatatactaattgcccaattgcgctggttataggttttgcacctattcaacagctgttgggttcgtttccatatgcttcattttattttttctgatattttcaacaaatacatcatcctttttataaatgacacaaaatatatatttttaagataaaatctattttaagccactgaatttatcctacttcaacgatttatcatcgattttgtctccctatgtaatatcccatgaactttgttggttttttttacaacatgacatttgggtggtagataattttaagaaatgactaaaatgtccttcaagtcatacaagaattgacaattgtttgaaccactaaaaagttttcaaaaaaaggtagtttttgtgtgcttaaccttcttacaaaatatagaagtttgtgtgtaaaattttctttcatgtttcgtttaaagaaactatttttatgtagcatataaaagaggaatcaaatacacaacatatagctgcatcagaaaaataatgtatagcatttaatgatgatgtacataaaagaacattaacataagagtattgtattagcatacaaaacataaattatatattctttttaaaagttaatacatgcaaaatgaaaattttcaaatatacacacatttctatattatgtaaggaggttacgtaaaaattttcattttcttgaaacttctagtaggtcaattaattataacctcttgtaacttgaaggacattttgagatttattttttaaagtatccaccccagtgacatattgtaaaaaaaaatttgataaactcaatgacatattatacagggagataaaaccgatggcaaattgttgaactagaacaaaatcagtgcaataaaataaatcctttatttttaaatgttatagtgtaaatcttaaatacaaccctcgagatcttctgcccacccatataagctcatacatgcttatatgaagaaatatcacaactggctacatattttcaaggaaaacaataattaaattttataaaatcctacctactccatctgcaccatattataagggattctaggtggatatgacttatcctagtactacgaatctgaacactaccagaatgagtcacatccacttaaaatcccttataatatgggacggagggagtattatggtctgttgtggttcaagttatacaaaaccatatggatttagacacgtggttcataaccctgggtattatgatcctaaagtttaacaaaaatcacaccactaaccattttggcttactcctatatcaaaatttaacactcctatatcaaaatttaacaaagtggttgtaatataagtttaaaatgtgattgtaaaacttaagaatgtggtagatcaaagtcaaaatgatcatgattatgatttcatcaaaccataatacctaagactatgtgtcacatgttaaaagttctattctgtgtaacttgaaccatataataatagattaatatatagggttttatgaaatttactttaaaaaacctacagcaacaacgctcaaaatggatgctgggtcatttaaggattctagttgcattcgagttttcttcagccgattgaactcatgggcttaacggcaacgatctgtaggccttgcaatgcacaagcatattgtaggcccatattttcaaagcacaagcatattctaggcccatataggcccaggacatttttaacgaataattgtatttggaataagttcgtctgaggtctcttaacttgtcaacgaatccgattttcgtccctcaaccggaaaaccagacacaacggatccctcaactatcaaaaccagtgcaaatgaggtccctcggcggttttgagggtggttttggctgacatgatgcctacgtggctaatttgactcggtcttcatctgacgtggtgcttacgtggcaattcgacccgagaaaataataaacccgtgggatccacatgtcagtttcacacataaattaataaaaaaaatggtgggccccacatgtcattgtcattgtcaccccctcttcttcctcctctccctctatctccctctcttcatctctctcccctatcccctctccaggcgcgacggagaggcagcggcgcacggcggccgacgggagaggagggagcggcgcggcggcggaggcacggctccggcagctgtgggcggaagaggaagggacggccggagttggccctggctacgacagacggcaggacaggagctgcacaacccaggccccgtcggtgccgactccttcttgatgtcgccggcgccgccaaggctaacgaggtggacgcggtggtggaggaggaggacgacgacgtacggcggcgcggcgtggttccaggagcggaggctggtggtggtgctggtgctgccgtcccagccgatgtgcgccatgtgctggcagtggtggagaagcctcgccaccagcgactcccccttgggtttgttctccgccgcgccgccgccctcgccactgccgccgcctagacacgcacacagcatcactaacaccaaactcctaaatcaccccgcaaaaaccaatcgacaagatcgagcagaagtgaagaacaagcatccaagactccaaacgacgaaccttggggcttcttgccgctcttgccgctgtcatcaacgacgtccacgctggagcatttggcaggtggaggagaaggggatcacgatgaaccggtccatctgcttcttctccttgccactactactcatggctagctagccactgctagctaagctgatactatcttcgaatcaaatcgcttgccgcttttggctgaacctgtactggtatgatcatttctagtaaaagaaatgggggtcttgacccttgctcaaaaaaaaaaatcttggaatcaaatcaatgtctgcgacagcggccagatgctgagcgacgggagcagcgcctccgcggccttggtggctagtgccgcgggagcggcggcggagcctccctccgcgacagccgacgcgtgctggctcccctcggcggcggcggcagcgacgttgctggggcgtcctccgccatggctgcggtaagtaggagagggagagatcaatggcgtggagaggggagagaccgagagagagaaaagaagctccacatccccttcctcttccgcccacagccgccggagccatgcctccgccgccgtgccgctccctcctctcccgccggccgccgtgcgccactgcctctccgtcgcgcctagagagaggataggggagagagatggagagggagaaggggagagaagaggaagaagaggggtgagtataatatgtggggcctatatgttatagaatttggtgtgtggaactgagatgcagttgacactggttgtaagattggtggggatctaaattgccacttaagcgtcatgtcagtgccatgtaagatgaagatcgagtcaaattagccacgtcagccaaaaccaccctcaaaaccgccaagggacctcatctgccccggttttgatagttgagggacccgttgtgtctagtttttcgattgagggacgaaaatcggatttgttgacaagttaaggaaccctagatgaacttattccattctatttttatctctctgatctcctcctcattgaattgcatccatataacacatctcccgtctttcaaatccaatacaaattgactgatccgatgattttagaaagtgggttttgcagacatgataggttgatcacgattgactcgttgagtcaacaggtgagatccacatatcagagtcgttcctcttcatctcaccttcttcctcttctctcccctcactctcctcccctcttctatccctccctcctccccttccgatggctccatcggctcctgcaaaggaaagggagaagtcccagccccagcaaggagagcggggggaaccatgttgagaaggtagtggagataggcgacaacaacagggagagggagccactgcacggggaggcgctgactctgactcgcctagagcttgccgcgctggcgatgatggcagatcaacggttggtagccatagaaaaaggcgaggggacgacagagaggagcggtcaccgccatcaccacggagctagtcctagaacctcggccagttgcggtgcacctcattccatccatggagggagccctacctagcggggtaacaattcgtgaagacgaaatcgttgttggcgccgagcagcacggctccgaagaagacgaaggagacatcgaaacgtgcaaaacaagagttatttggctctggcagctggtggcaactagggctgtcaacaagccgagctcgacacaagctttagccaagcctattacacctttgagcttttaggcaagctcggttcgagctcgacctcagccattaataatataatatatatattaatgataaattttttataagtataattatttctatttgatcgcactaataaaagagtagaaaatgactaagataaatatattacgctaacacatgctaatttgctgtgtaaatagatactaatatatatgatatattagtttattaaatcaataaagcgaataaacattttgaactatacacatttgcttagtagaggttcgagctcggttcggtaaagctcgcgagtttttgcttaggctctggttcggctcatttgtagctcgagtcgagctcgaatcgagctgggacaagtcaagcttgagctgcttgcgagcctcaagcttttttaactcctcaaactcatcatcagaattgaatttgttttttcaaataaagtaggttgttatacgttagaacgcggttcatgccacccgtgatagacataagcggtcattctcttcacgattccgtggatcacgcgaatgtcctcgtcgagcaatctgttcaattgttttgcttgctcagctttacgcatacttcatccgtcccacaaaagcttaatctaaaatagaatgtgatgtattctttggcaacgaatatcaacacgagtcttcagatttattgtcctaatatcccaggttgagtttttaagggagtacggagtaagatactggaaggaagagcaggtagtaccacgtgagactgacgcgacacaacaacggctgcacacgtacggccggtcgccggcgacgttgccggcagcccggccggccggttcgaccgaccggagttagcggggatatttttgacgactttaattgtgtgccggccggtgacgacggcgcccgtagtttcggccgatgcgtgccgtaattctgggcttctggctcgtctctttctctctctcccctcgcgatatctttgcattctcgcggggactttcgtagcggcaacgcacgctacggcacgcaggcggtgggggaaacagatctttaccgcggcagaattacttgtgaggtggggaggcggccaggcccagctgtaccactcttttttccagatggtgaaagctttgtatcactatctttctcttctttccttttttttttcatcatgcacaaagcactacacatgccctactgaaatcatattcaaaacatgtattcatggacagcagaatttagggcccctttgatttgaagtaaaaacataagatttttagaggatttgaaacatataggaaaatttcctatgaagccctttgaaataaagaattgaatcctatcatatcctttaaaattcctatggaatgggcaatcctatagagattttggaggaaatttagcaagagctccaaccacttggaaacattcctttgagtctatctctctcattccattcatgtgtttttcctgcggttcaatcaaacggtcattcctgtgtttttcctgcgttctgcaatcctctgtttttcatttacattcctgttagaatcctacgttactttttcctattcctccattttttcattcctacgattcaaaggggcccttaatctttggtgatgggtaacacccataactctatcatcattttcattgatttcctttgcaccattctctttcgattacacatgacatacacctatcgtttatcctaagacggttatgaaccgaataaaaaattagttttaaattttgattttagagttgattttagggcttttatcgtattttatttccagcatttgctttaaattgctatacatatgtatatagaagttctattaacaaagtatatgttggttgctgataagcctttatgtatataatcagtataagtgaaacgatggctgtcatgcgcgcacgcaccgtactgtgtgctcatactacatgcacattagcacatacatgtaaaatatgccaccaacacatacccaaacagggaaaaaccaacacggcaatacgttcgaagagacgaacaccatcggtaaacctttatctcaacaaattcgtattaaaagctagtccttagtctcgctaagttttattgaaagtgcaatcatatatgcattatattcttctaacttgaattagtgtgtgtggagtcatgtacttacaactccactagttacgtctatggttgcaagtggaccaacccacgaatccgcatgtaaaattagtgggtaacccgcgaatccatttgtgggtaatttgacctataaatagatttatgtatctacccccctacatctttaggtgcaataagctagg

SEQ ID NO: 5276 - DNA, 471 bp, Oryza sativa
atggagatggacgaagtcgggggattcgatggacatctctaggacaaatgaaggctacacgagctgcggcccggtagtcgagatgtcatggcacagggttggtgccctgctgctaggggctcagtcctgcctacctgtcccgggggttccgcccgtaggtgggattgggtcggtactcttgtctatggctaggatgggttgggaactatgtcacgtcttccgtctgtataccgtggtggtatgtggcacgtggttacacgtgaggaagatgtgtcttgtgggtaaatatgtacacctctgatcagagtataacctattcgaatagcggcgccctcggttatggccaagcggaccaatgtacccaagttagtgttttaattcttaaaacctgcttaacaactaaaatgtggaatggttggcctgggttggcttgggacgagctgggacccagggtcgggttgccagttcggt

SEQ ID NO: 5277 - DNA, 1015 bp, Oryza sativa
aattttggtagggtaccaaaccaaataagccctttattccttcctatatgttctaagataaatttatttttaagtcaacattatatctcaaagtttatgaaagtagtgtggataatacattaggagtagataaaaagaaaaataattgtattgggatttgataaaatgggaatattttagtctatttggttttgtattggtttgtgtgaaatgggtgaaaaaaacttattttgagacggagagattaattgttactattcgttgggtgataaaatatggtataacaatttctagagttaattatgggttattaagaaagcatgtgaaattaaataagagaaaacaataattaaatgaaaaaaaatcattgcaattaggataagttgagagaggaagtggtggataaatttgattgattattattggttgtgataaaaaaagtagatgtaagctgatatattctataataaatttttaaatcttataggtttatttgtctctgaataagtccatttctatgcactcatctacttctattcgagtttcatttcattaataccctttactaatcattatacctatatgaaccacccaaaaatactattatttctattaattgaagacattttgatatgattggcagtacaagtttcccagtccaaattttcccctattgccaaaaaaaagaaaagaaaaaagaaacgcaaacacacacatgcacacccttactcctatacacatctctctggtcccttctactactactactagctaggtccgattcgatcatatcgacgcgatgcaagccgttcactgaacctgcagctaagtatacgtaatacgttggcttggtgggtgcagtgcatgcactgatgactgatcgatccatcgatcgagctatatctctcgacgagacgagatccagtacgtactctttcgtcggatgggtacagtttaattatcgattgtctaggtggaagcccattcacgtactacgcgagcaagtgcatcgctg

SEQ ID NO: 5278 - DNA, 668 bp, Oryza sativa
acccgtcgtggacccgatcgatctcggccgtccgttttggttggatcgatctcgaccgtccgttcgcgtgaaccgccgccagtgcgctcggtccaccgcaaaccctagccgctgacgcaataaatccccttttcctttcaaaaataattctttattgcgtcataattcaattaaaaccggtttaagtgttttaatccgatttaatctttaaaaattcataactaattcatattagctccgatttagttggttcaagtctctaaatttttctaaaattgagatctacatgttaaaaatatccacatgtactgttcatgcttgtttatgtgctgttttggtgatttttctcttttcttcttagattccgtcgtttccggagagttcgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggatttaacctattctttgttatggcccttttgttcttgtttaccttattccttgataccttgggttattataatttgactagcatggaccttacatattggattggttcagctagatattagatgtaattgcttagccc

SEQ ID NO: 5279 - DNA, 567 bp, Oryza sativa
  unsure (1)..(567): unsure at all n locations
tagtccatggcaattagaatagcatacagattaaatttagtgaagagcaaatggctaattcaaagaccctgtcagaaagaaaattgtagcctgtaaaactaccaagagagcaccttcaaagaccctattgatgagtcagtaatcagtacatatatgagaaaggaaacaatagaacttctatgttgtaaaaaagcacaaatgcattaaggatctgatttgcaactagtagagatactgccttcggagttagtaaatctgaaagatgttttaggctacaagcattggttatcctttctaacaaaacaataccaattgttcagcttataaagtgcacactaactattgggtatatatcatgatgatggatatagatgcaaggcatggcaaattaagtcagagaggcaatatatacacaaaaacatgttgcatcatgtacaaattaagtacctgctcgctggttagtctttgctgtcttcttgtgtaccttcttttgtagctgtacattattaannnnnnnnnnnnnnnnnnnnnnnnnnnnnnnnnnnnnnnnnnnnnnnnnnnnnnnnn

SEQ ID NO: 5280 - DNA, 434 bp, Oryza sativa
catgacatgaccagttgcaaaagagaaaatgatttttttttacggttgaaagacaaaatgaaaaccactcaaaacctatacgacaaaaggcattacacacaatttcctttctattgggtgaagaaaattggtataactaaaggaacaatctatatgatgtggtgtaactatagagatatataagtgggccgacccgtgagtctacttatatgtcaaataagaagtaacactcaagtttttacgtcatggtcctagcttattgcacctaaagatgtaggtgggtagatacataaatctatttataggtcaaattacccacaaatggattcgcgggttacccactaattttacatgcggattcgtgggttggtccacttgcaaccatagacgtaactagtggagttgtaagtacatgactccacacacactaattc

SEQ ID NO: 5281 - DNA, 542 bp, Oryza sativa
  unsure (1)..(542): unsure at all n locations
ggcttgttttcgatatggtgcaaatctccgcagtttttgctttattggcttggcatcgggtcgcaccatgagtttgtgctcaatcacctccctgggtacccccggcatgtcggacggctgccaagcgaacacgttagcattgtcgcggaagaaggtgatgagcgcgagttcctatttctcgcctagtgatgccccgatcttgacggtcttgtcggggttggcactggagagtggaacgatcttgattgcgccgtccggcttcggcgtcttgtttgttttgctcactttcttgggtggctcagctgtggcgggtaggctgggcgtgtgctcgaccatgtcgaggctccacttgtcgcattgtactgccagcttagcgttcccttgaatagtgattgttcccttcggtcctggcatcttgagcacttgatacgcgtagtgagatgcggccatgaacttcgcgagtgaagttctcccaatgatggcattgnnnnnnnnnnnnnnnnnnnnnnnnnnnnnnnnnnnnnnnnnnnnnnnnnnnnnnn

SEQ ID NO: 5282 - DNA, 2280 bp, Oryza sativa
  unsure (1)..(2280): unsure at all n locations
nnnnnnnnnnnnnnnnnnnnnnnnnnnnnnnnnnnnnnnnnnnnnnnnnnnnnnnnnnnnnnnnnnnnnnnnncattctttgacatggctattgtcgtggaactcgggatagcaaccattgtggtccagtcagcagaatttgctgaatactccccgctgttctgcgtcttaatttatcttgagcaaatgtggtgggattggaattgaactagagaagggattaagaaaaataagtccatgcaaaagcataccgtaaagttacaggtaggatacgatagcatacaacgaaaatatgggaaacgggtacatttttaagttccagctgccttctatggatgtactcgaagagctgagaccactgcttcttgttttatgtttaagctgaaacagactagttcttctgaaaaataccgaaggctccaaattgatgggggcaaacagacctgaacaatatcccaactatgtcgaaatgtatataaaaaatggaagactaaaatcatgattacgatgcattcaatcagatccccgaattgtccacaatcacttgatgctttggcaattgtgtctgaatcagactgagactgaatcacaacgattcatttttcaggacaattcatgctcaggtgcaaaactgaattgaaactgaatttttagtggacatgctgaaacagaattgaaacttagtgttcgatccatgaggaaaaaaatgacccgtatatgctgaaactgaatgattaaaagtgtcaatgcgacaattccacggtcatgggagcatttcggaacaaatcttcagaagataatgagataacctagagttttatgtttaagctgaaacacagaccattcttcagaaaacaccgaaaacttcaaacaggatggggcaaacagactctgaactcaactatgtcaaaaaagaaaaatgtgtaaaatgaagaatgtctcaaatcatgatcacagtgaattcaatgagccgaattatcccccaattacttgatgctttggtaattttgtctgaatccgactgagactgaacaacaacggttcattttttcaggacacttgatggttggtgtcaggcaatgactgaaacaaaatgactcgcgtatgctgaaactgatcgattgaaacttaagtgatgatccatggtcacaatttgataagaagaacaccacaacaaaaaaatcgtcaggaactatgctaactgacccaagtgatcgaactaaactgcttgtctccctgaactttccgcagaagaaacaaatcaccgaagaacatcgatcagactgcaagatggtggattaatttgccgctggtgctggcaatttgctggttgctaggctcagctgtaaaaataaaaatagaataaaataaaaaccaccaaaccatgtcattttaaatcagcaaccaaacttgcatgaacagatgagaaatatgagatggataccagaaatgactcggcgcagtagctgacgaaggggaagaaacggccttgtgatttgcccaattcgcacactttcttgatgcgcagcgaatcgagctcgacggcgaagacgccgtcttcttccgtgccgacgaagatgacgttggggtcctcggcaactgcggccaagcacgcccgctccttgcccttggtattcccgaccggccatggcagcacctgctcgagatcgatggccacgcgccacacccaccgggcggcggcggcggcggcggagccgtcctcctccctgtcccacagggcgagcttgtggcggtgcaggactcccagccgcagcccgccgccgtcgctctccggcgccgccatgacgacggtgtagccgaggcggaggcggcgcttggcgcccggcggcgggtcgaccacccgagagcacgtcggccgaggtgatgccgtggcccaggatgtccctgccgcagcgcagcgggaggccatacctgtaccggaggaggatccccgacttgccgacgaagtaaagcgtgtcgccgccgacgagggcggcggggcggtcctcgaggtggtacccatcgaggtcgaggtggatgttgatgtggacgctccactcgccggtctccgacgagtagaagcaggcgtgcgcgtcccagaagtgcctctcccaattctgcacgccgacgaaggcgacgatgaaggaggctgagccaccacccccacccgcggcggcgccggagatgacggccgggtgggtcaaggcatccatcacgttggggatcctgtgctgctcgccggtgatcgggtcccagacgacgtggccgtcggtggggtag

SEQ ID NO: 5283 - DNA, 9002 bp, Oryza sativa
  unsure (1)..(9002): unsure at all n locations
ggtggaacgcgcggtggcgcgcggcgaagctcgggtcggcgaggacgcggcgccagcgcttgcagacggcggaggcgcggacgaggcgcgtggggtcgtccggcgggatgcggaggaggatctcgccgaccaggtcgtcgttgtctgccacggggtgacgcggacgcggaggcggtggcggtggcgccgccatgctgcggatcacggcgacggcgacggtgacgatgatcgatggcgaggggtggagattggaagaatcgatttgtgattctttgttgcttttatctggacgcacgatcccatgtttccaaacgccgaccgttggtgtcacagttcactttccaaacgcagttcagattgctccatgtgttttgtttcattcggaataagttcactttaatccctcgtatttgcttcgagtttaaatcacatccataaatcatgatacgagatataacacgtctttaacttacaatactgaaatactactaaattcacatgataatattatgtccggttttagctgacgtgtcattgagtcaaggtgaccacatggacgctacatgtgaacgggtcggttttcctactcctccctcctcttactctctcgtccccatcttttccaggcttccctccaggtggtagcgagcggtcagcaatagggagaagggcgataattaaccggcaagacaagagctgagtggcagctggcatcatcgaactagaccaatcgccgaatgggaatgtgatgggtggtgaactagaacatgcggtgggttttcgctgaactggaatgaaattgatttttgcatgcagatcttttaagtagccgtatgcgaaaatgtagaccgatgtttgcaggcacgactagttacggttcacccgtaacctaaagatgtcctcgttcggaaaaatgttttctgtagtagtgatatgacaccttctaataaaagtttgctccaaatgtcacggaaagagcaaaggatttttttttcgctgtgatggactgtataaatattgataaaatgtgttcagcatatcgttgtgaagttgaggtatgcagtgttaattttggataattacattgttatcaagctccatcatatgtgttggatagtatatggagagaggtatattgcgtaacatggatctattgtattgaacctcagggggccggtatatataggagtatatggagaggagataaggaaggattacagatatggaaggaatccacacaaatcaatcctattccacaacgccctcttgtgtgtcaattactaccttcccaaatcctatccatgaacgcatgtgtatacagataagagagagagatgggcagcaagagatcgatggcaaggctggcggaggtggcgtcaacggtggccagcggcgtagaggagtgcggggacggcggcgtggttgatggagctggcttcctcagcgcggcgaagaggcaagccccgtcacgctagggtagatggctgcggngcagcgccgagcaccaccagcaggcgggcgtcctcagcggcggacggggcccgatgacgccggccgaggtgaagaggtggccgtnccccctcccctcccccccccccagcggcagcggcgaggcaggcctagcatggccgacggagatccacacgtcaacggttgctcgtggatggccacgggcgggggcagtgcgccaggtggtcggtgagatcgacgacgatcggagacgctgctgctgctgcttgattgatgacaacacaaacgcctgagagatggatctcttaggatgatgacttgacgacgcgaagagagaaaaaaaaagttggccgcccccgggagatcggagccctcccggggcgacggtgacggaagcgtgagcagcggttctaggtcgctcgctctgataccatattggatagtatagggagagaggtatattgcgtaacgtggatcaattgcattgagccttagggaccggtatatataggagtacatagggtgagataaagaaggattacagatatggaaggagtccacacaaataaatcctattctaatataactataactaccatatactctaacaatatgatttcctgctaacttgtgaaagtttttttttaaaaaatgaaaaatcaggatgctagatcttactatctgttttccagcatcgagaatgtgatgaaatatatgcttgatttgtgcatcaagtttgctgaatgtatatttgtttcaatcagcataaagttctaatttctcctccaagaggcctttatgatgcaataagctttgcacatatttcctcacaagcaaagcaagtccattcttgttataaataataaattgttcaaggtacttgttttaacactagcaggcttatgaaatttatgtttgctgtgatgtttattagttttctgattagtggtgaactcatttcctcgtcgggccagccaaccgcatgtgaaaatcctctccgcccatctgaaaaaccctttctgatcggtggcagctccagccttgggagttctcaccagataacgagctacacatctctcggttttccctgtgatcatcctgctttcgacatgcatattgctggaaaaacaacatcgtcttcaaaagtttcgcaatcgtttgttagggcaatgtggtcattagtaactactattagacttgtagactttttctatcccttaattgctacacgccctagaccaaggaagtaatattgtaagcacttaatggctgtatgatcgcggttcaaattaaaatgttgattgcatttttaggcacttttggcaccatatatatgcgcgcatagaagatttttgcatcgctttattcttcctccacacgatgcacaaagtacgctggctgttcgaatttttgaaaagaaaaagtatcccattgcttgggcaacccttcgcgcgccgtatttaatgtgtgtgatatgcactgatccgatccgtttctctcttgttttttcgtcacccgcgtgggtacagaaaaaaaaacagaaacgaaggtgacgtaggagtacgtattgctagcatgtatcgacggcgccggtggaccgagttcatgcaccaggctagacggacacacagcctatgcccgtcgcgcaatctccggtgcccgtcgcgcaatctccggtgtaaagcaagcttgcgagcgtgccacgcaagctaaagccgatcgacctcgacgacatacatattccgtggtccccttttctttccgacccaatgcaatagcctgaagcagattgcaaattaagcagcacgagtagatgggtcatggtggctacatgcttttcgtgctactggtgtaatactcctgtgaaaaagaaattaatgtagctttattaatttatttattgctgaactaaatggattttatagttaggccttgtttagtttgccaaattttttttcctaaaaacgtcgcatcgaatctttgacacatacatggaacatcgaatatagataaaatcaataattgcacagttagggggaaatcgcgagacgaatcttttgagcctaattagtccatgattagtgctacagtaacccacatgtgctaatgaaggattaattaggcttgaaagattcgtctcgcggtttccaggcgagttatgaaattagttttttcattcgtgtctgaaaaccacttccgatatccgatcaaacatccgatgtgacacccaaaaattttcttttcgcgaacttaacaaggcaatttgtatcttgccaaacaacaaatatcgatcggatgtagatatgtactactccctccgtcttaaaatataagcatttttaaattctgacacagtctccgagattctactttgaccaacaatatcaataaaaataaaatgttttaaatataaagaattgcatattatgataatttgtttaatgataaatctagtaacatcaattttatacatatgattgattttttttcttttgctactaatagttaaagctaaaaatgtttaacttgtcactgtactagaaatacttatattttaggacggaaggagcaataaatagttccgccggcaaattttttctccatcacatcgaacgtttgaacacatgtacgaaatattaaatattgaaaaaaaacaattacatagtttgcgtgtaaattgcgagacgaatcttttagacctaattgtgccatgatttgacaatgtggtgctacagtaaacatttgttgatgatggattaattaggcttaataaattcgtctcacggtttctatgctgattatgtaatttgttttgttattacttcaaatgtgtgtctgtatatgatgtgacccggtttttttttttttttttgccggtggaggctaggttagttatatacacgtacgctcacttatttcatcactaaattgaacttaaaaaatacatatatacgctcacttattgcagcgttgcagtaattaagcgaggaaatgcatgtagccgagaaatgcatgtaattatcgatctgtttgcgatctctgcttcttctaggctgctgttcggtcgcacgcaaacaatccacggaattgtccaggggagggagagagggggacccacggaatttgtgtgcttggttggttggcttcatgcatggcagaacgtgtggatgggtgcacctgtgctaccggaaagatacatacaccggagcttgaaagatccatacacctagcaggctagcacggtctgtgcgtctactctacccgcggttcatgaactcagtccacgcgctcgcggcgccgtggatgcatgcagcgcgtactgctactgctaccaccacgacgacggcgtctacgcctgcagctctggtcttccctttttccctgtacgcgcgcggggggacaaagacagactgcatgtcgaaatacacatgcatatacatgcagttaatgaaatggtaatatggaatagtagtagtatactaacaaagtcgttttcttgttgatgcatatatacaccgtctacatcgatctccaatttacatacatacaccgtatgcatttcacggtacgttggtccaaactccaaagccaaaggtgatctctctaaagtttgactgctttttctaacactctcgcaaaatgcataacccatagttgccaaaaaaccctagcattggctcctgattataaatatcgcaaggctgcactgcagtagtgcacttcacctccacccccggccatatctcctcatcagcgagaacgagagatcgagatgtcgtcgttgttcatcctcgggtgccccgtcctgtgcctgcctggaggcgccggccatggtggtggtgctggccgtggccgtctcctgccgccgccggtcgcgcgcttcgccggcgccggccgtcccctcaggctgacggtggcacaggcggctgctaacccaggtccatggctggcctgggacgacgactccaccaaggtgagaaaacgcacgcactcttctttccaactacctgcatctgcatgcatgtgtagtacgtacggaaccggatcgatgtttgcggtgtgcgtctcgactgacttctgccttcctcgcatttgattcgatgtgtttcaaaaaaaaaaagaagaagaaaaatgttcttttcggtcgcgcgtattgatctgtacgtggagggaaaaaaaaactggtcgttttcttgttgatgcttgcgtgctgtaacaaacggtagatctaggattatgggtctgggatgccgtgagaaaatctgctcttgcggtaaaaacatgagatcgcgcgagcttgttgcttgggagaacatatatgttgtacttgatgcatgtgtgacgttggcctgcaggtagtaaggccctcttacaacgttctttctctcggtctagatctgtgtttgtttgtatcttctatggagtttacgttgtgcttttcttttcggcttttttctcccgaggagttcacacgctagctcttctttaccgttcttgttggttgtgttgatacatggtctatctgtttctcgcgtacgtaggttcttcattctgaaaagaaagttttcttttttttaaaaaaatcgtgcaggcttgttcgcaaaaaaggttctcttctgatcaataaacaaagcgtacgcagtagcaactacggaggaagaaacggtagatctttggtggttgttgggccatttgttttctcgaaggaaaaatatttactatgtctgtccactaatacaagggatgttcatattttcttgtaaatgtttgaccactcgtcttattcaaaaaaattttttgtgcaaatataaaaaacaaaaagttatgcttaaagtacttgttgttattagtaagtataagttagccgtgttgatgatcgttgttgggctaggaggacagacgttggggatttgggggatggaatctgtttgacgagaggatggcctgatcggaaagggttcgagaatgggccgaactgatcagcccgttggtccctgggcatactgtgggcgtggatacagttgtgagatgggttcctaggggagcgtgccgggccaatgagttgttctgggccaggccaggctgatgcaatttaattgaagtacgagcatgcagtttgggctgagaggaaattggttatggggcaaattctttgggctgggaggggtttggggctgatgatgtttgggctatatgggctggaacttagtttcgtaaaacaattccatatacatacatgcgtgcctcaactgaagtttgttttttgagatgaaaagaagaagatatatatatatatctgaatctttatctgttttgttggatatgtggttgctgtcaggtgacgccgtacaaggccatcgcatggtcagctgcagaggcgctggacctcctggagcagactccgccgccatcggccgggagcgccgcaagccaggacgtgcaggaaataatcggcacgttcaagaacctcaaggagcttgctgattccgatgaggtgccgatggagcccctggcggcgacgtgcacgctgctgaggtaccattggtacctttggcagtgctaccacggcgacccagtcacaaggggattcccggacgggctcctcagtttcctgcacagctgcatcagtttcgcttgcggccccgatggctacgcgctgccatactacctcaacattttcggcatcaaggccgacaagctccccaaggaggcgtgggccaaggtcagaacagaacagaacccgatgacttttctccgaccctagacctccttgtgttggcttgggccgagtttagtttcgaaaaaaaaaatgtcacatcaaatttttattacatataaatttttaattttttcatcatatcgttttaacttcaatcaatcttttaattttgatgcggagctaaacacacccttggtatacctgaccgacctgttcgatttgtcgcgtgcatgcaggatttggtcacagtcgcgatgtatgcttcccagggtacccgcctcgtcgtgggtaaacacgagaagcatcttctggatgttttcaggatgaggctcattgcagatgaggggaaacaggaggaggagtccaagattcgggcggaggaggccagccaccgcaaatggcgccccgaccacttcgtcgacgacgatgacgacggcatgctcggacttgggggcgtctgacgacctccttccaagcgaagccggccacaaaatctatgccattgccatttgccaactgagtagacattagttatcttatcttagagtatgtttatggttaggtgttgttactttagccttctgatatgatggtgtcttgattatcactgctttatggttacgtgttaccagacttctcctttgctttatgctcactatattaatccattcgctagcaatgggtactctgttcctttgcaactccagtattactgctattatatcagaatatgcatgacacttgcatgggtccatggcatgaatgcaaagaatttggatccacaaaatttgagggaaaaagactttctgcactatcatagcacaaactttcgaatatgacctctctaaaatcaaataccatttccctgtaaaaacttttaaattcaaaaatgatggctctgtttgaacacagcttcaactctagctggatatatgaaaattcgaaaatgattttaacccataaattctactatctgcaatgccaaacagacccaattatacaggtagcagtgtcttattcgaaaaaaaaaggtagtagtgtcttattccggaaaaaaaaagttgtagtgttatctcgtattgttatgcttctacgacagcaacatgttctgcaccaataattgttttgtttattgtgaaacattactgttacagcatcatcttctgattagtactatatacattgactggtcctttctactatgtactccaccctgatcaagtctgatttctcctgaacccagtgtgacaagtctatattgattgaccggtcctttctagactgctccactgagtggatgcaagcgagccaacccgccggacctaccacttccttacacccgccggacccaccacttccttacccatgcttttctcattctaagtcttgatggtattgtgttcttttttaaagttcatatagaagcgagattttttttttctaatatttcaacgagaactgtacttcttttttttaaaaaaatctatatttaaaaagattaggctagttatggactaattaggctcaaaagattcgtctcgcgatttccatgcaaactgtgtaattagtttttttatctatatttaaagctccatgcatatgtcaaagattagatgtgatgtttttttttaaaaaaattgaaactaaacaaggcatttagctcaaaccctcattgacgcctagagatggcaatgggggcccgtttaccgtttccccgtgatgaattcatctattaggtgacggggatggttaatatctactcaccatgaggaataaaatggttaaaaacctctcaccatcggggatgacgggg

SEQ ID NO: 5284 - DNA, 15629 bp, Oryza sativa
gtgacccgactatacttatagggcggaattctagactttttagatgtattggcccataatattgaagcccatttaacatgcatatatataatctaaccctaagtcaacaggtcaaagccaaatcctccaggacctccacccatccagatccacagcaacccccacccaagtcacgcgcgccgcgccgccgccgttcgccagtccgccgggagcctaggagccgtgcacgccactgttcgctgccactcgctgccttctctcgtcgggagattgaagccgtcgtcaccggccggcgcggcgcttgcagccgtcttcaccgagagccaccggctgcctctgtcgacacgccgccagcctgcagccgtcttcaccgggagtcgtcgtcgccgtgctgccgggagccgccgtcgccgcgccgccgggagccgccatcgccgccgccatccgttgaccatggcttcagcctccccccgtaagctatgacagcgacgatgcaaggtgagcatactacaatccctcatcccttctctgtgctcgatagacgcctacctctagttcttctccatcgagttattcgtcttccatagctgcattgttgactcactaacccacgaccggcggtccacgcgaagggatgctgccatggatttggacctgctaccacgtgatacaagtaaagcagtagtcgctgccgcagccacacccaatgttgggcatactgccgtatccgccgccgtgctgggtgctgcccctgcggtcgtcgcattgggtgcagcccctgcggtcgtcgggttgggtgctggctcctctcgcaagtccaatgcaaatgcccttcgcaggcctcctcctttgaaaaggaccacatccaagccgaaaagccatcttgcagctgttggagctccttctgcaccgactactctaaacacgtcatcttttgccggcggccttcgtctattaaaatccatggggttcgatttcaagcacgctacccctcttatatgtttcagctcttttatttaacaatttggaatatgtaagttggagtttatgacttatgagattgcattgcacttaggtactgaatgtttcagctcttaggtactaaatgatggatttgttgatgttactgtcatatattttctttgcaaattgaagggatatttctttgcacgttactgttatatattttctatatttatacttatgtacatgcattattgtttggtgatttatagtgctatgcaggtatgcgtcaacatggtctgaactttaaatttgctttcacagctttgtaaagggatttcagtatgttactaggccattgaataaattttgaactgaatttatttctctcttctcagattcacatcgaagtcaactgcgggtagtgcgaatagaagccagcaagactcgcaatcacttccacctcacgatgagagtgttaatgattctcagccaatacaaggtgatgatgatgaagatgaggctgaggaggaggatgtggactttggcaccaagaggaagcttacttctatcgtttggaaggatttcaagaaagtaaaaatctgtggtaaagtcaaggctcaatgccttcattgccacaagcggcttggagggaaaagcagtaatggaacaagacatctccatgaccatttgaaaatttgcacattgaaaaagatcaagatggcgggacaaaacaagacacttgcacagtcttctttaaggttcaattcccaggagggaggaaaaatatctgtggagaagtacacatttgatccacaaatagctaggagagagcttgctgccatgattgtactacatgagtatcctttatctattgttgatcatattggatttcaaaggtttgtgactgcacttcagccattatttaagatggtgactcgaaacactattaggtaataatgatatctattagtttcagttgtctattaaaaatatctgcaattaagaagaaaaaattaacatttatgcatttttaggaaggacattatggactattacatggaagaaaataagaaagccctagcctacatggctggaactaagtcaagagtggctattactacagacttgtggacatctgataaccaaaaaagagggtacatggctgtcacagcccatttcattgatgattcttggacacttagaagcattatcatgaggtacttgatgaacaattaatttcatttcctactgctacatatttaattcagcatgacattagatttcatttttgcatcaatctgaatttaatctaggtttaactttgattgtataggttcatatatgtgcctgctccacacacaactgaagttatatgtgaacaactttatgaagcattggtggaatggaatcttgatgagaagatctcaaccttgactcttgataattgtaccacgaatgacaaggtaatcactgaacttgggaagaagattggcaagtctaagttgatgttggagggaaaattgttgcatattgttaacgaccaaatttggttatttaggtatcggagatgaagataaaatcgaagcggaatccaagatggagatcgttccagaagcggagcaagaatcggctgaagtccgaatcggctacgatcaggatcggtagagttcgagtcggacaaggttgccgattaagccgattccgacaatgtgattcggtacacgttgtcgggttgagttaatgtgcttcatgaggattgccatgcatggattgagtcctgaaaaggtaattgtatctattaattagggtatttcatgtaatttccttagagataagtttgggcaaaagtctgccgcaaagacttatggtatcttagagtttgttagagatgagagtcgtgtccgacatggacatattttgtaatctcgggtataaatagaccccgagccccatgtaatacaacaacacacgttcaatacaatctcggcgcatcgccaccctttacttttgttttttttcgacaagttcttgctttcgggttgagctgcatcagtttcgatcttcaactagatgtaaaacttgttatggcgggttgcgttatcgggattagtgcttccatctttatgatactctaatcttgtttatgtaattcgtcgaattatcatatattatgtataatcttcaacaatatcgttatctaaccttcaatcggctaacatctattattggaaggcaaccaatcaggttaaatatctatgttgacttagattatacagggtatctaccactctatgaaacagccaacagcttgattgtctagatattgtccttcttttcatatttatagctgcatcagttgagtttgaccttataagtcgttattaaaatctcaatttctagcctgcttttggttgccgattagggtagtgtcggggtttcagccgatcttacctgatttaactactctatgtcttatatgcttgattgacatgttaaatccgccctttatgttaagatcttgttgccgatacatgctagatctatctaatcggctatgctatgaacatctataatctcattgttattatatatttcgatctaagtgatttatactgtctcggcatggtgaccgatctatcccaatcacttgatttaagtatatatcaacataagaattatatatggttaatatctacagccgatcaagtagatttagttctttcttacttattcatgattgccgatcgattcaaatatgacatcggctcaaagacaaatgatacgtcatcggcggctggtcgatcggctatcgtttatggatttaaccgctattttcctgtctttatttcttgttgattgcatgatcaaatcaactggcacgctcacgaacctaaaggcaagatttttggacctgcactggagttaagcagatctcccaggcctcgtgtttttcacatcaacacatatgcgttgtgctgcccatattcttaacttaattgtgaaggatggtatagaggtgataaaatattcaattgcaaaaatccgtgaaagtgttgctttttggacagccacgcctaagagagtagagaaatttgatgaaattgctaagcatgttaaagttaaaatggatcacaagttaggccttgattgcaaaactaggtggagttccacctacaagatgcttagcattgctttaccttatgcacatgcttttgatcgtgcaaaacatgttgagaagctctttgattgtgcccctagtaaagatgaatgtgcttttgctgtagaggtagttaataggctcaagttgttcaatgatatcacagaagtgttctctggaactaattatgtgactgccaatgtccaactcttgaaaatttgtggggctaaagagcaaattaggcagtgggctgtgtcagggttacgggtaaggtataccctctacccttcgatatacgtcacgtatcgatatggtatgttcacgcgtatacggacgttttcggcatacgttaaggaaattcatcatggagttcacagatggaaggagtcctactcggtcagaactgggtcgtcattgtgtcgtgttcggtccagtctctccgagtccaactgggagacaggtgacctgcgatataaaagggaccccccaggaggacctaaggcatcgaatctcagagccaactccaccacagcctacgaagccggagcttatcggagccaagtcgccgggagatctagtcggatcaactcgactacgatcttgtcggtatcgtcgagttccactgttccctttgtaatctgtggttttcatcatataatcccatatcaactggattagggctattacctaccaaggggcctgaaccagtataatctctgtttcctgtttgcttgatgtcgtactacgtagatcctcgtaccagcgtaccccaataccctctatatccggtctacgggtattccccgtcgacagtggcgtgccaggtaggtggacttggtgctcaaggttctactactatgacatccagctttgtcgacaacagtgtcaacaccaacctcaaccaaggagttcctacttcaacaacactggtgtggactcaggtcggcgaaatcgtctttccggtttacaccacagtgccgatctcagctggtccgccaatggccggaaacgagaatgcagtggctacaacccagggcgactccatgtcgaaggatcctcccgccgaagcggagataggaacgtcgacaacatccgagcccgagaaggatcctagtgcggccaagccttgtctttccgacaggaatcacgagccgacgaggattacttccgaggtgacaaggtcctggtgtcctatccacaaaaccaggaaacacaccctgcaagcctgctgggtctttctcaacgtccatgctgaaattcgtgcctgcaaagagcgtggaattcagcgtacctctccaactcgtgatgtctattgtccaattcacaagacaaagaatcacaacctctcgagctgcaaggtctttctcagcgccatgaagacgccaccttctaaggtccagcagtcacgcatccccatcagggatgaacacaaggcacaaggagcgacgctgatttcagatcgattcgttgccgtacctcgacatagatccccacgaaccatcagtcttgcacctgctcgaagactatgaatcatcgacacgagtacgcccgcgtgaggtattggctatcgacgatgtcggcacatcagcgcgcaccaatgcggaagcggaaaatcaagcgactacactggcccagcacatcagagccgtcaacgcaatactgagggaaaccccctacgatcccattctgaacgacgatctcgcacgatggacagaacgactacgggaatcagtgaccaacctcagcaacgcgttcaaagaagccgctgctgcagtgcacccagaacagccaccaactggcgatgctaatggtgaagatcctgaacaccgggaattgcctcatcgagccaccccttcacctcgcggcaccggcgatctccgcgatcacctgaatggccgccgagaggcgcgacgcacaagtgacaacgagaaccgttctcaacatcgcatctcttcacgacgtcacgataacgaagatcgaggaggccgttcaagcgaagaccgaggccatgataaccgccacaaccgctgcgatcatgacgatcacgaacggcgggtgctgggcgatactggtcgaggacgtcgccataatgacgacgatgatggagatcggcgccgagacaacaacgggcgacgacaacaaggttctcgagaacccggccgacgtcctcgtaaccgcacgccggaaccgagcgacccatcgtcatcgtcatcatcttcctcatcttcatcatcagatagacatccacgaagggcgtatgatcgccgacaacccaccgcccccagcgctgggtgtagagctttcgatcgttcacttcgggatgtccgatagcctgaaagattccgacctggagcaatagagaaatacgatgggagcaccaacccagaagagttccttctggtttactccacggtactctacgctgccggagcggacgacaatgcgttggtgaattacttgccaaccacattgaaaggctctgcacgttcatggctgatgcatctcccccctactcgatctcttcgtgggcagacttgtggcagcagttcgtagccaacttccaaggaacttacaagcgccacgcgatcgaagacgacctacatgcgttgacacagaacccgggtgaatccttgagggattatgttcggcgctttaacgagtgcagaaacacaatccccgagatcaccgacgcttctgtaattcgcgctttcaaatccagtgtcagagatcgctatactactcaagagttggcaacgaggcgcgtcacgactactcggagattattcgaaattgtcgatcgatgcgctcatgcggatgacgcactgagacgcaagaacgacaaaccgaagactggaggagagaagaaaccagccaaggatgcacctgagtcaagcaagaagaaaattcgcaagagtaggaaaaggaaagctcaatcggaagttctcgcaacagaatacgcggaccctcccaagcgcccagacccacaaggcagcgatacgaagaaagcatggtgccctatacacaagtcggacagacactctctagaagattgcctcgtcttcaaaaagtcgctcgcaaaacacatgacatcggaaaaaggcaagcgagtacacgtggttgagaaggatgctgaggcgcctactcaggaatcggactcagcatacccagattccgatcttcatgtctcacacatctttggaggttccacggcatactcctcaaagcgagaatacaagaaagtggaacgtgaagtctgttcgacgtggcagggggctgcgcccaagatgaagtggtccgagcagaagatagaattctcagaagaggaccaccccaagattgctgtcatcccagggcaatatctgatcgtagtcgaacccactattcataatatcaaggtcgcacgagtcctgatcgacggcggtagctcaatcaaccttctcttcgccagcgccttggacgcgatggggatcccacgaaacgagttgacacccaccgatcaacccttccatggaattactcctcagtcatcgtccaaaccattgggcaaaattacgttgcctgtgactttcggccaagcaaactacttccgaacggaacagatcacctttgatgtcgctgaatttgatacagcatacaatgccatcattgggagaacttcactcaccaacttcatggccgcatctcactacgcgtatcaagtgctcaagatgcccagaccgaagggaacaatcactattcaagggaacgctaagctggcagtacaatgcgacaagtggagcctcgacatggtcgagcacacgcccagcctacccgccacagctgagccacccaagaaagtgagcaaaacaaacaagacgccgaagccggacggcgcaatcaagatcgttccactctccagtgccaaccccgacaagaccgtcaagatcggggcatcactaggcgagaaataggaactcgcgctcatcaccttcctccgcgacaatgctaacgtgttcgcttggcagccgtccgacatgccgggggtacccagggaggtgattgagcacaaactcatggtgcgacccgatgccaagccaataaagcaaaaactgcggagatttgcaccatatcgaaaacaagccatacgagaagagctcgacaagcttctcaaagccggtttcatcagagaggtactccatccagagtggctagccaacccagtcatggtacggaaggccaacgggaagtggagaatgtgtgtcgatttcaccacctcaacaaggcgtgtcccaaggatcactttcctcttcctcgaatagaccaactggtggactcaacagccggttgcgagttgttgagcttcctcgacgcttactccggttaccaccaaataagcatggcaaaagaggacgaggataagacagcattcatcacgccgttcggggtattctgctacgttaagatgccattcggactaataaccacaggaaacactttccagcgcacggtccaaggtgcacttagtgaccagctcggaaacaatgtcgaggcttacgtcgatgacattgttgtcaagaccaagacaagcgactcattgattgacgatctgcgggaaacgttcgacaacctccgacgatatcgccttatgctcaatccagagaagtgcacgttcggagtaccatcgggcaagtgtcacaccttgaaaattcaaaatttataaattgttgtttaaaaggaatttttagaatttatttttaaaagtcttgaaaagaagatctaattttaaaaataaattccaatataaaatggggccagataaaatttcattaaatactttgcttaattctataattcctagatttttctgagatttatttgagctaaggaagtatttttaataaatggaattgcatttaaaaaataatttaaattgaaaaaggttttaaaaatcttcttttggctttgggccgaaagtcggctcaaaaacctctcttttctctctcctcggcccagccgacccagtccgcagccgcgcgcgcgcgttcggtcgctgacaggtgggtcccacctgtcaggtcgtcgtcttcctggcgtcggcctccgcccgaaaccctagccgccgccgccgccgccgttcctttccaaatccggccgcccctttccgtttccggccgaatcaatagaggggaaatgatctccgggatctcctcgaccttttctcctttggaatcttcggctaaatcggtttggaaaccgatgggttcgaggtcgattcggatcggctttgagcccgatctttccttctcgtcgccggtcgccgtgggccttcgccgccgcctccgagcccctttaaaaggaccccccgagctctcctctacccgtcgcccccttcgccttcgcctctcgtcgtcggagaagccctagcgccgtgcgccctagctcagccgtcgccgccgtcgctccagccgtgcgccgccgccgttccagccgtcgccgtcgctcgggaaggccaccgttgggatcgccaagttgccgccgtcctcgtccgttgcttcgccgccgtcggagaccgccggagcaccatcgccgtcgtcgaaccgaagagctccgccgcttcttcttcgtcgccgccgccgtccgttgggtttccgccgtcgttttggtcgccggtgagttcgccgtgccgtccgctacccgttggtgccctccgtttgcgtcctcgtgccgccgttcgccggcgagtgtgcaccgcccgagccgtccgagccgccgagccgccgccgccgatgatgacgtcatcgctgacgttatcggggccgtccgccgtgagccgtcgtggacccgatcgatctcggccgtccgttttggatggatcgatctcggccgtccgttcgcatgaaccgccgcctgtgcgctcggtccaccgcaaaccctagccgctgacgcaataaatccccttttccttttcaaaaataattctttattgcgtcataattcaattaaaaccggtttaagtgttttaatccgatttaatctttaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgttttcggagagttcgttttcgccggagaagagtttgaagagttccaaggccagcaaggtaatgtcacagctcctttccgaggtaccgtggtggtactaaggcacatggtgacatgatgtggggctgtgtcttgtgggtacagtggtacacctctgatcagagtaaaactattcgaatagccgtgcccgcggttatgggcgggtctaacaatgtttttcgtgattagtctcacatttctcaccatagtaaatgatgctttatttggttataatttgtttagctcctggtttggaatggttaattcctggtttggagattagatctgttcagccgggaatggttgttcagaatggttgggcctatacaacagggtatgttgtatagcgttggtttaatattgtttaatacttcactgttttattaaattctcaaatgtttactaaatgctgcttttgcaaaataaaaccctattatgccatcttttggtatccttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacaagttggtatcagagcttccttgaccctaggttatgccaaatggttacccatagaagccctctaaaaatgttggaaaaatagaactgttctcctccctttctcttttaattaaaccaaactaatagcacatgcacttcataatctgttttaatggttctcgttcaaaaatttattccagtgttattagtactgtacatctattactgtactaatggctcattttaccagcaaaagttttacaatattgttttatttaatcttgctgcaataaaataaatttaacatgttgattttataactttcttttatttcttttggaacctgatgttcaaaagtacaaaattcatttccaactgtttcaacttatcttgcaagcttggtttactttatttaattaccttttactttgatcttctaaactttattcaaattaatcccaaaacttgtgctattaattggataaatgtcttaactccctcttttcacttgtctttagatgccgcgctacaagcctgagtacttgtttggtgttgagggttttgtccaggagttgcgtacaatgtcctttgtcattggatttgggactgcccctttttatgcccagattcctcatgatcgtcatgaagagaagtgccgagtcaaagtcaccttgaacagtaatagtgaagatatcccctcagtgatgttcgaagctggaggaagaaactacatccatgcaagtcaggaggtggcaaggatcgccataggagagctccgcgatcgttacagtgatcagttggccgatactgagtatcgctatcatcctcgtcaaccccagggaagtgaccgtggcagctaccttgagactgaaggaattgagaatgatgctaccacaaggcatttggttgagatgctgtgggctatggatgaaagtcgtgcggagactgtgttagcggctcaagatcgtgaagatcggaatcgtggtaagatttgcaagctagaagacaaggtggatcgtttggagaaggaactagccgcattgaagggagaagcaccaccgcagaaggccaggattcgtcttaccgcaaggaagagagctctatttgtccctcgctatcaattggcgccaaaggttcgtgtggtggagaaagaagttgccccaactctagcagatcctccggtcaacatcataagtgatgatgaggaagaagaatccaagcgcaaccattccaagattgagtgggtagcaactcaagatgatgaagatgagccgaaagagccttcaatcgacctccgatgctcggaagaactagagtgacttgttaagtcgttgtcttagatcgttgtgttagtttgcttgctttaagttgcttgtgtgtgcttcgcatgtaatttacatcagtgatgggatgtaagtgcatgtgtttgtttgcttttgagtgttaggaagttggtgagtttagtggtgtgagagttttcagttttgtaataaaactcagttaagatcaataaaagttaaagtaattctctgtcctaagtagtttccccccccggtttctcttcttgtgccctgtccagcaagatggtgaatactcgcagcaatgggaatggccccaacaatcccaataataataacaatgaagggaacccaactcttgcccaagtcctggctcaacaggtgcaacttatgaacatgatgatgcagcaacttcagaatcagcagaaccaaggaaataaccatgcacctccgcagaacaggttaactgattttcttcgtgtgaggccacctaccttttctagcactaccaacccagtggaagcaggtgattggttgcatgccatagagaagaagttggatttgcttcaatgcactgatcaggagaaggtctcatttgcatcgcatcagttgcatggccctgcctctgaatggtgggatcatttccgccttaacagaactactgctgaacctatcacttggcttgaatttaccgctgctttccggaagacgcatataccatcgggagtggtgtctctcaagaagaaggaattcaggtcgctcacccagggatcacgctctgttacggagtatctgcacgagttcaatcgtcttgctcgttatgctccggaagatgtgcgcaatgacgaagagcgtcaggagaagttcttagaaggacttaatgatgagctttcttattcactcatgattggagattatcctgatttccagaagctagtggataaggctattcgccaggagaacaagtacaattgcatggagcagaagaaacgccggattgctcaattcaagacacaacaggggaataatcagaagccgcgtcttactttaggaccccagtccataccacatggaagttcttcgtccgttgttcgtccgcagcgtcagttcttcaacaacaatgctggcaacaacatacgtaatcaagttccgcgtcctgttgcagctccaacacagcaacaacctatcaagagggagcaaggcagcaagcccgcggtgtgtttcaactgtggagatccaggacattatgctgacaagtgtccgaagccccgacgcgtgaaggttgtccctgctcagaacaactctactgtaccagtatcaaaggcccgtgtcaatcatgttgctgctgcagaagctcaagatgctccagatgtgattttgggtacgttccttgttaacttagttcctgcaacagtgctttttgattctggtgctacacattcatttttatctatgagttttgctggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagacctagatgtcatcctagggatggactggttagccagacataaaggtgtgatagactgtgctaacagaaaagtaactctcaccagcaatgatggtcgagttgtaactgttcatgcattgtcttctgaatctttaaggtcgagactgaaccaaataactttggaagagattcctatagtccgggagtatcccgatgtgttcccagatgatttacctggtatgccgcctaaaagggatatagagttcagaatagatttggtaccaggaacaactccgatccataagagaccttatcgaatggcagccaatgagttggcagaagtcaaaaggcaagtagatgatttgcttcagaaaagatacatcagaccaagttcatcaccatggggagctccggttatttttgtggaaaagaaagatcatacccagaggatgtgtgtggactatcgtgccctaaatgatgtgactatcaagaataagtatccgctacccagaattgatgatttgtttgatcagcttaaaggtgccactgttttctccaagatagatcttcgatcagggtatcaccagttgagaataaaagaggaagatatacctaagacagcttttaccactaggtatggattgttcgaatgtacggttatgtcttttggacttaccaatgcccctgctttcttcatgaacttgatgaataaggtgtttatggaatacctagacaagttcgtggtggtctttattgatgacattcttatctactcccgaactgaagaagagcatgaagaacatcttcgccttgcactagagaagctaagagaacatcggttgtatgctaagtttagcaagtgtgaattttggttgtctgaagtgaagttccttggtcacgtcatctcagcaggaggagttgccgtcgatcctagtaatgtggaatccgtaaccaattggaagcaaccaaagacagtttcagagattcgcagtttcctaggcctcgcaggatattatcgaaggtttatagagaatttttccaagattgctaagcctatgacacgactgcttcagaaagatgtgaagtacaagtggtcggaagaatgtgagcagagttttcaagagttgaagaatcgtttagtatcggctcctatcttgattttgcctgatccaaagaagggtttccaagtgtattgtgatgcatccaaacttgggttaggttgtgttctgatgcaagatgggaaggtggttgcctatgcatctcgtcagttacgtccgcatgagaagaactaccctactcatgatcttgagttagctgcagtagttcatgcgttgaaaatttggcatcattaccttttcggtactcgaacggaggtatataccgatcacaagagtttaaagtatatctttacccagccggatctgaacatgagacaaaggagatggttggaattaattaaggactacgacatgggaattcattatcacccgggaaaggctaatgttgtagcagacgctcttagtaggaaaggctattgcaatgctacggaaggacaacggttgccattggaattatgcaaggaatttgaaagattaaatttggaaatt

SEQ ID NO: 5285 - DNA, 1567 bp, Oryza sativa
tgtgtccccgacaccaaagatttaaaggatgcaattctgaaagaagctcatgatactttatattccattcaccctggtagtaccaaaatgtaccaggatctcaaggaaagattttggtgggcaagtatgaagcgtgaaatcgcagaatacgtagcagtatgtgatgtttgtcagcgaatcaaggcagaacatcagaaacctgccggtttgctgcaacctttgaagattcctgaatggaaatgggaagaaatcggtatggattttatcactggtttacccagaacgtcatcaggccatgactctatttgggtgatagtcgacagacttaccaaagtagctcatttcatcccggtaaagacaacctattctggaagtcggttggcggaattgtacatggcaaggattgtgtgtttgcatggcgtccctaagaaaatagtgtctgatcgaggcagtcagtttacttcaaatttttggaagaaacttcaggaagagatgggttctaagttgaactttagtactgcttatcatccgcagacagacggacagaccgaaagggtgaatcagattctggaagacatgttgagagcttgtgctttagatttcggtggaagttgggataagaatctaccctatgtagaattttcgtacaacaacagttatcaagctagtattcagatggctccttacgaagcactgtatggtcgaaagtgccgcactccgcttttgtgggatcaaacgggagaacgtcaggttttcgggacggatatcttaagggaagcagaagaaaaggtgaaaatcattcaagaaagattgcgtgtggctcagtctctacataagagttatgctgacaatcgccgcagagatttgagttttgaagaaggagattatgtgtatcttcgtgtcacgcctcttcgaggggttcatcgttttcacaccaaaggaaaattggcaccgcgttttgtgggaccttataagatagtcagcagaagaggagaggttgcttatcagttggagttacctcaatctttggcaggagtccataatgtgtttcatgtgtcgcaattgaaaaagtgtttaagggtacctaccgaagaagctaatcttgaacagatagaagtccaagaggatctgacctatgttgagaaaccaatccgtattttggaaactgatgagagaagaaccaggaatcgagttatccgtttttgcaaagtccaatggagtaatcactcggaagaagaatcaacttgggaacgagaagatgaattgaagtcagctcatccgtatctgttcgccagttcttccgaatctcgaggacgagattctgtttaaggggggtaggtttgtcacaccctgaaaattcaaaatttataaattgttgtttaaaaggaatttttagaatttatttttaaaagtcttgaaaataagatctaattttaataataaattccaatataaaatggggccagataaaatttcattaaatactttgcttaattctataattcctagatttttctgggatttatttgagctaaggaagtatttttaataaatggaattgcattta

SEQ ID NO: 5286 - DNA, 901 bp, Oryza sativa
atccacatgtactgttcatgcttgtttatgtgctgttttggtgatttttctcttttcttcttagattccgtcgtttccggagagttcgttttcgccggagaagagtttgaagagttccaaggccagcaaggcaagtcacacagatcccaaacaaccctttgagcatgttgatcctatttaaagctattgtttctattcaactattgcatttattttcgaatgtcattgggtggatttaacctattctttgttatggcccttttgttcttgtttaccttattccttgataccttgggttattataatttgactagcatggaccttacatattggattggttcagctagatattagatgtaattgcttagccctgcttagaaacactagttcacttttgggttaactaatgactcactataatttaatgatggcttaatgatagttcacgatggttaatcgtgattagttaattaattaatgtgctaactaaaacctgataatggtgggttgtgagcacatggttttgttggtcgtgctcatgacaattaaggaccggttcacgagtttcggttgtgaaacattaaccgtgccaaccacaagctagcgtgggcaacggctttatcttttgtatagcatggttcattgcagagcaccaggttgagaagtggcggagataagcccacgggggtcgctggggagtccattacctctggttttgagggggagattatgatccaggaacggtgcactgtagtggattgtgttgtgcgagaggtaatgtcacagctcctttccgaggtaccgtggtggtactaaggcacatggtgacatgatgtggggctgtgtcttgtgggtacagtggtacacctctgatcagagtaaaactattcgaatagccgtg

SEQ ID NO: 5287 - DNA, 4216 bp, Oryza sativa
tttactaaatgctgcttttgcaaaataaaaccctattatgccatcctttggtattcttgtgcacttgcatatttgctgcgtgacttgctgagtatgtcatatactcaccttgcaatcattcatcagaggaagagttctacaatgaggctgatggtgtggaggattaggtgtagccttggtcaagctgcctgtggagtggagccgtccgcgccgtttattttattttccgctgcttagatctttattgattgagaggaactatctacctctgtaataatattttattcgtttaaattagagtattaattgtactctattatcaatttgttattgtgtgcctcggctgattcctggacgagggttcacacacatgtaagcgtttggaattttggatagaaattccgggcgtgacagcaagctactcggcttcctcgtctccggcagaggaatagaagcaaatcccgagaagatcatggtaatcgagaacatgaggtcgcctacaagactcaaggaagtacagaagctaaccggatgcatggcagcactaagcaggttcgtcgctaggatgggagagcgaggacaacctttcttcgctctgctgaaaaaacaagacaaatttgtatggacacaggaggccgaagaggcattcattgcattcaagcgctacctatcaaatccacatgtacttgttgcccctcaacctaatgaagaattatttctctatattgccgccacgccatattccgttagcactatcattgttgttgagagagagaaggtgcaactaccagtctactatgtcagcgaagctctccacgacgtaatgacaagatatccacagatccaaaaactgctctacgcagtaatcatgacatcaagaaagctatgccagtacttccaagcccacagggtcacagttgtctcctccttccctctcggtgaagtcatgagaaataaagatgttgtcagccgcattgccaaatgggtagtcgagctaagccaatttgatatccacttcgtgccacgaacagccatcaagtcccaggtactcgccgatttcgtagccgattggaccatgcccgataacaggtcagacaaccaaatcgacaatgaaacgtggaccatggcattcgacggcgcactcaacagcaagggagcaggggcaggattcatcttgacatcaccttcgggagatcaattcaagcatgcaattcacctcaacttcagggcaaccaataacacagccgaatatgaaggactactcgcggggataagagttgcagctgcgctcgtagtcaggtgactgatcgtgaaaggggattccgaactagtcgcgaaccaggtgcataaagactacaagtgctctagccccgagttattcaagtatctcgcagaagtcaggaagctggagaaaaggttcgatgggatcgaggtccgacatgtataccgcaaagacaacatcgaaccagatgatctagcacgacgtgcgtccaggcgagagccactcgaacctggcacctttctggacgtcctaaccaggccatcagtgaaagaggcaagcggcgaagatagcccggtcgcccccgacatcagctcgggggctatagaggcagagcgcaccgttgccgatatcgagaccacggacgactggcgcaccccactcattaaattcataggcagcgaagagttgcccgaggacgacgcagaagtcgagaaaatatcccgtaaagcaaaagtctactgtatgatcggcaatgatctatacaagaaggcaccaaacggggtactcctaaaatgcatcttgtccgacgacggcagacacctcctcctcgacatacatgaagagatctgtgggtcacatgccgccggtcggacattagtcggaaaagctttccaacaagggtttttctggccaaacgccctcaaagacgcctgcgacatggttcaacagtgtgaagcctgtcaattccacagtaaacacacaaagctgccagcgcaagcactccagactatccctttcacttggccgttatcgtgctgggggctagatatactcaggccattcccacgaggacagggcggctacaggttcctattcgtggcgatcgacaaattcaccaagtggattgaagcgacacccacgggggaaatcaaggccgacaacgccatcaaattcatcaaagggatattctgcaaattcggattgccccaccgtatcataacagacaacggctcccagttcatcagtgccgatttccaggattactgcatcaggctgggagtcaagatctgcttcgcctcggtttctcaccctcagagcaattgacaagtcgagagggcaacggcataatactacaaggaatcaagacccgcgtctacgacaggctcatgtcacacgacaagaattgggtcgaggaacttccatcagtactatgggccgtgcgtaccacaccgacaacgtccaacaaggagacacccttcttcctcgtgtacggctcagaggcgatgctccccaccgagctacgacatcaaagtacacgagtacagaagtattccgatgaggatcaggaagagcagcgatacgacgatgtgaatctactcgaggaacatcgcgaacgagttgccgttcgagcagccagctaccaacaagcccttcgccgttaccacgagaagcgcatccgagcacgcatgctttcgatcggcgactacgtcctccgacgggttcaaagccaagcagggcgcaacaagctctcacccaaatgggaaggaccgtacacgatcacgcaagttttgcggccaggtgcattcaaaatcgcagatggcgatggtcgcgagttggcaaattcctggaacattgatcaattacgtaaattctatgtataagtcaatagtatccatacttgtaagacatcttacagcctcaataaagcctattttttaggtacagactacaatcaaagtgttccttttcgatgatcccttacccagatgacacctaacgttgaaacctatcctcatgtctctttacgccgtcttgacaaggcctccgaggaacctaagggaacttcggcggggacacccagagccgataaggccttgtcggatcctgtagagacgaaagaccatgtaagatctggttgtgtaagagttctcgccgtgcgtattaaccaagccgtgtaatcggaaataaactttccaacttcacggctgggggctaggatcagtgcttgttcaaccgaggcaggtcaaaggtccaagagccttatcttccgagaagaattctccgatgacaaggctggaggctagggagagtgtataactcaaacgactgatcgaagtcgcgaagtgagaagacactcatacacactacgtccagagtaagaaagcttagtaagatagatttcttttctattccacaagtatttcttacaattccatcaaaattcaaaactatattacactttttccaaagacatttgtcacaggatacggagactaccaggaaggacaacgctagtccatcgactggaaaaccttctccgccagcggcgccatcgactttgccaggccatctatctccgtaggagttctctgggaacgagaaaacccttcgcggaggaactcgagatgcagctgcgaacgatgatctcgtatgcaggccaacacgtgccccccggcatatcggcttgagcgacgacactcctgcttcaaggcctcgtcgatatgttgaccgatgccttcgagctgggcataggccccattcagccatgagatgtatccggcagccgattcctcgggatccccacggggtattcggagctctctacagactctcgacatggatgtgcagcaactcttcagatacgagttgaaccacacctcacgaccccggagtgtctctacggcctggtcctttctcacctccagcatagtcctctcgagttccgcgacctcaaacttcgtcctccaatactggatgcgacgatcctggtcagcaagcgcactctcgagatctgctcagcatggaaacgactaagtcaagctgctcttctctcccgagaacacaacaaatcaagtcgatccagacggaagggcaaaggaaatggtaacaaaggacaacaaagtactcaagatcaaaatgctaaataaagctaaggcaatgaccgcacacactagggcggttgagaccaataaaagttttacaaagcatgactaa

SEQ ID NO: 5288 - DNA, 2713 bp, Oryza sativa
  unsure (1)..(2713): unsure at all n locations
tgnnnnnnnnnnnnnnnnnnnnnnnnnnnnnnnnnnnnnnnnnnnnnnnnnnnattcgccgggatggtggacttgataccgcactccccggcgagctggtgcagaccagtataggtgacccgcaatgagccatggatttccgacaagttgttctcaagctccgacatgcgatgctcgagcccctgccgttgtcgctcgttgccggccaccagttccctcatcttctggaggtcctcgcgaacctccgccaggtcgcgcgctagccgatcggcgtgcttgttcgccgacgacgcagccgccgccctcgcctccgcgatttcgtggctaacaccgcgagcaccagcctcgaggaggcgccccatctcaacctggagctcctcccaggtgaggacggcagccggcgaaccacaatcagccacaagatcccccagacatccgtcgcctcatggctcctgggcacgacaacgacatccgttgaggccacggcaggagacgcgttggaggtcccccagacccatcttgcgctgccttcgcccgcgccgccctgcgaaaggctgcgattgagacagagttcgacgaaatcacgaaacctcaaattcattcacttacttctcgctgagcgtcacaagccgctgccatcgcggaggcgggggagacgcgtccgaggcctggagtacaatcgatatgatgtgaggtggaagttttccgactacgtgatcaaataacaggagaacttaccgagggggtgggtgtcttccgacaatgtccgactacagaggagaatttcctcccctttttcggaacatcgctgccactcgtcgtggcagcggcagcagcagtgtcagacgcctccttggcgaccttctccttcagcgacgctgccacctgatggtccacgagcggcccgatgatatcagtcagaggaagagcctatgtttcatgaagtcataatgcgatcccggaagaaaaatgcaaaaggaccgctaagtacacttacattgatggcagcgtcacgctcggctgcccctttctcgcaaagggggacggggacgttgctcgccgttgtcgggccgctgatcatcagttggctgacgcggcgctccacggttgcactattcaagcctgtagatcgagaacagaatccgataagccgggaagaacatgcgcataagggagtcaatttaactaaaaaggaaatacctcgaggagaaacccgggtcgcgtcctctggcccataataatcaaaggcaggaagggctcgagcctgaagcggctggatccgcctaccaatgaaatcggcagcaacttcataccccgacaacccccgttctcggaggtcgtcaacgatatcgatgaaagattggagggacggggtcaaggcaggtttggtggtccaagatggaaccttgtctggctgctcctcaggaacaacgaaggcaggatccgaatcctctacctgaagatagaaccacctcccccgccatttgctgcgagatgaggggcactgaaaggggatgtatcgtgacttcaggccatcccgaagtcggaaaccaacacacccggacacctttttggattccatccagcgtaactcatagtaaaagcggaagaggtcaagaaacggctctaccccaatgtaggcctcacaaaggtgaaaaatactcaggaaggcgatggagttggggttcaaatggagcaaggaaagaccatagaaatttaagaccaaaaggagaaattcagaaggcggaggaagaaaaccgcagagaataaagtcctcaaccgcaaccatgcgacccaggacaggctggggttcagtacctcctacttccctctccgcggtcccgcgactgggaagggcgccatcctcctgcagtttcttcagtgacacactggtggaggtagacttgtcaagatccatggccaccggagatcgccggagaaaggaccgagatgagttggctagggtttttgcgggagcgaagaagacgagggacgcttggaagctggagagttttttcaacgggcagacctcaaattggatccccaaaactcccttaaatagacgcacctccgccggtgcgaatttctgggtccgttacgcgtggcagtttttcggacttcaatttaaattcactcatgaccgttgaacttcactcgatgttgtcgatcactccttgtctctccgtcctcacaccgagaacaacgacaatttcgacatgtgaagtcgcgatcagtttcaccagttcatttaagcagaagtcggggggctactgtcagggttacgagtaaggtataccctctacccttcgatatacgtcacatatcgatatggtatgttcacgcatatacggatgtttcgggcatacgttaaggaaattcatcatggatttcacaaatgaaaagagtcctactcggtcagaactggggcgtcattgtgtcgtgttcgctccggtttctccgagtccaactgggagacaggtgacctgcgatataaaagggaccccccggaggacctaaagcatcgaatctcagagccaactccaccacagcctactaagccggagcttatcgtagccaagtcgctgggagatctagtcggatcaactcgactacgatcttgtcggtatcgtcgagattccactgttcccttttgtaatctgtggtgtccatcatataatcccatatcaacaggattagggctattacctaccaa

SEQ ID NO: 5289 - DNA, 1764 bp, Oryza sativa
  unsure (1)..(1764): unsure at all n locations
gccaccatacttgatcctaagtttaaaacagactacctccttgggttcattgagtccattactagccaatcaagtgaggagtgtacagacaaacttgaagaggttaaaaacaatttgtatgacctcatgaaggagtatgaaatggaagaggatgaagataacacagaatcttcagctcattcacttgctaattcaggtgtattgtcttcaattagtgcacgtgttgcttgaaggaggccaccagcaataagagttaaatctgagctagataggtacttggaggatgagttagtctcaattaatatggaaaacttcaagatttttgattggtgtaaggtggctgggacacaatatcctacattgagaaaagtagcatgggacatatttgccattccagttagcccagttgcatcagaggctgcattcagcactagtgggagggttcttagtgagcaccgcagctgactcacttcagatatcttggaggccttaatgtgttcccaaaattggctacgaaacaagtacaaaggtgtatgtgttgtaccattcaaacatagtgtgatcatttatatttttccattgtcatggttgcataataatcattacaactaattttgtagatgctgataatgaagaacctgcaagatttttggagctgtcttcaagagatccaagataagatggaggtattcttttcaaactaaaaataattgactattgcattgtactcccttcatttccttgctatcaaataattgactaatgcctatgtattttgcttgtcttttgcatgcagagacttgcactagtttgagacatgaagagtcgaagacagtgccttctaagctaacgtgtgcatgatgcctatttgtgtattttgtttattgtgatgatccattggatgatggttgtcacgaccggaaatcacccaacgggcgttccttacgtgcgtgtattattccttgtcccaggaggcaaggtacaccaaaagttgatacaattcagagtttaacaagcggaagcgtaaatagttaattattacatgggcagcgacggcccagcacactcaaagacaacgaagaacagcggaagactagggcgacgaccacaggcacttgacggcaggcacgagctagacaccaaagccttcatcttccaggggctcctcttctgggtttgggaaaaattgagcaagactgagtacaaccaccgtactcaacaagacacacccacaagtgcagcataattgcaaaggagtacaatggaattataatataggggttaggagttgcagtaaatagcattaaaagacacttagttgctcaaagctatgttgtaaacacgatcctagagctataaaatattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccccggtatacagacggaagacgtgacatagataccagcccatcctacccatagacaagagtannnnnnnnnnnnnnnnnnnnnnnnnnnnnnnnnnnnnnnnn

SEQ ID NO: 5290 - DNA, 9293 bp, Oryza sativa
  unsure (1)..(9293): unsure at all n locations
nnnnnnnnnnnnnnnnnnnnnnnnnnnnnnnnnnnnnnnnnnnnnnnnnnnnnnnaataggttatactctgatcagaggtgtacatctttacccacaagacacatcttcctcacgtgtaaccacgtgccacataccaccacggtatacagacggaagacgtgacatagttcccaacccatcctagccatagacaagagtaccgacccaatcccacctacggccggaacccccgggacaggtaggcaggactgagcccctagcagcagggcaccaaccctgtgccatgacatctcgactaccgggccgcagctcgtgtagccttcatttgtcctagagatgtccatcgaatcccccgacttcgtccatctccatccgtgtacttttgtttataaccagactgagccacaaactaagccttacccattagacatgtggaagtacggtggtgctttgcaacagaggcccgaagaccggtccttatatggccgaggtgcgactatcaaaaccatgcaccccgagcccagcctaaaaccattttgagagttttgaatagagggggcggggtgaatccaattccacaataatccaacaattccagtgtccaggtgatatgaatattaccacagtctagggttttaaaaccacctaatgttacctaattaatcagcgaagcatctacctaaaatcatactagtgataccacaaatagagtgtccactagttgggggttttgtttattctagggtgaacaaggtaataatagcaataaaaataataaggtcgtaacaaaggtaataggcatggctaaataaaacagtgataacgcgggaatttaaataaagcgataatgcaataatttaaatcaaaataatttcagaaattgggattcaatatgttcaaggatgatgtgtcttgccttgctcgctttcccaaacgccggcttcaacttccacgaagagcggatcctccgaagctgcagcgtctacacgaccaacggaaaagaaaaggcttttactctaacaaactccatataaaaagcattaacaaagcacaaaaatgggttcttgacttcttaagaaaaaattagagacttgaacggtccaattctgagttcaaatggccaagttatagccatttgaagtttatatgctctttaaatgaatatttgcgaatttcttcatttaaaatttaatttaaaatcggatttattgcgtcagccgaggggagagggcgcgcggaccgggtccacgggagcggggcccacgccgcagcctcacggcccacggtggaccgggtgcacgcggctcacgccgaccggcgccgtgggccccaggcgtcagccgcacccgagggcgcgggcggctgacggccgagccccacgtggcagccgctcggtgcgcccggggggccggccattccggccggccggcgggaaggcggcgcccgtgccccgatggtcaccgccggcgaccaccggcacggcggaacagcgaccgagagaggggagggaaaggggaaaacgaaacggcggtccacggctcaccccgagtcgaaggcgacgacgaaaacggcggccggaacggaggaaggcggcggcgcggctcgggtcgacgggatcgacggcgttccggcggtcggtgagcgaagcggaggggcggacgaggtcggcgagcatgcggcgaagccgaaggaggcggccccggggcggaagatggtccggggcgacggcggcggcggaccggagctcggcggcgacggcggagagagagtgcgacggcgcgggctcgattccgacggggaggaaaggcggcaagtggcggaaacggtgaaggggaaggggatgacgggtgggccccacccgtcagcgagggtgcggggcgggcccgcccgtcagcggcgcgcgcgcggggagaaggccgagtggcccgcggggaaaggagagggaggggagggagctgggccgagccggcccaagagggggagggggagggaaagggaactttttagggtttttctttttataaaacctttttaactttgtttatttcttcttaattatcatttgtgctctgaaaattccactaaaatttatttacgcattttaggctttttaggaaatatacaaaaatcctccaagccttatttgacttttaactttgcacattttaatttttgaaggctttcacatggattttaattattctaatcataatttagaggatgtattttagagtcgatttgggacgcgacaatggtgccccagactcatatgttgctgacttagtgactatgctcatttgtgatttgtgaaactaatattagcttcagactgtcattttgtggctcatgtgatcatgtgatgtttaatattagctccagagtctagactgcaattttgtggctcatgtcatcaggtgatgtttatttgtgttttgcctaatgaagtaatgacaaatgataatgatccttactgtgattgtgatctataatttgctgatttgttgagtggagtattttggatatatttgatataatgtgattgtgaatatgttgtttaaccggggacgtgttcaccatggagaaaaattcaccgcgtggtgatcggggctagagaaattatagccccgttgtagttgacgggggcggggacagtgacatattttcaccgtggtgacggggacacgggcatgaccccgacggtgaattaaccattgccatctctattaacaccagactcaaagatgcaaaaggtgccaggactgcgggatgcaggtgcacgtcacaagcctgagaaggagcgatcgtatcgcagagaaagagagaggagaaacggaatgggatagaggacagggcatgaccattgatgggagatttttgtggtgcatccagcatatggtgggtcccatggtatgctttatatttttccttttaatttccgtcgcacttttggacgtatcaaagcatgcatccataccaatatacttatagcaaatggtctatatcatatacctaattaaagaaaatatgtaaagctttcggcgattttttttcaattgaaatggactaaacttagagtttgcttgtttagaatagggcttaattccgagtttgatacacaatggattttctctgatttttgggacaacggaaaaatgaaaagataagaatcgaaaccctcgatcaattttagattatctataaggaaatgacctgatttcacaagaggtggcttcagcccgtgttgggcaactgagagaatctggacagatatgggaaggcggagggaaggagaaaggaggaaaatgggccggcttagctacgggttgaggaagaaaattggctaaaaaaggcccatacacaaatgaggatttttatttagattttgttttaaataaatgctgaaatgatatttgtattatagaaaatagcaattaatctttgaaaattccgagaaaaaatcaaagagtgtaaataatcatgaagaatttaataaaaaattaaattcagccatgctattttatttcccacacttactttacttataaattaatttaattatacatctacctatttaaaaatacctagatatctcaggaaatttataatttaattaactacaaaatgtaaatctttctcaattgttcctcaattttctcgttttttcttcccttgcaacgcacgggcactttttatagtcttttaaaatatttgtagtgtttttatcatctcacctgacataatgacgctgaaaaaaaataggaaatcaaaaatagatagctcccttcacaaacccagattcgtattcctggtttgcaacctaggactaaaggggttgcaacccggactataaattctctagcagttccaatttctttaaagtattatgtaattcacgttcttattagctttgaaccatttatttaaaaagtggctccaactagctaaagagtactgtactctctccttcccaaattgatcattatataatgaaatctaaaatttctcaaattgatcatcatataactttatggacgcggatttcatcggaatacaattaatgcaacatcggagaatgtgtgcatgctagcgaccaattttattaccatttctaattcgatctttattcctgatccaattggtactacatctcctagcgccggtccccctgctccgtgccaatcagatctttgttcccgatccagcttctcctagcactggttacaacgctcggaggccggggaaagaccggccgcgacgatggccccaacctttggcaccctgtgtcatctcctcgcttagagcaggtacaatagtagtagactataaaccagctataaccactgcatatatcgagaaaaaaagagaagagagaaaaaagcgggctacaaatttatagctagctgcaacacggactctaatatgttatgtgtgtatgagatgtgggaccgggtattaatggtgtagtatatttttatagttaactattgtataaatgggctattagattatttatagataatttagagtcagtagttggctatactattaaaatactcttaaggattagagcccgccctctcgtagtgagttcgtttccaaggttgggtgctggggttcttggttaaatatggcgtatatacataagtatataacgtatataaattttatataagtatgtattaaaaaataaaaaaactagaaaatatattatgtatacaaagtttgtatacacataaaaagttttttacacgtatataaactttgtatcccgtaaaaaaaacaaaaaaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgatatatatatatatacacaccctaagccccggcctgcaacaaactacaccgatcgaccaggcgggcagcgagagatgatgcgcccctccggcctcctcatcagcggcggctccgtagtcgtgcggccggcaaccatggctgcgcgcgccccctcgcggcttccgtccgtcgtcgtccacctcccgaggtgcaccgccacaggagggccgccgcactgcaggctgacagcggaggcatcgtccgtcctccccaacatgtccgtagcgtccccatgggtcaacgatgacgacctcaccgaggtgatcgatcgatctcatcttcgatcatgatctcttaattctttccttcgatcatgcaatacaaatacaatatagaaaatccatattgattattctctaaattaatttgttgtttaatttcttttgctgccgatcgattactcgattaaattagttaggcacctgctgatccatcttgctaacttcataacttaaactaaaattgttgcattttgttttcgatgttccgttgaaacaactaatatttctatttattattagtttaatagtatatccttcatcccaatttgatcatcccctaaataaaaggtgcaaagacaaggacaataaaattttcatgtttttaaattaattatcaccaatcaaggtgctccatatatccagtggatattgcatcacactttaaatgttgcatggaattgcactaacagtcgtagcatgcatatggcttcatgcatgcattccattcagcgatgcccaattaccctttgcataataaataaataaagagacacttattattatatgataattattttaggaagacctcaaaatcgttaggtgatgatcaaattgggatggagagaatatctttagatctaatttatttatttgcttgtgtgatatattttcattattaaaaaaaatctgatttactcatatagagtcgtatcaattgtatgatatctatcgaatattatttattaattactccctacgtccctaaatatttgacgtcgttgacttttttaaatatgtttgaccgtttgtcttattcaaaaaatttaagtaattattaattattttcctatcatttgattcattgttaaatatacttttatgtatacatatagtcttattacatatttcacaaaaatttttaaataagacgaatggtcaaacatattttaaaaagtcaactgcgtcaaatattttgggacggagggagtagttaattatgagcataatatttacgtttttggcagatttccatctacgaggtaattgcgtggtctgcagaagaagccatggaactcatcaagcagactccacctccaccacctcctcctcctcctcctccctctcctccggcgacgcacgacgtgggccagccacctcctcctccctcccttgcagcgccgccgccggcgcagcacgacatgggcaagctactccgcatgtacgcgcggctgctccgccgcctggagtcgcaggccatcgacatgtacgccggcagcaggaggctggtggagtaccacgtcatggcgtggggcgcctacgaggcgacccggcccgcgctcctcggcctcgggttcatggcggggccagggatcgaggaggttctcatcgagtgcatcaacaggggcaacgccgccgtcgccgccgccgccgccgccggcgacggccagccgaggctgctcgccgcgttcgggatcaagccggagagcctgccggcgaacccgacggagaggcgcttcgtggccggcatcctgtacgctgcgctggagatgaggaactgcgtgcggaggcgggtccggtggctgaggagggtggagaggttcaaccagcggcggcgggaggaagaggcggaggcggccatgaggagggaggaggaggaggcgaggaggaagctggaggtgcaaaaggttcttgaggggtatgaggaatttataaattttaaataaatatttggcttgtttagattcaaggaattaattttggaggtttttcacagtaattaattgttttgatccctatgaaattactactttccaaagtagcacttagccttacaaagtactgaaggatccaagcttcacagtgcacttcatactattgaagggagtagttgcattttcaattgttttcagtggctactcgtgatagaaaccattatatatctttggctgttattgtgacttatatgttctaaactcatccaatttgtttttttggagccctttttgaaggaaattttatttatcttagacaactaataagacggtataattagtgcaagaccactctcaatctgtgcacgcatcatatgaattactttctaagaaaaggaaataaaaagacaagacaacaaatatcataccgtccgaactataaccactagggatcatcatcctcggacaatcaaaacagctcttctaaaacatcgtctctaaaaaaagaacaacgtgtgtacgtatcgacattgccatgatccaatcagtaaatataccataacataggttgtagttacactatgaagaaactcttctaactctatataataccttcaacaagctaggaagcaaataaacatgcatgccgccccaccattccaaggcggttcttccataccccgtacacttacaagcaagcaaataggcacactgctaaaattcatgctcttaacaagcacgccaataggcacatggccaaaattcatagggtccatctaaagagagagagttattgttagtgtaagtgatgcatctaaatagtggaagagttattatcagtgtaagtgatgagcaagcctataggcacatgcattcaaaatttgtagggtccatccaaagagagaaagagctagatctaaagaaacaaagagtgagtgttgtcggcataaatgatatcataatttgaaacaagatagcttcgacctacatgatgatataaaagtcagtaactagtgatgaagatgtgtcacaatgagtaactgcacctagtggagagaagggcttaggcttcactgccacctgcgcaaatacaatcactcccaccgttcatagatcaccactgcttaaaaaaaagtttgtgcggggcggtcaagaacctgtttacaatggtgttttagacccgcctacaaccaaggccttgtaaaaatcacatgatttgggcaagcgaaataacgaccgctcttggaaatcaatttccatggacgactcccttaagtttaaaggacttgcccatgagaacaaatttctagtttttgaatttgttggtgaaaaattccgtaatttagtagacacagcatattaaatcatactccatccgtccaaaaaaaactcgacctagggttacatattctcttttttttagggggggggggacggagagagtatgccttagatataatggctataaccgaaatgagagagtatgccttagatataatggctataaccgaaatgtagttgcaacttgcgagatgatgcaacagcctgttaattgaatgacaagatgcagagaaatcgggcaaaaaggcacacatcagcacactcgagatgatagtactaaagaaggaagacgtatatgtgaatccgtcttcgatcatgtgaaaccggaagcccaaaaggcacacatcaaaccattttcaaagatggaactgattgtttatgtcgacaaatccttcgcacaatttataacagttgacaaatccttagctcaatttaggcatcacatagttcgttcaagagcagcattcctcatcttacccaataagttatgttcacggaacaggagcaattattagcaggtaaaacaaggagcatcgcctcgtcaggtgcaacaccaacaccagaaccggagctaccaatgtcccaagcaattagagcattcacttcccttcaagttgtaccaattgccacatgacgacaatagtctttgattaatcaaaaccaatgaatcgaatatacaatttcagcatattctagcaaacaatgtaacattaatgaatcgaataagtagccgacacaaacaatggcaacattcagttcaagggccacatttcctcggggagcaaagcatatagcacacaactccacggtaagatagtaatagcatacgcagccacaaacttattggacgatcttgaaaggcatggttattgcaaaaaggatcttcttggttctctcactggttgagatcaaaatcaataacacgcacaaactctacgcaagtcattcacttggaaaatcaggtatgtcaca

SEQ ID NO: 5291 - DNA, 7692 bp, Oryza sativa
gtacccaatcaggtatgtcacaggcaccgggcatgctcgcccaggggtcctcaaggtcatgttcatcgccttgacctgcagcagctagattggtctcatcagaaagacccccatgaccgaaagcgtcatctgcatctttggcaaactgctcatttgagggcggcaattcttcgttaaactggcaataaactggcaaattcggttctagtgatacatcgtgcctccagaaagtagggtccaccaagggtggaggttggctgtcaaggaataggctgcttgcattattgttgatgccaacaaaagcatgacaacctgaaaagactaacagtaagttttatgtgatattgttcatgttaaaataagagtgagtacacttactgttctcgaggagatcatcaccaatgattggaaaggaagaactcagagagaaagcattcgattgaatcacttgattgcattgaacacgaggaaaacaagcatcaaaagatccttgggaatttgcaagttccccttgtccatgtcctccatgaaccaatgcatccagcagaccattgttgtttggagagagatattctgatctcagggagccaaagtcaacctggtcaataggatgtcctaaggggtcgtgatatgaccatgcattattattgttaaagtcatagttgggatattggagtgaagggagctctacattcatgggcctctgtatggtcccagaagtagagaagttgccatcaagaattggatgtccactgacaatggcactaccaaaaggtactgactgatcttgtgtggcaatggcactaccaaatggacttgtggcatcaactggaagagaatttggagtcacacaatttggccgaatataattttctggtctactatagtctaaattatcgaaaaaaacctctttgtaactttgaccatttccctgtaaaacctcatttgttcgtttcttggcacgtgattcatcagggctttcacagttcatcacttccagatctgtcaacttaaaatgattaaactccttcggatatagaggttcaccagttctctgaattctcttacatctagtgttccagaagttcttgatttcattatctgtgcggcctggcaactgcaataacaacaacagaagttcagatatgcaagttaacatatgatctaataggatttttctaggcaattagactaaagaaccttaaggcattagcctaataagcatttgcattgtacctcagatgttagaatggcaaatatagcaagatgtatcatggtgttgcaatagttggagaggatttaaacatacctaacgaaacagtgaatgatattgtctccccataaatgaaaatatgatgaagtcctattcgatgaacaaaaactcataggaatttagtaggaggcaggaaaggaacccaataaaagtttaaaaatatatatgaccatgtcaatgaatcctcccataataattgcagaccctaccttatcctgtggcctagatgtcagcttttcctgttgcagtttaaaagttgacactacttataacatggctcagaaaactaagaattgaaaattaaattcacatctttcgagattgtgtctagctagcgagtcacagtacatccgcctgcttacagtaacacaagggaaaaagacagttccatgtgttaactgactgtatagattcaagaaaataggtattctatttttttctaattagtgcaagctctgaatgctcaaacaagccgagttccttctctacagaagaggaataacagtaaaatatatatctagtttcttttctgcagtgcagcactgcaagcacgtgtgccccatggcaccacaacgcactaaagaaaaagtatgcccggcaaccattctctatttaagtccttagcaactaacgatattaagacaattaaattgaataaaataaagtctgtcaccaatatacataagaaagaactatttaatgtccactgattatatccagacactagcaaatagtatatatggagaagactgcactagacaaactgttagctggctttaatctaaagacaatattttcctctaatccaatacaccaatgcatctaaatatcagatacatgattgcaatatgccgtttggttttctacggatactcgactgctattctcgggaccacacctcgagagctattctacggatacatgattaatagattatatactgcttgattaatagattatatccagagcaagggtctcgacctcgccgacctcatctggttgtcaggtaaactattcactcttccattaatttcagtatttcaccatccatttcagagttcagacttcaccatcaatattagttgcagtttcacctgatgacagtatcgtttctgaaaagaaaagtaaaaccattcacttaagctaatgaatggttaacttgacacaaacggcagccaaagatcgattttcacgttatatcctaattaagtcgattgattactagctagtcttcaggatagaactcagatttggtgttatatctagcttgatctagctagctacgtggtgtttgcaaatgcgtagtacaaaccaccaacaaatagtgaattagtgatgtgatatcgtgatgcaatatggagaaaacgattgttaacttttgcaaattctttatgtgttcagtccgcaactaggacacactctcactctcactcactcaggcactcacatcacaccagtaatgctgtccctaaagattcagaagatgaaagatatatagcctcgatcacaccgattttcatgtagtaacaatactaacaaacaatgatcctaataggaacctagaacagtgactacagtctacagatgccgaatttctatccattatctacaaaattctcgagccacgacaatccagaattgaacagacagcttacgtccaacatggaggattgggtctacttaattcatagaaggccaaagcttagctgaattttgttcacgggtatcgcatcaaatcaaagttaaaaaacagtttagatacgctgtttggttttctacggatactcgactgacaatatgccgtttgttctgattataaactaaacaatttatattaatcaagcagtatatcatgcttctagataggtagtatatatacgactaagttgtaacttgcaaaggttttgcagccaatggaggccagtgtccaggtaggcagccatgaggctctgcccctgcttatgtaaagccactacaagcaagaagatttaaaggataattggtctgaatcaattttctttcgatttgttggaggaccaaatactatttcagacaagactaacaacaattgtaaaagaacgacttactttgttattctctgcaaacaaggaataatggcaaagcatttgtctactccttttaacaaggccatttacaagagtgcagcatgtcaaatgtgtctgcaccatggcactacgccacactcagaaaaaagtatgcccagtggccattctctatttaaatcaagttggagccaattaaatgaataaaataaagtctttcgccaatacagaagaaaatactggttgatgtactctgaatacatctatctacgagcaagtggtatatttgcggcccctatatttggagtggacagcatgcattctccccactaggcaaactgttggtaggctttaatttaggtggttaaatatttttgctctaatccaactaatacaccaatgcacctaaatattaagcatgctactaatctaaactaacaatgaacggagtatcaatgcacaagctagcaaaaccaaggaaccatgaaagagtaggaggaggagcacacttacagagtttgccatcttagcccacttgttccccagccataaatggagcttgatgatcatctcctcctcttccttgctgaagggccccttcttgaggtcgggcttgaggtggttcgcccagcggaggcggcagctcttgccgcagcggttcagccccgcgttcctctgcacccggttccagttcccctcgccgtgcgcctccacgtactcccgcagccgcttgtcctcgtcgggcgtccacggccccttcttcaggggaatcttgccacgcacgcgcacacggccgccgccgccgcggcgacgaacccccgccctagccacaccgccctgctccttttcgccgccgctggcgtcaccctcatcatcgccgccgtcgccgtctcggtctccgttcgggtgcagcatcgccggcgactccccctgcgagccggcaagcctccccgcctcctcctcctcctccatcgggaagaaaccctccatcttcatcctgcacgaggaaaatccagtcaaatccccccaccaattcaacaaaaaaaaaatcaaaaaaccaaaaaccaaatatccaacgatccaatctcgctccaccctagcccgaactaatccaaccagcggcgcgtggatctccagcgggggagagtgctcaccggcgtcgagacgaggtgggcggcggcggcggcggcggcggcggcggagagcgaagtagagtagtagactaggcggagtagggaggaggaagcaagtagtagacgacccccgatgacgatggctcgtgtcctgggccggaatgggctgccatctcgaggcggcccaactagggtttgcttcgttactaaggtttatcatgtaatttttttataggaaaaaaatatcaaaccctcttgtttattttatccatggaagaattattatatatccattcagataggataatgttttaaaaaaaggatatatgtatttaatattaaattccatggatgaaacgtggaaaagatatcttagtatttaaaagaaacaaaggatatatattccgcgtgctgaaattaatgttaggtacgttctctcatattaaggttgttttgaattgaagccaacacgtgtcctactgaatttttggtaacttcaatagttaggaaaaagctagatgtgtcaacattttcttgctaaattcttaattattaatattgatgggtcatgctatgggtgtatttagatttttataacttacatcttgatgaaattattgtcaaagggggagaaatatacaaaatgcatacttcttgaaaagggcggaattgaagttctagactcagtgaggagttgaggtccagacggtcaaggataccgggtgacgaagttggatacgagatggcatacggtggatggataccgtgtgggtgaaatctttgcaacgggcttcacgaggtgtgcgtgcaagcgtcggtgttcgcgaaggaaattggaaagtaagagtatatggtgctacagtacacgtggtactgtagcatgcatatatgtgtgcctactatgaattgcagtagcgtggtgatgcatgttgtgctatgcatgtgtgtatgcgtactgtgcagcatgcagcggctcggcttggtgatgcaagcagggcgtcggctggcctgggcatgtggcaaggcaagccgagtctgactcggtgaattttctgtggccggctgtggctgcaggtttcggagagtttgtgagaattacaattttttaagcaacttttgtacaaaaatttttttacaaaaaatacaccgtttagcggtttgaaaagtgtgcgcacggaaaacgatcgagaggggttagaaaaagagggtgccgaacacacctcattgtgccaagatgaaatatgactatcaaaagttgatggagggagtacttaattaattatgcactgcataatgctcacatcctaaaatcatgcaccagcgcgcttcactgtaccaccaaccagcagggcagccaccattggatgaaggcatgaagcacacacgtcctatttgattcgatccccgaattttgcctggttgccaatttgcgtgacagtggaacgcaacagcgcaactcgctagatagctgtacatccatgtgcaaacgaatgaattactaacgattattatgtgcacaagcaaacgtacgtgtaacacccttatatcggagcgggccaaaaaattcaaatcagcactgaaaaggtggaactaactgctggcccgctacaaaaaattttagaaaggtatttcgaatggaagttttttttactgctgattatcggttaaaaaaattggttaacttgtaacgatggggtgacgtttttcatttcgatagtgggtaccatacagggtttgccattcggattgagcacgatccacctgtgtaaccttggtttacaggactgcattgagtgtttcttagatttagtggtgaacttcctgaaaacgatcatttgttttgtccgatgaagcttacataaaatctaggatgcaataataaacctcgcatttgtgttgtttcccgtgaagccattcgaaacagattatctgtttgtcaagcggtgtgcacatttatggaagtctatggatatatcacggtaatgtcacagcttgttgttgattcacatccttttctgccagtggtattcctatagtattcatttctacaaataaaatggattaaaaataaatttattatgagacgtaagaagtaagtacatgaataattactgaaagcccaaagcgaaagggggcaaataaaaaaggcataatgcgtgcatatgcttttcaaatttcaagtagtttgaggttggcgcatgcacgcacgtcggccgctcgctcgctgcaccctgcgtgccggcccgcgaggcgatcagtcgagtcaggctgcattgctggctgctgcaacttcaacacgacgcgcgcgcgacgggatcggagacggagacggcagaggcaaagaccgccgtgcggcgcggcggcgcgcggcatgcggcgtactccctccgtccaagaaaaagttagaccatagatttccgtgtccaactttaactgtctgtcttatataaactttttttataattcgtatttttattgttgttagatgataaaatatgattaatattttatgcgtaacttgtctttttaaattttttttataaatttttcaaataagacggacggtcaaacgttgggcacggaaatcagggtttgtattttttttaggacggaggaagtagtagccaagatctcgtccgtcgtgtccctctccgcaagggcgacgtccgtagtcgcgcgggcgcgcgcgtagtacgtagagtatcgacgacttgcgcatgcgcgttgtttcggtcgggccaggttcgtgccacctgcaggcttgcagcccacagccacacatggagggaggcaacacgggggcgcgtacgcttgtcgcagataccgcccggtgcgcacgcgcgtgcacgtgcgccggccgttgactagctggaaaaaaaaggttaaaaatatagtagtattatttttcttctatgattttgcgtggatataccggattaacaatgtaattacgcaatccctgaatccctaaaaagaacgatacattttgagagcgtccgattagttagttaaaaaacggggacgcggcggagtcgaccgacaggcatgcgatcgatcaacctcagcgactcctgccggccacctagctcgatccgtccggaaagcgaacgcgatcgatcaacgacgaagccgcgcgcggcgcgcagcagctagcggctagctagcgcggcatgcacgcagatgcaggtgcgctgcatctcgcgcggggggggggggggggggg

SEQ ID NO: 5292 - DNA, 879 bp, Oryza sativa
tgggatttcttttttgagggatttcagggagtaggccttcttcacacaacttgtggaacaccaaattatgttgctcctgaggtatgatgctctctctctctctatctctcaatgcatggtaaattgaactgtacgaaatgttttttttttggcaaggagctaattgattagctacactacatgcaagaaatatgtctgcaaaattagacgagttactcgggatgcaattcaattttcctagattttctttatagatcatatttgtatgtatgatacaaatgtctgttagactagaaagagattacctatttctttgtttctctacctgtctcgcagttatttggttggttagttctcttcagggttctaaacctcatttttatgcatatttctgccatcatcactaaataaatatctctagctgtcttatttcaccatgttcaagctattgtgattttaattgtctgaactagttcataaaattgtgatatgggcatttcaagccatttccttagacaagattaggggcatttttttagtacatatatgatatgcgctttaccatgtgtcaatgttttaggtgcttagcaacaatggttatgatggatctgcagcagatgtttggtcatgtggtgttattctctatgttttgatggctggataccttccttttgaggaagatgatcttccaacactgtatgataaggtattggcttcattactaatgtgtgcagcataagtctttctttccctaaattgttgatgtgaacacctacataatcgttctactcagatgagattgaaacctgatatgtttactcctacattaaaagattactgcaggtcagttttcatgcccttattggttctcttcaggtg

SEQ ID NO: 5293 - DNA, 447 bp, Oryza sativa
  unsure (1)..(447): unsure at all n locations
nnnnnnnnnnnnnnnnnnnnnnnnnnnnnnnnnnnnnnnnnnnnnnnnnnnnnnnnnnnnncataaattgtaaaaaaaagaaaaaaaagaaaagccggccggccggccactgccgcctcccctccttccctccgcgccggccggtcgccgcagccgcacgggcccccgtgccgccgcgccggccgccgccgagcggcccttcgcctgccaccgggcgatcccccgcgccgccgcgcaggccggctccgcgcggacccccgagcctccgcgctggccgactccgcgcggacccccgcgccgcctcgtcggccgccgtctgcttcgctgtgacgaatggaaggaaaaaaaaaggaaagagaaggtaggagttagagataaggaagagataagaagttggagagggagaaagagatagagggatgagtttgttgtgtggacgggaaaaga

SEQ ID NO: 5294 - DNA, 1169 bp, Oryza sativa
cgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtatgcccgttaggactggaagttcataagattcacgcatgtccaatacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgattgcacgctgaagagcgtcaacaggacgggatgctgagacaccctgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtgga

SEQ ID NO: 5295 - DNA, 1728 bp, Oryza sativa
ttgtgaaagagatccgtattctcgggcctatgtaccttcacaacatgtttccttttgagaggacatgggcgttctgaagaagtatgttcgtaaccgtgctcgaccagaggcaagcatcaccaaggggtatggaacagaggaggtcatcgaattttgcgttcaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattctagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgatcttaacaaggttggatactcggaagaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttgtaaatcacacaggtggcaatttcatatgtatgttaattagagtttttaacatttaatttactagcattcatatgctaattataattgactagaggatttttaaaagttttaaatcacgcaagtggcaatttcatatgttaattagaatttttaacatttaatttactatcattcatatgctaattataatcgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaaaatttattaattttaaatcatgcagtatgtacatacatatcttaatta

SEQ ID NO: 5296 - DNA, 14228 bp, Oryza sativa
  unsure (1)..(14228): unsure at all n locations
cgagaacgagaaggatcgaacgaagacaagcgagaacgagggaacgaacgtgaaggagaacaagcgaacgaacgtgaacgagctagggaacgtgaacgagcgaacgaacgaggacgaacgttaacgtgaaatgcaatatatatatatatatatatatatatatatgttacttcgcatttatcctaatacatctttttgtatcttgcagaaaagacgtgttgtcggagtgtcgttcgtcaagcctgagtggaagagctagccctagaagtaattggagcaggcaagtgacgtaataatataaatgattgttatatttgtaatgcaattaattaagattattagacctgtaattagacttatcatataagattgtgtagtggtctaatattatttgagtttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactgcggaagtggtgcgacaagtagcaattgactattgtagtcttaattagacttagcatatacgcacgaaacacttagcatacatgactattctagtcttagcatgtaatattatttgagttttaatataagattactttatttgtaattagacttagtatgtaattattgactacggaattggtgcgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgtgggcaacgaggtgcaacgaagaagcttgagggtcggcacatcataacggaagtggaagaagatggacgtcctagtgccccggccgaagccgccaagaactatgtacgtcatagcggttgggttgtgcgggataacgtgcctgtcagtacggtgtactggcgaagaacaagggcacgcagagatcatgagagctttgtcccagattcggagaaagagatgctgtggaccacaatgctcgagacattcacccttcctgtgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagctcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagctaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgcactgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatctcgctacgaactcaacatgcaagaggagatggcaaggaaggttgatgaacgcatggccgcacatcggtcccatgatccccagccgaccattcctcctgcaatggtgagcccgtcaggaaaccgtagcagctgcgcctcaacggggcaggtagtgtcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggaccctttaggtacttaccactgcaggccgattccagcaggatactcgaaggtcgaagttgagttggtcgaaggcgcgtacgaggacctcgagctggattaccctggaggagacggtgagatgcatctacgagacacatgccatgccattattctatcgcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctgcccacacaaggacccgaggtacgattgcacgcaagaggagcttgacgcttacgttgcatcagaagtcaagagacaattcaagcctcgaagtccagaaaagaagattcctatagaccccagtgtcagaaacttctttaggggtatgtctgcatctgtcaaggaggccatcaagctatcggactatgagcgaatgctgaagaaagcatcttctggaaagtccaaaccagtccctcagcttggagagcaaccaaaccaggagatcgagcagttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggacatgagcgccaccggtagagagatgatcgaagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactcccttttatcgttgtagaaaggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacatagagttagtttaattttacagtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccatcatttggtccgcggcaaatggagagaaagacttaggcggaagttcaaatttcctgtgagtacacatgctctacatttatatttctccgattcaaatacatacaagtgtatattaatttgatctctcgttgtttgtcatttatttgtagtgcgcaaagcaaaagcagggaactaacttgtgcggcttttacgtgtgcgagtattgccactgccttgcagaccaaatcatcaccacaagagagctcgatgtacgtacaaataaatttaaaatttcattacgtagcgatttcttgtttaattactaatcaatttcatacattcatatagtttattcgcatgagggataacctgaccacacacaaggaatttatcgcggcggttcaagaacaactcatgggattcatcaacaaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatacatgtgtacacattttctataatgtaaatatattttggtcatatatatatctatatacatatgcatttgcatatcatatatatgtataaatacatatatattatgcatgtatatacatataatataatatatatatatacatatatatatatatatatgtatgcatatatatgtattgaaacatatatatgcatggtttatatataaaccatgcagcaaaagggccatgcaaaaaaaaaaggtcagctcgatctttagtcccggttggtaatggctcagccggccacgtggctaagccatctttagtcccggttggtagatcgatctttactcccggttatttcacccgggactaaagatagcgatctttagtcccggattggtactcccggtttggaaaccgggactaaaggggggttacgaaccgggactacaaagggtttctccaccagtgatacttttccaatctcaagccatcaaacatgataattttcttttgaagtgaagcaaaataataacaaataatatgataagaagattttatagtgagaataattttatttgattcttgagactttaaagcgtacaacaggttctgttatttaattatattgcaacacgtgagcattcacctatttattttataggaaggaagaaataagccatatatcccattgtggatgagaagttggagatgatcgaacacgatggataagagggtggtttttgaccatcaccgaccagtgacgaggcctacgacctagctatggacacacacggcgcggcactgtaacgaatcacgtaacctaaagcaaaactccacagtatgtatgcatggagccccattcgtccgtccctgcagctgcagcagcatttaccttttttcctttctctgttcctgatgaattagttcaagatggataggaaattaggagtaggacagggcaaaatctttcttgcctcccctagctacctagctagtggaccgggcctagttccttttagcaaagtaatcgatccacttttctctacaatgcaggggtgacctgatttcctaaactgccggtaaccacgtagttaccgcgcttactgtggatatgataaaagaaaaccacacttactgtggatatggtaaaagaaaaccatagtaacctccttaaattcaaataaatttaaaaataatttaaaattttaataaattttatattgtttcgtacagcttctcatggttaccgcgcgataactgtgcttactgctggggcccagtaaccccggctccggtggtttgggtaaccctcttcttgcacgttcagtgtgacagtgtcaacaaagtcatcacaagagagactgtatttttgaggcactaggtaaatagaagaagctcgctgttcacacaggcatgtttattgcaacgggaagaaaaggcaaaaaaaaatgaggaaaagttaagaaagattcacattatacaattaattaaaatacaaatttcccaaaatacttgggtgtgtataattaaattaatttacaagtaaaataagtgtgggaaataaaataacatggctggattttatttttattaaattatccgtgattaattgcactctctaaattttctcaaaattttcagagcttaatagctagtctattaacttaataaagtaatagaaaaaaaagccaccatgttcattctcgcggtctagatattatcacgttaatcgaagaaaaaaacaaaaaaaacaaatggacatgtattcttttggaaatgtgacataccagaaacacactcatgcattgtataggtttaggaaactgatcacaactcttactcggatgaaaattagaagaaaaaacaaacggacatgattctttttggaaatgtgatataacaataaatacttgtggagattatggatatcccatatctatacggcgatgatatttggattgaatataggataccgagtatagatagaatatcttatgtgtatcctgggtttgtttcctaacttgtatatcaaggaaacaccttgagacttagtcggtcacgactgtattcagttagggacatagattatcttttgtaatccggactccttcctatatataaggggggtccgggtgcctttaggggcagatgttgattttctctaaatcatacaatcaataatacactcggcggattcatccccggacaggagtagggtattacttcttttataagaaggcctgaacctgtataaatcctttgtctccaaacccatacacttttccagcttgatagccacccccttttattattgccgaaatctagtttcgacagttggcgcgccaggtaggggccgcgtcaagcttttcgccgatcagtgcaatgggttccacctccggcatcgacgacctcgtcttcccgcccaggcagacgtttcggttcggcagcctcgacttcgtcaccaacaacttcggcaagatttctctcctcgactcggaatcagaccagtcgggagagaaccgaatttcggtcccgtttggattcccgaacgcggctgaaagctacttcaagaccatctcaaccgagtcggcttcaaaccacccggccgagatcgcatcttctctaacgacaccagatcaagatgatggggcttacccaccagtcctgatgaagctccccgacgatttagcggccgtctccaccacgactgcggcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgatatcgtggagtacgacgaatttagttctcgctacaacgacttcgacgacttcgacggaagcctagatgacaactacacccctctctactttggcgttttcatggccaataatgagacggaggagcaacgccaagcccgggagaccgaagaacgtcgccgactggaggaggagcatcaagcacaagaacaagaacggctacggcgtgagcagcaggaccgtgagcagaccgcgaaggaggctgaggatcgacgtcagcgagctttggaagcagggcgccgagcgcgtgatctcatcggccagcaagatgtcgaagggacaccggttttccgcacccctcaacagaatgcggttgccgcgatcacccttctcgacatcctcctcaaccaaaacgagctcaatcgatccgaccacgtcgtcaacatcttgaaccagacgaagaccatgattgcggcttcggtcccagttaactccgaaagcgtccacacaccgactggcagccgagttccccacttccgatctcatgactaccgtcatccaagcctcagcatcaccggcgcaggatccaaccgcaggagcaggggtcacgacgagcggtctgttcactcacctcccgaccttcatagggagcgccgagtggaacggcctcgctcaccacctcgtcgccgccccatcgatcttcgcgacacaatcatacagcgccgagcagctcgaggctaccatcactcgccagaccgccacgacgacgaccttgacggagtagcagccttcaccgacgacctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaactatttaccagtggctttagcggattccgcccgatcttggctccatggattgccccgtggtacaattggatcttgggccgaactacgcgaccacttcatcgccaacttccaaggcaccttcgagcgtcccggcacacaatatgatctctacaacgtcattcagaagtccagagaatcccttcgagattacatccggcgattttctgaacaacgtaacaagatctccgacatcaccgacgacgtcatcatcgccgcgttcaccaaagggattcgccacgaagaactagtcggcaagtttgggcgtaagcctcccaggacagtcaagctcatgtttgaaaaagccaacgagtatgccaaagctgaagacgccgtcaccgcatcaaagcagtcgggtcccagttggaagcaaaacaagggtacgccggctacgggaggaggtggaagtaacaatcataaggaccgcaagcgtaagcctgcggaacttgttgcaaccgccagtcactcttcccgacagcgttcgcgcgtcaacacgttcgataagatcatgaactcccaatgcccgcaccatcctaactccaaccacatggccaaagattgtttcgtctataagcaattcgcggatcaatacaccaagactgcacggaagaactccgacgaagaacaaagcacgtcgaggaagaaggacgacggcgacgccccggcaggatttcaagaccaccgcaaggagctcaaccatatcttcggcggccccttggcttatgagtctaaacggaagcaaaagttgactgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccaggactatccgcaactccactcggccagatcaccctcccggtcacttttggtactcgggaaaactttcgcacagagaacatcagcttcgaagtcgccgatttcgagacagcataccatgccatacttggacgcccggcgttagccaagttcatggccgtcccacactacacttacatgatgatgaagatgcctggtccccgaggagtcctatccctacggagtgacatcaagcaagccgtcacatgcgacaaggagagttgcgacatggctcaaacccgcgagatggcgtccgcccgagaggatatccgactggctgcagccacggcgagcgaaggagaagtgcccgctaccaagatttcaaagagtggggaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacacgtcaaagaagatgccaagcctatcaaacaacgactccgccgattcgcacaagacaggaaggacgcgatcaaggaggaattaaccaagctgttagcagcaggcttcatcaaagaagtccttcatcccgactggctggcaaacccagttctagttcggaagaaaacagggcaatggcgcatgtgtgttgattataccgacctcaacaagtcttgtcccaaagatccttttgggttgcctcgcattgaccaggtagttgactcaaccgccggctgtgagcttctcagttttctggattgctactcggggtatcatcagatccgactgaaggaatccgactgcttgaagacttcattcatcacgccctttggagcttattgctatgtcaccatgccgttcggactaaaaaacgcaggagcaacttatcaacgtatgatccaaagatgcttctcaacgcagatcggccgcaacgttgaagcctatgtggatgatgtagtcgtcaagaccaagcaaaaggatgatttgatctcggatctagaagaaaccttcgtgagcatccgtgctttcaggatgaaattgaaccctgaaaagtgcaccttcggagtaccgtcagggaagctgcttggctttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctgctgaagaaaacagataacttccagtggggacccgaagcacagaaggccttcgaagatttcaagaaacttctcaccgagccaccagtcttagcctcaccacacccgcaggagccgttgttgctgtacgtatcagctacctcccaggttgtgagcacagtcttggtcgttgagcgcgaggaagaaggccatgtccaaaaagtccagcgaccgatttattttgtcagcgaggtcctagccgattccaaaacgaggtaccctcaggttcagaagctgttatatggtattctaattactaccaggaagctatctcactactttcaaggtcactcggtaacggtggtcacatcatttccactcggtgatatactgcacaaccgcgaagcaaacggacgtattgctaagtgggctttggagttgatgtctttggacatatcatttaagccccgaatttcaatcaagtcccaagcgttagctgattttgtcgccgaatggaccgagtgccaggaggatacccccgcgaagaacatggagcactggaccatgcattttgacggatccaaacgactttcgggcactggagcaggagtggttttgatttccccaactggagaaagattgagctatgtgctttggatacatttttcggcgtcccacaacgttgccgagtatgaggccctccttcatggactacggattgcaatttccttagggataaagcgtctgattgttcgaggcgattcacagttggttgtcaatcaagttatgaaagagtggtcctgtattgacgacaatatgatggcatatcgacaagaggtgcgcaaattggaagacaagttcgaaggactcgagctcagtcacgttcttcgacacaacaatgaagccgccgacagacttgccaattttggatccaagcgcgaggcggcgccctcagatgttttcgtcgaacacctttatacaccgaccgtacctcataaagatactactcaagatgcggacactcatgacgtagctatggttgaagccgactggcgagagcccttcatacgatttttaacttctcaagagctccctcaagataaaaatgaagccgagcggatttcaaggcggagcaaactttatgttatgcatgaatctgagttatacaagaaaagcccttcaggaattctgcaacgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaattgtgcgcacatgtgaaggttgccaatttttcgccagacaaattcatctaccagctcaagagttgcaaactatcccgctgtcttggccgtttgcggtttgggggctcgacatggttggcccgtttaaaaaggcagttggctgttacacgcatctctttgtggccattgacaaattctccaagtggattgaggccaaaccggttgtcacaatcacagcagataatgctcgagacttcttcatcaacattgtgcatagatttggagtgcccaatcggataatcactgataatggcacacaattcactggcggagtttttaaagacttttgtgaggacttcggaattaagatttgctacgcctcagtggcacaccccatgagcaatggacaggtggagcgagctaatggcatgatacttcaagggattaaagcgcgtgtctttgaccggctaaaaccctatgccggcaaatgggtgcaacaactgccatcggtactttggtctttgcgaactacacccagtcgggccacaggccagtcaccttttttccttgtctatggggcagaagcaatgttgccgagtgaagtcgaatttgagtctttgcgctttcgtaattttcgtgaagaacgctacgaggaagaccgagtagatgacttgcaccaattggaagaagcccgcgaagcagctttgattcggtcggctcgatatttacaagggttgcggcgctatcataatcgcaatgttcggtctcgtgcctttttagtcggtgacctggttttgaggaaaattcaaactacacgagatcggcacaagttatctcctctatgggaagggacatttattatctttgaagtcacccggccaggttcttatcgactcaagcgcgaagacggtactcttgtcgacaactcttggaacattgaacatcttcgtcgtttctacgcttaagtttatcattgcacttccctatcttgactgtcaacatcaagttttcttcttgccgttgtcagtcgggggctatcatcataataatggagtgtgattttttatcaatttaatttgcttacttggtctatcattaccttgaatgattttttctacttactctgcgaggactgaaagtttttaatagcttctttgggttccaggctcaacaaagcttgataaaagcttttaagaaatcaaagacttggttagaactatcaagcacagcataaatacaccagcattgtacaaattaagcctccatttgctacatttacactcagtcagaatcagtcttttcatcatcagagttattattgctcggctgaaggtcgttgttgcggaattgctctacaacatcacttgcaatcttgtcagctgcattttgagcattactgataagatcaagagcagcttcttcgcttgtcccgtctgcaaagccatcaatggcgtcaatttcaatcctcgggtacaaggatttggtcatcgccaatgccatactagctcccatacttccagctttcttgatattcttgaagtatacatccggtgctactctcagcttgtcaaagatttcggttgcgtcaagtgcactcggaccactgtcattaaggaacatagcttggacaagtggtgtagcgacattggcgacttcgtctcttgctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5297 - DNA, 639 bp, Oryza sativa
ggttacgaacatacttcttcagaacgcccatgtacctctcgaaagaaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaccaagccaagaaggtttacgcaaaggttcttagtgaggtgcatcacgt

SEQ ID NO: 5298 - DNA, 745 bp, Oryza sativa
catgctgacgccctcttgggggtgtgtattgttgtttaacacgcttggcggggtggcatggtcaaaacgtttatgaggatttatttttaaattaaaagtaaaataataataaacattatcgttggaatgttttagtagggctctaggtcctatattctggtcttatatagcaggccggtgcttaagcaaatggcagtccatttagaacattttgaagaccatctcatattcattgcaaaaattaaattcaggagtgcaataaccgcactgcccatcaatccatacgaaattattcataagcctctgatccactatcctggctgatcaatagagccatgcccactcacccacacgctttttattttttctatctttttaataatggaatgaaacatcttggcttttgctcaagagctatagccaattattacaaggttcacacaaaaacaaactcacacagtgagtatgtagccagtagccaaagtaacaaaaccaaaagtagaagcaaactaataagaatcaaacaaggtaaagacctcataactactgaattctattgatgaatctccacttgaagttggcaaagagcttcatgatcgtcgactcaaatatacgacacgcatcttttattagcttgatatgatcatcatgtctttgtaactgagcccattcctagagccaatatgttatcctgaaaagtgcctacaaataaaattttgaaggtgatctatcaaaaatcatttct

SEQ ID NO: 5299 - DNA, 9609 bp, Oryza sativa
gcttaccaagtgtgagttctggttgtccaaagtcaaattcttagggcacgtgatatctgctaaaggagttgctgtggaccccgaaacagtgaccgccgtcactgattggaagcaacccaagacagtcacccaaattcgcagcgttttgggtttggcaggatactaccggaggttcatcgagaacttctccaaaatcgctcgacccatggcacagttgttgaagaaagaagagaaatttgtgtggagcccgcaatgcgagaaggcgttccaaactctcaaggaaaagctggtttcctcgccggttttaatcttaccggatactcgcaaggacttcatggtgtactgtgacgcttcgcgccaaggattggggtgcgtgctcatgcaggaaggtcatgtggtagcctatgcctcacgccagctacggccccatgaaggcaactaccctacccatgatttggagttagccgctgtggttcatgctctaaagatctggcggcactatctcattgggaatcgctgtgaaatatatactgatcataagagtttgaaatacatcttcactcagtcggatctgaatcttcggcaaaggagatggttagaactcatcaaggattatgatgtgggaattcactatcatcctggtaaggccaacgtggtcgccaacgctctaagtcgaaaaagccactgcaacactcttggcgtccgtggcattccaccagaacttaatcaacagatggaagccctgaacctaagtatagttagtcgtggattcttagctacgctggaagccaagcctaccttgctcgatcaaatccgcgaggctcagaagaatgatccggatgtgcgtggactcctcaagaatatgaaacagggtaaagccgctggtttcacagaggatgaacacggaaccctatggaatggaaatcgggtatgcgttccagacgacagagaacttaaacagttgatacttcaggaagctcacgaaagtccttattccatccaccctggcagtacgaagatgtacttagacttgaaagagaaatactggtgggttagtatgaagcgggaaattgcagagttcgtggccctttgtgatgtgtgccagcgtgtcaaggcagagtaccaacgaccggccggacttctccaacctctccaagtaccagaatggaaatggggtgaaattgggatggatttcatcaccggacttccaaaaacccaaggcggatatgattctatatgggtagttgtggaccgacttaccaaggtagctcggtttattcctgtgaagaccacctatggagggaacaaactagccgagctctacttcgctaggatcgtgagtctccatggtgttcctaagaaaattgtatctgataggggaagccaattcacctctcacttttggaagaagctccaagaagagttgggtacccgattaaatttcagcaccgcgtatcacccgcagacagatggacagaccgagcgtctaaatcagatcctagaagatatgctccgtgcctgcgtcctagatttcgggaagaccggggataagagtctcccctatgccgagttctcctacaataacagctaccaagccagcatacaaatggcaccctatgaagcgttgtatggacgcaaatgccggacaccgctattgtgggaccaagttggggaaagccaagtgttcggaactgatatcctgagagaagctaaagctaaagtcagaaccattcgggataatctaaaggtggcacagtcctggcagaagagttatgcagataaccgacgccgtaatctggaatttgcagtggacgattttgtgtaccttcgggtcacgccattgcggggtgtacacaggttccagacgaaagggaagcttgcccctcggttcgtgggtcctttccgtatcattgctcggcgcggggaagtcgcttaccagttggagctgcccgcctccttgggcaacgtgcatgatgtgttccatgtgtcgcaactcaagaaatgtcttcgagtgccatccgagcaggccgattcagagcaaattgaagttcgcgaagacttgacctacgtggaaaggccagtgaaaatcctggacaccatggagcgcaggatcaggaaccgggtaatccgtttttgcaaggtccaatggagcaactacgctgaggaagaagctactacgctgaggaagacgagatgaaggcagcccatcccgatctcttcgtcagttcttccgaatctcggggtcgagattccgtttaagggggtaggtttgtcacgtcccaaaacgactctaaaatacatcctctaaattatgtctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaaaccctaaaggtcccctttccctccctccccctcttgggccggctcggcccatctccctccccctctctcccctctccccgcgcgcgcgccgctgacgggcgggcccgcccaccaccctcgctgacgggtggggcccacccgtcatccccttcctcctggcagctcccgccgcctcgcccgcgccctagcgccgccgccgccgccgaatccgccgcatcccgtcatccccgcgtgcaatcaataggggggaattattccccttgattctctctccctttcccccatttttccctctctctctcgcgttcaaacggcggacttgcccccgcaagtctcgccggcgccattgatggcggccgacatcccgcgccggtttccttccttccccggccgccctctctcgccccggctctatttaaacccaccccgcacctcctccgtccgtttccgcctctcgccgcccttcctcctcaccggaatcgagctcgcgccgtcgctctctctctccgccgtcgccgccgagctccggtccgccgccgtcgtcgccccagaccacctcccacctcggcgccgcctccttcggcttcgccgcatcctcgccgacctcatccacccctccgtttcgctcgccgaccgccggaacgccgtcgaccccgtcgacccgagccgcgccgccgccttcctccgctccggccgcctttttcgtcgtcgccgtggacctagggtgagccgtggaccgccgcctcttttcccccttcccttcccctctctcggccgccgctccgccgtgcctatggccgccgccggctgcgccggcttggctgccctcgggcgcgccgagtggctgccgcgtggggcccggccatcagccgctcgtgccctcgggtgcagctgacgcgtgggacccacggcgctggccggtgtgagcccgggtgcacccggtccaccgtggaccgtgagggtgccgcgtgggccccactcccgtggacccggtccgcgcgccccctccccttggctgacgcaataaaccctttttaaattaaaatttaaatgaagaaattcgcaaatattcatttaaagagcatataaacttcaaatgaccataacttggccatttgaactcggaattggaccgttcaagtctctaattttttcttaagaagtcaagaacccatttttgtgctttgttcctgcttgttatacggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttataactctagactttgggaatattctcatcacctggacactatggaatggttggattattgtggaattgggttcacacctccccctctattcaaaacccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctataggacaaatgaaggctacacgagctgcggcccggtagtcgagatgtcatagcacagggccggtgtcctgtagctaggggctcagtcctgcctacctgtcccgggggttccggccgtaggtggggttgggtcggtactctcgtctatggctaggatgggttggaaactatgtcacgtcttccatccgtataccgtggtggtatgtggcacgtggttacacgtgaggaagatgtgtcttgtgggtaaagatgtacacctctggtcagagtataatctattcgaatagccgcgccctcggttatgggcaagccgagcaatgtaccgaagttagtgttttaattcttaaaacctgcttaacaactaaaatgtggaatggttggcctgggttggcttaggacgagctgggacccagggtcgggttgccagttcggtctgaatcatcgtaggccttgggttaaggcaggttcgtgtgggttcacggccttgtttaataatattgtatagctctagaatcgtgtttacaaaatagctttgagtacctaagtgtcttttaatgctgtttactgcaaaccctaaccctttatattataatgcccttgtactcccttgcatttatcctgcacttgtgggtgtgtcttgttgagtacggtggttgtactcagtcttgctcaatttttcccaaacccagaagtggagttcctggaagatgaaggctttggtgtctagctcgtgtctgccgtcaagcgcctgtggtcgtcgccctagtcttcctctgtttcccgtttgtctttgtgtgtgctgggccttcgccgcccatgtaataaattatctatttatgcttccgcttgataaactctgaaatgtatcaacttttggtgtaccttgcctcctgggacaaggaataatacacgcacgtaaggaacgcctgttgggttaattccggtcgtgacaatgacaataaaaatgagaggcatcggacgggtcatatatgagtacaatggcagagccgccaatggttgctaggacttctagaaagtaaaaaatgaattccaatgattgttatgttcgggtttttaggatcccaatgacaataaatagtagtcggcagataggtcgtagaggagtatagtggcagcgtttgacgggatttctaaaagttataaaaaataaaacccaatgaaacaatgaactctaaaaactataaggtctaatttttaaaggttcgggcttctaaaaagtataaaagaaacccaatgataaacatgtttgattttaaattctcaatgacaataaagaagggaggcagcgggcaagccgtaaaggagtacaatgactaagtcgctgacgttttggcagaaattctaaaaagtaaaaaatgaacctaaatgataattatgttcatttttaaaataccaatgacaataaagagaaaatacagtggacgaccgtagagaagtataatggcaatgtttgacaaaacttctagaaattatataaacgaaacccaacgggacaataaactctaaaaattataagatccagtttttaaaggttctaaggagaatgaatagaaacagcagtagatcgagcaagcaaataaagaaggatatatcataagtaagcagtagcaactggtatgacttttaaaaactataaaattagaaacacgagaatgataaggtttcgtctttcaaagtcttaaaacaacgagatagatatttaataaattttaagtaaaaacatatttaaaaatataattttgtatgggtgctagccgcgcgattgcgcgggccacccaactagttattatatactaaaagtccatgaaacttcctacaaacactctcaagccgccacttggcgctctaataaaatagagaaaatcctagatattctaagaaaaaagcaaaacatctattctttgattttcacttaaattggtgggtccaatattatacaccgttagataaaattgatcttaaaacatactaattaccgtgggtcccacctatcctcctcccgtgcattggcatgtggagtatatacgtacatacgtacatacgcttccttcccctccttttcttttcttttttcttatttttttaatttatatatttaatggatatattttttaaataatcattattttacaaataaagaatctaccatcatataatttaaacgggtgtactctttactttgtacaattattttcaaataatgcactactttaaaataaattttacacaattatatcgtatacttatcaaataaacaatatctatattaacttatttatacgtgcacttaagctgatagccccattatataaatcatcggatctactttttattacattgatctattactcttaagtaatgcactctttcaaaataaggtctacaccattatattgtctatccatattgtgtttcataaaattcacggaaatacttgccactaccctcccatctctctgcacctcatacatgcatacatgtatgcatttttgcgagttttaaaatgatttttctcataaactaattatccaatctatgatttgattacaccgttgtattcgttgtaattaaatctttacaacaagatatcacatgattatattttgatagaagaaaaacatatgtttcaatccgttaacactagttgtttcatatgtggtagcgacatgtttcaacgtatatcttcatcatgtttcataaaatttttaaatgtttcagttgctgattttttttcaccatatataatttgatgtttcactgctcaatggtcaactagtaacatttgaccaaccaattttttttggacatcagacgtcagatgggaagattccttatgattgtggagtgaaaaataaagtgcagcaacatgcacatgcacatacgctcagaggttggctgggcgtccgatatttggtgggatatcggacgtccgagccgtagcgctctccgaacatgcaaggcccagcccacagctccacacacacgggaggcaaacagaagtccaaaacgtagtccgccaaagtcgctaaccctctctctttttctctcgattcttcggaaactacggcgctagttcctctttttgcggcacagagcgacggttctttgttaccagacggctaactctcacgcagggttcaccttaccgttttagggtgggttaccgaccccccgcggtaaccgcgcggttaccgccaaaaaccgcacaaattccgcatccaaatttttgaattcaaatcacacggtatgatcgaggttaccacacggtttcagtcggttaccgcggtaagtaaacggttaccgcgatatgtgaatcagaaaataaggagaatgcaaaaaaaaaggagaaacacttaaatgtgagtataatttggggataatagctctaacaaaaaatatatggggataatagctctaacaaaaaaatatatgggagacttgaaaacttaagatgtgattatataatagaaaaattcggcatgacctttcttttctatattgtgcagttcaaatcaatccaataattcataacattataattcaacaataacaatcatcaatctcatatttgaaagcataacgatgtccacatgtagaatgaatagagtccacaataacaacagagtccacaatataatgtccacgattacagttctagtttgaatgaaaggaaataaacaaggacatgcatagctacgcgttccactgattatatgccatattgtactcctctatggacatgagcatcaagccatgtgaatgtagcaaccccgctttgtatgcctcccatctttgaccagtccatgatgatgttgtttgccactgagcgtacaattgagcataccactgaggctcttgccattcatacacccatgtaggcgcaggataatcagaagcttgcggacggttatacacatacgttggatagccactttcaatgctagaggcactgaatgagctggagctatcctgttgtatgtcaacatgttgttgctgttgttggcctctcgatgcaatggtagttcgttgagagcttggagcaccatgatcgtggtcttgagtagcatgagtaaagtcagcctcacctgcaaatgagaaagttgcaagtaaattaactagtactgaattggatggtgaaggttgaaatagcaattaaattatatcacaccagtgaattgaatggggctgtggtgatctaactgttgggtgtgacccctaggaggcacatcagtagttccttggcctccttgaccatcgtcgtctccgtcatcggtttcagttcttgaactactatcattagactcttggtagtctgggcttccttgagtctcttcatcgctatcaacattagtcgatcgtagacctttgccctttgtctttttagatggacgtgcttttggtggctttcgagtcttcctttttccaatatgagtgtcacctacattcttatcagcccactcaacaaaactagaagctcccgtggtcctgtgcaggtcatccaagtccactaggtcggttacaagtggactaggcaagggggcgtcactctcatttgaatcttcatctagttcagggcaagcattcgaccgagcagtgtccatccatttcttgatctgattgttagtttcgtagaatgagaggtccgctaatctttgaaggggatcgtcgtcctccgtcctaacttgggcatttgctcgccgaattcgaaggcgaaggttgtagttcacataaactagcttgttgagcttcttgtgggtaagtctattacgaaccttggtatgtacgaaagcgaatgtgctccaattccgttcacatccacttgaagagcaacattgaccaaccaaacgcaacgcaagcttcttcaaattcggcgtgtctgaggcgaacatagaccaccattgtgctgcaattgccgagtaacatgtcattttataatattgaatacatcaagatcgattggacatatcatagttccatgattagaaacataccaggagacgttttcccatctatggccatctttcttgctagtgcccttccaaattcgcccgtcttacgtcgatacatctcaacctccagcaaagcggcggcggctgtatcgatgtccgtcatccactcgaatgcctgtcggaggtcttggaagacagtggcacttggatagtacgcatagtgcgtcctagg

SEQ ID NO: 5300 - DNA, 5662 bp, Oryza sativa
atatctaccttccgttgtccgctgaattttgttggcatgaagtcagaggaagccatccattgcatgaaaagatctcgcttcctaaggaaactctggaggaacatgtagttcgtcccgaaccttgtaacattccacttaaccagttcaccacctatagctgtgaccatcatagcatgcaacttgttatgattgtatagccatctgcaaatttttctaccacttgcaatcaccatttcgtggtttggcattttcccaacatccttaagcatcaagttgactgtgtgtgccacacaaggttgccacacaattctttggtattcttgccgaagtagtctgcacgccttcttatagttagacccattgtcagtgataatttgaacaacatgatcagggctgtaacgtcccgccttcccccaggccgggcccgcttacatctgatagctttcatactgtaggataagccaaatggtcaaaccttaaggacaaatcttccgaaaacataatttgtgaaaattttcctttctttcttatctagaattctttgcaaatcgttttgtcgttcttcccccttcctctttcaacttgagtagtcgttaatcttgatggagaaactcgaagacgtcgatgttgtcaacttctgcaagtcaagtggatcgaggaataagaagatgatagtcgaatcttaagtgttcagatagagtgaagtttggaacctatcttagaacctatgccgccaaagtgtctttgaagaatagttagtagggtagaacgcttgttgtttgctttgtgtgtaggtatggttgcattcccatcattggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacagttgggcatcagtggtgagatcaactcagatactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggacgagattctttgtaaggggggtagatttgtcacatcctgattttcgtttcaggatttataaattatttaataaattattaatagaatttatattaaacgttcattaatttactagtgaagttaaatgtgggaaataaaatttcctaaatataaagcatggaaggatttaatttttattaaattcttcatggttaattatactctctggaattttctcagatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcagcccattccttcctttccttcctctctcttccgccggcccaacctgagccgcctcctctcctctcagcctagccagaaaagtctattttctttccctgcgctactgttcatcttccaactcaggcagagcccgagccagccgtgccgtgcacagtgccgccgcctcttccttccaaatctcgcctccccgttgctctttttctccaattttgttgaggggaaatattcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgctggtcatcggagctccgccgccccgtgcaacccgagccgccgccgtcgcctcctcgtcgccggccgtcgtcggtcgttgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatattgatcctatatttaaattctctatttatttcatctgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggatgacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccacgggggtcgctggggagtccatgcctctagtttttgagggggtgattatgatccaggaaaggtgcgctgtaatggattatgttgtgcatggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttaatacctgataataatttgcttagctcctggtttggagttagatctgtacagccgggtatggttgttcaggatggttgggcctgtacagcatgggtgtgctgttcagtgttgattaaaatttttaattaattactctactgttttactactcttaactctttgctaaatgcgctttcgcaaatgagcctatattatgccatcctttggtattcttgtgcacttgcatatttgctgtgtggcttgttgagtatgtcatatgctcattcttgcaataatcaatcaacctcatttgaagataaaggatccagaaggagaagacgtttggcttataccccagttgagctgcctgtgggagtggagctgaagccatcgctagatcgttattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaagggcctacttcgcgtaccaccttccttatctcctgcattagtacatcacaaaataaaaattagtccatgaccctaacactgacgataacagaggaagaagtaatttgttgcatcaacgacgtcaccttcagcacgaagttagcatcctggctttggcccgtcgcatcaatggacttgtggaaaaacattattccattgcaatatatcaaaaaattgattacagacatacccgtcgggccagtccaagaatcacacattatagtaacaccgtactcatcccagtcattcttgaacctatcgaatatcttcttcacatccttctctgtagaatcaagatatttgccatctatctccctaccagttggagaaggaacactttcacctataattgacgtatgaagtaattagaaaaatgtgttagaaaaatgtaattccttaataaatacatacgtaccccacttttgtgtctcccgaacggcgctgacaaagtatagattatcggcatttctaccaggaatgccggcggtaaagaagaaccttgcccatgactcaccaatggcctgcctagcttgcttccccttctttgtgaagaatcctgtgtcaatgcgtgtctgcacaggggacttggcagatgctagattgtaatctcttacagcaggtgactccctatgagatgtagcccttcgtagcatattggtaattgggttacttctacctttccgtgcctcgggctgagcggatccactcccaccaccatgctcataagtgccaccacgctcctccacgtggctcctgaagttttcctcttgtcgtgaggctgccatggctgcttccatttgttcctcctcgtcggcatcacctgttaggtcataatagttgacccctg

SEQ ID NO: 5301 - DNA, 28909 bp, Oryza sativa
gtgtcccaagtgcatttttagtcgtgtggccccaccacctttcttcctctgatggcaatacttacaacgccatccaggtgcaaaattctccccgtgctcccacacaaggtccctactttctgccatctccaccctatatgaaatgcatgaaaaattatcactaggaattataaacatacctctcataacgcaataatatgtatacagctaagctttcacccaaattcgggcatgtatacaacaaaacaatcaaatgtacttcacatgcatggttttaggcaagtacgggcaaccaaattcgctaataaactcatattcccaacgtacttcacataatccccaaatataattcatattcacaatgttttcacctaatatgttcatatgacagtataaaaaaacatataccacggtttcacgcacggtaaccacagtatcaaccacggttaccgcggtttaaacaacgattaccgtgctcaacaatagcagcgaacgtaaataacaggctacggtttctctcccaaaccgcacggttaccggacaaatctcgcggtaaccgccccctctcatgcgcatacctgttggtgggcgagccagtcggtaaccgcctcctaccacacggttaccgctgcataccgcgcggaaatcagccacgccggcgcggaggcggcggatctggcgcggcagtcctcgtcgccccttcgaagcaatgcgcagctgtgagagagagaggaaagaaatagaagaacgcgacagaaaccaggaagagatgcggtagatattttccccccactgttgggccttattgggcctcctgaacagtgcatatttggcccattacattaattattttttctattttctaatcgacattagtttttgcgctcaaatttgaatttctcttactatttttcaagaaatttttacaccataacaacatacaaatcaagctatacatccatgatttttttttgattttttttggttatttttgaaaattttgaatttgagcaaaatttgctcaaaccctaccgtcggtaagggttaccgaccccccgcggtacggccggttaccgcggtaaccgcgcggtaaccggcggtagggtgaaccctgctctcacgtggccagatcaaacccccacctctcgttaaccctaccaatcagctgcttcggtaaaaaaatgaaatcccaaacaaaccaaaccgattttgttcggtcttctcgtgtcggttttattttttctacaactagaaaggtagcccgcgcattcgtacggacatgcatcgtagactatgtttgagaacctataacgatgaaatgttaatcggaacttataaaagatcactttattttttttgattatttgagcacatttagaaaaaaacattaagtaattggactattttctctaattaaaggaactcgatgttttatgcagtggctcggactattcatatttcagttagttatttttgtttatgaagtgtatgtttaatttagctatatatgtttcaaaacatatcactatactctgtgttgttgagttatttctttttcttttggcaaattaaatttgaaaattttgttccggtactatttatttaatttagttatgcatgtttgtagaatttttcataatgacataatatttattgtcaaaattgtaaggtatttagatgtggtgcaaagtgcacgggtggactgtgcccaaatgctataattcttatacagcaaaatatatgcatatataaatattacattgttagtttaattataaatagagaataattagacagaaatcagacatgtatagcttataaaaaatctgtagttgtttcaacattcattgtttctcttctagtttagtagctaaaaaaataaggaatgggagcgcagtgttttctacatgtgagatggaggatgaggtggagggattttagtgaaaaccgatgagagatgttttttttttctcagcatttcttttattgtttttataacttgtaagacatgacacatgttgtcttatgttttttttttaaaaaatagatgacatgtgttacttattgttctttcaaaaataaatctaattgatgaaaataatgaaatccatcgagttatgttggattgttttctattttttgagacatgatacatggttacttacaagtgcaatatgggacgtttaatcaaattttatcaagtagactgatttaatatgccataatgcatatagtcaaccttttcgaaatgtctaattcctatttggtttccatgcaaaacataagtgtcaatgttcaaatgatgtatttaaatttataataaaaatatggataatatggaacttgaattatttatttagttataaataaaacaacaattgaaacaaactaaaaataagatacaacttttaaaattataatcattaatctttctaattattgttttttttacataatgttgtccattgaaaaaaagagaggatgtgaagggagagaagcagagatattgtacgtatggagatgtcacttgaacacatatatgacgtgtgaaggggtgagaagtgggtcttttccgtttttacattgttaagatagcagtagaaaataataggtatactatgaatgagttaaaataatcaatggttaggtgtattatataatttctttagaatttccaagatttattgtacattactagagaaaccatctttggtcagtcgcccaaaaaccacaatagtcccagttcgaataggaaccggaactaaagattatttttaatcccaattaaaatatttttgatctttagtcccagttggtgttaccaatcgggactaaaaaaacatttttagtcccggttcaaagaagttattaggtcgagttaggccctaattacctttagtactgttggtataaacaatcggaactaaagatcaaataactgggactaaaaatagatctttagttccggttctttatacctaccaggaacaaaaatcctcccgagcgcacgtcgagtcctctctctcggtcttaccggtaagaccgataaaaaccatctctacttcgtctctcattaaaaaccatctccactctccagcttcctcgatcccatctcaatatcgggcattctccttctcaatcggcctcctctctctgaccccctctcccctccgaccccccctctcctctcctccccctccccgcctcctcctcctcctaccacggcctctctgggttagcggcggccagtcggggtcggcggcgggccagccgggcgctgtactggatcgggcgggagggcaggaggggcgttggattgggcgggagcggcggtgcctctggctcccatccgccagatccggcggcggtggtggaacgacgacggcggcggtcgccgggctagggaggtgcgcgcggcggccttcggaatttgttttctttttttgaggatttgtgatgattgtttttgagaatttgttatgtgatgaaatgaggggaaaaaccaattacaccgtttgcgtgtaaattgcgagacaaatcttttaagtctaattgcgccacgatttgacaatgtggtactataataaacatttaataatgatggattaattgggcttaataaattcgtcttgcggtttcccggtggaatctgtaatctgttttgttattagacaatgtttaatacttcaaatgtgtgtccgtatatccgatgtgacacccaaaacaaatttttttgggaactaaaccgggccctagtagagttctttgtggaggtttagtattcttttatctgaattaatttataatcggatgaattcatattgttttaatttacttaatactatcattataatttatttgtggtggttttttcaaaatttgtgatgtaatttttttggaatttatgatgaatttaatatgtgattcggagatgatttggggatttgtctattaggggatgtagtgattggtgaaatcaatatgaaaaaaaactctagacttatatctatatattcatagccaatgctagaataacttacattatgaaacggaggaagtacatttttctgacattgtagatctattttagttacatgccagtgaagttattatatagcatgaaacaatatactaatgtcactttcttttcataatttttacaagctaaattatagtcaagaggtgtattaaattctaatttgtgattttagtcataataatgacacaaacagaacatataatttcatccgatagcaaaaaaaaaaaaaaaacttccttacaagagaaatggagaggagttatatacatgcgtatgcacgggaagaggggacgcctcttcgaaagaaatagaaaaatcaatctaatccaacggtttggagtgatgggctaggttttagtgaaatcaaaggctaggtttttttttctcaggttttttctaatttattggagcgccacgtggcattataggagcatttatataagcatcatgtggcagcttagaaacatttatagaaattttcatggacttttactatataatagatatattggatatcattgatataatttagcgaaatatatttgtagaattatttaaggtgatatataatatgccaactggagatgaggagagagagggagtacgtacgtacaggaggccaggaggggaacgtacaggtgatggggaccggtgtggagaggaggattttttttatttgatctaatggttaaaaatgttagacccaccaatttaaaaggaaaatcaacggttagatttttagactgccacttggcatcttaagagcgtttataggagacccaccaatttaaaggaaaatcaacggttagattgttagactgccacttggcatcttagtagcgtttgtaggagaacatgtggcggcttaggagcatttgtaggaagtttaatggactttttagtatataataataactagaaaggtagcccgcgcatatgcgcgggcatgtgcgtaaaattttattacgaatgtccatgtctggatggttttatatcaaaaatattcttttactttatcataaactaaaatttaacatatttaacgtgctttgaacgttggttacttgctaacatataaattgtgaactaaaattacttcaaaacagtgttcttttaattcatgagaaaattttgtatcgaaacaattgatgtgtttcctatgaatgtccaattttttttttggttaaattctatttgaaattttaaatatattcatttgattagtcctggtaaaatgtttggatatttctatttagaatgggttataaacccaacgaaaagaaatttaaaattagataaattttgtttaattttcatttctttttatcttcatttttttggacaaatccactttatgaagcatcttgaaatgctttgatctatgtaaatcgggatgaaaatataagtgggttgatcctacaacctagcatggggtaaaggcatccattctaaattatctcgctccaatcaactaagaaaatttaaaatagaggccatagtattttcttagcaaattaccactgaactggagcgtcatgtaataattacacgtttctagattgttctatgctatgtcacaaattcgcgatgtactgtagcaagttttacccgaaaagtaaatggatacggtcttttaattcctatctggaattggcttatatattattgaggccacataatggttgttttactcttaagattccttggtgcaaccaacgtgcttagtatgatcggtatgttgttcaactggccacgtgacttcatagatcatatatataatatagatgatatgatcattttaagattatgtatttatctcctaaaatgatcatttattcataaaagcatcaatatcaaaatgtatgggtaaatagctcctgtatactcgctgaaaataaaattaattaagttgatagaaagttgttagatgtctaacgggatataagtaatggatctaccagttttattaaaaattaaggtgggatactttgatttttagtgagcaactttagtattttattttatttagggtaaaatttgctacaggacattaaaaaatgtaattagctagggacaccgtaagaatgcgtatcagctgtaggacaccgaaaaaactgctatttagttgctggacacccgcaacattattttataatgtccaatggaaatggagagagaaacaataacaaaagtacaatttttccccttgcctaccaagtccggctcgcatacacctctgacgcagcaaccggacccgccaccggtgaggtggctatctagaggggggagggggtttcaaggagagcccatgcgcctgggcccgtagctacatgtcgttcccgcactcatcgtcgctgcagcgcgagggccatgccagtgtcgatgctctgccacacaccgcgcttgagggtgagcacaacatggagcacctcctgatttatgtcgagcagggtgccgcagagcgctggctattgttgtcggtctcacagccacgccacgccacgccacgctgccatatcctccaccgttcatgtcgtgactacaatggcgtcagacctatatgcgagccgcatatggcaggaaggggcaaaatcatactttcatgattgtttctctccctttcctttcgatgtaaaaaaataatgccacgggtatccaaccgctaattaccattttttttctgtgtcccatagcatatatatgttcttccagtgtctctcaactaactacacttcttttatgtcctgtagcaaattttatctttattaagtagaggcttcaatatggatgtgggttcataaagtaattttttttataaaaattagcacttaaatatagtcaatatcggtattaagttattgtttccacttaaaaaaaaatagccggctagacctaatagatggagattcatttgtggtcttttctttgcccataaaaataattttaattttaattttcatagagacagaaaaaacagagaaaagtaacgctgcacaccgcatggggacggggatggagggaggtttggtatgtttcttttttttagaaaaaaaatgattgatctgacggcataaaataatgtgttgaagtttaagccaaaatcgatggttggatattattttttttctcagatttattataatcttttctaatttaagtgagacaagtagcagcttggcaaaatgcccatagggatggagaggaagagaggaagggaagatgatttgaggtgtttttttagtaaaaaaaagatccaataacgatgtaaattaatgtgtccagatttaagtggaaaccaatggatcgatgtttctctaatgtcatacaacgatttagaaatatttatagaatgtttaatggactttaacacctatttatgagattgttttgcataatcataattttaatttaaattgtgatagggataaaaaaaagagaaaggaacaaggagcctggtcgcacggatatgggaacgtgggaggtgtgggaggttttggttttctaccatagatctaacgatatagaataatgggtccactgatttaaatgaatatcgatatttattgagtgacttgagattatttatagggtgccatgtgacggtttgggagtgtttgtagaaagtttaatggattttatttattatataatagatagatagatagatagatatagatggtactatgtaagtatggttttttcgctttatcttatacggtagaaaattatattctatatttttcttccgatgatactttgtttgtattctttttttttttgctttatctctattttaatacggcctggcattttttttcttccacgaacggaacatgagcgctttttttcctgaatcatacgtactggagatacttgatttatttttgccaaccgtaggtactttcactttttatacagggaagatattatatatacactaatgattaatctaaactaatgggtacaccaatttaatgaaaataaacaatacatatatatctaatctaatagaccaaaataacaggtccaccaattaaataaaaatcgatggtgtgattagatagtgccacgtgacggtacatgagtatttattgtattttttttgctttatctcttttataacatggccgggtaatttttttttcttccggcgaacggaacgtgaacgcttttttccccgaatcatatttaccggagatacttgattttttttttgccgacgtacgtattttcacttttataatgggaaggtatatacatttgtcagggatacgggttaggcatactctttacccttcgatatacgtcacatatcggtacagtatacccacgcgtatacggatacttactgcgtattccaaggaaatccttcacggaatctacggatgggaagaatcctactcggacaagactgggtcgttgatgtatcgtatagggtctgatatctctgagttctacttggagacctccagatctgcgatataaaagggaccccccggggagggcttaaggcatcaaatctcagagccaacacagcccacacagcctacgaagtcagagcctgcaaggagccaagccatcgggatctagtcgaaccaactcgactacgatctcgccggatccgacaaattccattgtcccctttgtaacctgtgttttccaccatataatcccacatcaactgaattagggctattacctatcaaggggcctgaaccagtataatcctcgtcttttgtttgcttgatgtcgtattacgtagatccttataccaacgtaccccaataccctctatatccggtctacaggtaccatccgtcgacagttgcgcgccaggtaggggcacttggtacttaaggttctactactatgtcatccagcttcgtcgacaacagcgtcaacaccaacctcagccaagtactccctgctttaacgatgctggtgtggaatcaagtcggcgaaatcgtcttcccggtttacaccacgacgccgatctcaaccgatcccccaatgaccggaaacgagaacgcagtggctacaaaccaacgagactccatgtcgaaaaatcctcccgctgagacggagaacggagcatcgacgacatccgagctcgagaaggattctgatgtggccaaaccttgtccttccgacataaaccgcgagccgacaaagatgacttccgaagccacaaggtcctgttgtcctatccacaaaaccaagaaacacactttgcaagcctgctgggttttcctcaatgtccgcgctgaaattcgcgcctgcaaagagcgtgggattcagcgtatttctccaattcgcgatgtctattatcctattcacaagataaagaatcacgacatctcaagctgcgaggtctttctcggcgccatgaaagctccgtctcctaagtcatacgtccccatcagggataacgacaagtaacaaggagcgactccaacttcagatcgattcgttggggtaatcgatatcgatcctcacgaaccatcagtcttacaccttctcgaagactatgggtcatcgacaacgagcgcgccgtgggaggtattggccattgatgacgttggcacgtcagcccatgccaacgcagaagcggggaatcaattgactacaccagcccagcacattagaaccgttcaagctatactgagggaaactccctacgatcccgttctgaacgatgacctcgagcattggatagaacgactacgggaatcagtgaccaacctcagcaacgcgttcgaagaagccgctaccgcagtgcacccggagcagccaccaactggcgatgccaatggtgaaaacccggaacggagggaataacctcaacgagctacccctccacctcgcggcactagcgatctccgagatcacatcaacagccgccgagaggcacaacgcacacgagacaatgtgaatcattctcggcgtcatgtctcttcacagcgccatgataacgaaaatcgagaagaccgctcaaacgacgaccgagaccaggactaccaccacgatcacaacggtcgcaaacgacgggtgccagacaatactggttgaggccgtcgccataacgacgacgatgacggagatcggcgccgagacaacagcgggagacgacgacaagattcccgagatccaggccgacatcctcgtaatcgtatgccggaaccaagtgacccatcgtcatcgtcatcatccttgtcctcctcatcgtcagacagacatccacgaaggacacacgaccgccgacaacccaccgcccccaacgctgggtgtagggctttcggtcgttccctgcgtgatgtccgatggactgagagattccgacctggagcaatagaaaagtatgatgggagcaccgacctagaggagttccttcaagtctactccacagtgctctacgctgctggagcagacgacaacgcgttggcgaattatttactgtcgcgtcccaaaacgactataaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtttcttttcccaccccctctccctcttgggccggctcggcccacctccctccctctctctcctctcccccgcggcccaatcggccccctccccacgcgcgcgtgccgctgacgggcgggcccgcccgccaccctcgctgacgggtggggcccacccgtcatccccttcctcccgccgctcccgccgcctcgcccgtgccctagcgccgccgccgccgtgaatcccgccgcctcccgccgtccccgcgcgcaataaagagggggaaatcactccccgtgattccctccctctttccccccacttttccctctctctctccctcggattcgttcggaaagtttgcccccgctaacttcgccggcgcatcaatggcggccggatcttccgtggccgattccccctcatccggccgctctctccctctcccaacactatataaacgctccccgtgcctccctccaccgtttccgccactcgctgctctctctccccgtcggaatcgagctcgcgccgtcgttctctctctccgccgtcgccgccgagctccggtccgccgccgtcgtcgccccggaccctctcccgtttcggcgtcgccttcttcaggttcgccgcaacctcgccgacctcgtccacccctccgtttcgcccgccgaccgccggaacgccgtcctcgtcgacccgagccgcgccgccgccttcctccgctccggtcgccgttcccgtcgtcgccgtcgacccggggtgagccgtggaccgccgtttcacttcccccttccctcccctctctcgggcgccgctccgccgcgccggtggtcgccggcggcgagcatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccacgtgggccccactcccgtggacccggtccgcgcgcccctcccctcggctgacgcaataaatccgattttaaattaaaatttaaatgaagaaattcgtaaatatccatttaaagagcagataaacttcaaatggccataacttggccatttgaactcggaattggaccgttcaagtctctaatttttccttaagaagccaagaacccatttttgtgctttgtttctgcttgttatatggagtttagtagagtaaaagccgtttcttttccgttggtcgtgtagacgctgcagcttcggaagatccgctcttcgtggaggttgaagccggcgtttgggaaagcgagcaaggcaagtcacatcatctttgaacatattgaatcccagtttgtaaaattatgttgatttaacttattgcgttatcgctttatttaaattcccgcgttatcactgttttatttagccatgcctatttacctttgttatgaccttattattattgttattattattattaccttgttcaccctagaataaacaaaaccccaactagtggaccctctactcatggtaccactagtataattttaggtagatgcttcgcttttaattaggtaacattaggcggttttacaactctagactttgggaatattcatatcacctggacactatggaatggtttggttattgtggaattggctgggctcggggtgcatggttttgatagtagcacctcggccatataaggaccggtcttcgggcctctgttgaaaagcactaccgtacttccacatgtctagtgggtaaggcttagtttgtggctcagtctagttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgctcagagtataatctattcgaatagccgcgccctcggttatgggcaagccgagcaatgtacccaagttagtgttttaattcttaaaacctgcttaacaactaaaatgtggaatggttagcctgggttggcttgggacgagctgggacccagggtcgggttgccagttcggtctgaatcatcgtaggccttgggttaaggcaggttcgtttgggttcacggccttgataaataatattgcatagtactagaatcgtctttgcaaaatagccctgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggagttcctggaggatgaaggcttcggtgtctagctcgtgcctgccgtcaagtgcctgtggtcgtcgccctagtcttccgctgtttctcgtttgtctttgtgtgtgctgggccttcgctgcccatgtaatagattaactatttacgcttccgcttgttaaactctgaattgtatcaacttttggtgtaccttgcctcctaggacaaggattaatgcacgcacgtaaggaacgcccgttgggttatttccggtcgtgacatttaccaactgcgttgaaaggttctgcacgttcatggctgatgcatcttcctccctactcaatctcttcgtgggcagacctgtggcaacagttcgtcgccaatttccaaggaacatacaagcgccacgcgatcgaagacgacctatacgcgttgacacagaactcgggtgaatcattgagggaatatgttcggcgcttcaacgagtgcagaaatacaatccccgaaatcaccgacgcttctgtaattcgcgccttcgattccggtgtcagagattgctatactacccaggagttggcgacaagacgcatcacaacctctcagagattgttcgagattgttcagcgatgcgcccacgcagatgatgcgctaagacgcaagaacgataagccgaagaccgggggagagaagaaaccagccacaaacgcatctgagtcaagcaagaagaaaaatcgcaaaaatgggaaaaggaaagctcaagcggaagtcctcgcagcggaatacgcgaaccctcctaagcgaccagacccacaaagtagcgacacaaggaaagcatggtgccccatacacaagacgaacagacattctctggaagattgccttgttttcagaaaatcgctcgagaagcacatcgcatttgaaaaaggcaagcgagtacgcgtggtcgagaagaatgaggaggcagttcctcacgaatcggattcagcatttccagactccgacttccacgtttcacacatcttcagaggctccacaacgtactcctcaaagcgagaatacaagaaagtggaacatgaagtctgttcgacttggcagggggctgcacccaagatgaagtggtctgagcagaagatagagttctcggaaggagaccaccccaagaccgccgtcatcctaggacgatatccgatcatggtcgaacccactattcggaacatcaaggtagcgtgagtcctcattgacggtggcagctcaatcaatcttcttttcgccagcactttggacgcgatgggaattccgcaaagcgagttgacaccaaccgatcaacccttccatggaattactccccaatcatcgtctagaccattgggcaagattacgttgcttgtaactttcggccaagccaacaacctccgaacagagcagatcacctttgatgtcgctgaattcgatacagcttacaacgccatcatcgggagaactacgcttgcgaagttcatggccgcatctcactaagcgtatcaagtgctcaagatgccgggaccgaagggaacaatcactattcaagggaacgcaaaactggcggtgcagtgcaacaagcggagcctcgacatagtcgagcaaacgcccaacccacccgccacgactgagccacccaagaaagtgagcaagacaaacaagacgccgaaaccagatggcgccatcaagatcgttccactttccagtgccaaccccgacaagactgtcaagatcggggcgacactaaacgagaaataggaactcgcgctcatcaccttcctccgcgataatgctgacgtgttcgcttgacagccgtccgacatgccgggggtccccagggaggtgattgagtacaaactcatggtgcgacccgatgccaagccagtaaagcaaagactgcggagatttgcaccagaccgaaaacaagccatacgagaagagctcgacaaacttctcaaagctggcttcatcagagaagtactttatccagagtggctatccaatccaaccatggtgtggaaggccaacggaaaatggagaatgtgcgtcgacttcaccgacctcaataaggcatgccccaaggatcacttccctctccctcgaatagaccaattggtggattcaacagccggttgcgagctgttgagcttcctcgacgcttactctggctaccaccaaatcagcatggcaaaagaggacgaagagaagacagcattcctcacgccgttcggggtattttgctatgttaagatgccgttcggactgataaccgcagggaataccttccagcgcacggtccagggcgcacttagcgaccagctcagcaataatgtcaaggcatatgtcgacgacatcgttgtcaagaccaagacaggcgactcattgattgacgatctgcgggaaacgttcaacaaccttcgacgatatcgcctcatgctcaatccagagaagtgcacgttcggagtaccgtcgggcaagctgctcggattccttgtttttggcagaggaatagaagcaaaccccgagaagatcaaggcaatcgagaacatgaagtcgcccacaagactcaaggaggtacaaaagctaaccggatgcatggcggcactgagcaggttcgtcgctaggatgggagaacgaggacaacctttcttcgctctgctgaagaaacaagacaaatttgtatggacacaggaagccgaagaggcattcgttgcactcaagcgctacctatcaaacccccctgtacttgttgctccccaacctaataaagaattattcctctatattgccgccacgccatattccgttagcaccgtcattgttgtcgagagagagaaagtacaacgaccagtctattacgtcagcgaagctctccacgacgcaaagacaagatacccacaaatccaaaagctcctttacgcggtcatcatgacatcaaggaaggtatgccactactttcaagcccacagagttacagttgtctcctctttctctctcgacgaagttgtgagaaacaaagacgttatcagccgcattgcgaaatgggtagtcgagctgagccagtttgatgtccactttgtgccacgaacagccatcaagtcccaggttgtaacatcctcaaattttaaactaaaatttgacggcatcatgctggcttttgattaaatttgtttggttcaaaaatctatttgatttttatttaaaattggttcaagtattagagcccaagcaatttactctaacttattccctttattctaaactctagtgaatttgagcaaattctctcaaattcaaaccatagattatttctttagcttatcctaatattagtggagatttgctatactctaaaccctagtgaaaccttttcaaactcctagtttgaattcaaatcttttctaggaaatattcaaaatttctgaattctactattcattgcacataaggtgttcggaagaatgtctagcccacctagagcagcccaactccatccaatcttgcacaaagtttagatttgatcctagggaccacaccccactcaaaaaccgtggatttcattgcttcttcctccccttgcacgcgccgcactggcatctgattttgccgcgcgccgtgtcaccgcgcgtcggcctcggggccgtttgcatgtgcccgactgccttggcgcgccgtcgcctgtccgccgccctcagcccactgtcgtcgcaccaatattgacgacgacaaagccaggactacgaccgctgcaagaaatcaccgctcgacgccatgcgcacccgtccaagccaccgccgagttcgatttcgcttctacccggggtgaatcgcgccaattcttgccgcacggtaggattggagatagacggtggtatcccctctcacaattcaaaccattcacccccgagccagccattttcaccttcgccgccgccacgcgtcacgcccggattggcgccaacacgtcgccagcagattccaaccgcggtcaagtcaatccttcgctggtaagtattcgaacgtgacctcccgcctctcaaatcgatcttgcccgccctctctcagcctctgccacctttgcctcatccaaatcccgagctcatccaaggcgatgaaggtgcccgagctcatccgttcctcctagccctatgaataggaccccaatcccttccctgtccagcatcgatcatcaacaaccatagccccacaaccccgaagctctgcttcaccaatccatctcatcaaccaccctcgcccgtcggtcgagcaccttgtgcgcgatcgactccacccctctccatccatcttccgccctaaataacccttagaacacctatatcctaccatgttctagcataataagccctaaccaaagcactgcgtcgagttttacctcgccgcaccaaaccaagcaccgccgcccccacactgctctgttcttcgccgccgcgaagtttttccggccgcaatccgtcgtttcaaccaatctcggtgagttcttctgttacaaccatctacatactacctagattccattttagcaatccctttgcactaacatgccaccctctgagctgccgacgtgagcacggccgccacctatggaggcgctcgtcggcaactatgctccgcgccttgtcaaaggttggcaagctgtcggaatccctctggacacctcgtagatgctctagaaccccttccctagccatgtctaactcttatcaccttgatcactatctcggcctaaccgtgccaccgccgccctagccgctaggccgtccacgcatcaaattaactcctccgccgccgctcgccgtcgacggagatccctagccccctcccctcctcggccgcaaccactttcttcctctaacgctgccgcaatcctaaaccctagcgccgccggcccgacttggggaacggccggaggtagaagaagagaagagagagagactaacaggtgggacccacacacagtgccatttcacatttatttgattttcaaactttagaagcccatatattttaaaatatagatccaatttcaatgaaacttggaccaatattcttctaaaatcattctctatcttttggaccccttttcgctatttttttcattttattttattttctctatttttcttatttttggattttatttaaactcctttttgaatttgaattttatatgtctaaccctaggtcttgaggattcctctgacattctagataatatcaatcaatctcaggacatcgagcaaggcaagttaccatatacctgttgatcatttaagcctatattttataaattatttatttatagccttctattcaatattccattttctatgcataaattaatcatagaaacccaaataatttagtattgcttattttgcttacaatctggttaaaataccctatacttagattgagacaatacgtaagatttggatgatttccgggtggctagtattgtctcaatcgatataagttttactaggtacttatgtcgaacgaacgagtacgaccgcagtttctaaaatggggacagacctatttattaggttaattggcattatggcacctatgtatagtggttcttatttctaagtcctcgcgcaggaggcaactatagccgcgaagggcaactttaaccattaccatgtacaggtaaatggtttgtgatactcgagtataaactatatggtatatttctaaaccctgatcgagatgacgtggtgtcatacgatcagttcccgttaaatacctcgggaacgccataactcctcttactgctgttaacattacgttcagaacatatgaggatacaagttcatggaacaggtgccataactgttaatgacttaatactgggccatgactaaagctgataattatcagcaaatcgtggactgcgggtaaagcgtacatcatctgcagtagaatatctttgaaactattcgaatagccgtactcatggagttgagtaccgggactcatatggtactctggttagaaatataaagtttatatgttttataaattctgctataacttttccagattgtccaataccgctttttgcaaagaaccctattatatgtcaattcataacatatttccatcataacttgctgagtattgtgaatactcatccttgctcttataacccctttttcagatctgggtcaagaggaggacccatatgactattactacgaagaccccgataacttagaaaatccctgagggttttacctcactagtcagaatgtatagaacttccgctgtgtactaattagataggtgagtacctattattgtaaaacccttagtattgtaagactttaacatatgcaatgaagaaccagttatattgtatgtatcaatttttactgatccagggattgatacattaatctcagtcggatccaagttgttagttttgggctccgacacaggtactcgccgatttcgttgccgattggactatgcctgataacaaattaaacaaccaagtcgacaacgaaacatggacaatggctttcgatggcgcactcaacagccaaggagcaggggcaggattcatcttgacgtctccctccggagatcaattcaagcacgcaatccacctcaacttcagggcgaccaataacacagccgaatacaagggactactcgccgggataagagcagcagtcgcacttggggtcaagcgactaatcatcaaaggggactccgagctagtcgcgaaccaggtgcacaaagattataaatgctctaacccagagttatccaagtatctcgcagaagtcaggaagctagagaaaagattcgatgggatcgaagtccgacacatctaccgcaaagacaacatcgagccagatgacctagcacgacgagcgtctagacgagaaccgctcgagcccggcacttttctggatatcctgacgaagccatcagtgaaagaggttagcggcgaagttagcccggacacccccgacatcagctcggaggtcacaaaggcagaacgcgctgttgccgatatcgagaccacagacgactggcgcatcccactaatcaaattcatcatcagcaaggagttgccagaggacgatacagaggccgagaaaataacccgtaaagcaaagatctactgtatggtcggcaacgatctatacaagaaagcgccaaatggggtacctctcaaatgcgtctcgtccgacgacggcagacacctcctcctcgatatacatgaaggcatttgtgggtcacatgccgtcggtcggacattggtcaggaaagcttttcgacaaggtttttttctggccaaccgcccttaaaaatgcatgcgacatggtccagcgatgtgaagcctatcaattccacagtaaacacacaaagctacccgcgcaagcactccagactatccctctgacttggcagttctcgtgctgggggctagatatacttgggccattcccacgaggacagggcggctacaggttcttattcgtggctatcgacaagttcaccaaatggatcgaagtagtacccatgggggaaatcaaggccgacaacgccatcaaattcatcaaagggatattttgcacatacagactaccgcaccgcatcataaccgacaacggctcccagttcatcagcgccgatttccaggattactgcatcgggttgggggtcaaaatatgcttcgcctcggtctctcaccctccaagcaacggacaagtcgagagggcaaacggcatagtactacaagggataaaaacccgcgtctacgacagactcatgtcacacgacaaaaaatgggttgaagaactcccatcagtactatgggccgtacgcaccacaccgacaacgtctaacaaggaaacacccttcttcctcgtgtacggctctaaggccatgctccccggcgagctacgacattagagtacatgagtacagaagcactccgacgaggaccaggaggaacagcgagacatcgatgtaaatcttctcgaggagcatcgtgaacgagttgccgttcgagcagtcagctatcaacaggccctccgccgttaccacgagaagcgcatccgagcacgcatactttcgatcggcgactctgtcctccgacgggttcaaagccaagcagggcggaacaagctctcacccaattgggaaggaccttacacgatcacataagtcttgcagccaggcgcattcaaaattgcagacggcgaaggtcgtgagttagcaaattcttggaacattgaccaactacgtaaattctatgtatgagtcaataccatccgtacctgtaagacagcttacagtatcaataaagccaattcttaggcccatgttacaatcaaagtgtttttgcccaatgatcccttaccctgatgacacctagcgttgaaacctgtcctcatgtccctttacgctgtcttgacaaggcctccgaggaacctaagggatcttcggctggggacgcccagtgccgataaggccttgtcagatcctgtagagacgaaagactatgtaagatctggtcgtgtaagagttctcaccgtgcgtattaaccaagccgtgaaatcggaaatcaactttccaacttcacagctgggggctaggatcagagcttattcaaaggtccaagagccttatcctccgagaaaattcctccgacgacaaggctgggggctagagagagtgtacgactcaaacggctaactaaagtcgtgaactgagaacgcactcttacacacaacatccagagtaagaaacatttgttaatgatagatttcttttctatttcacaaaatacttcttacagtttttacacaaatcttttgctacattacacctttttcctaagatatctgtcacagggtacgaatactagcaagaaggccaacgccagtccatagactggaagatcttctcggccaacggcgacatcgatctcgccagatggtctatctccgccgaagtcctccgagaacgagcaaaaccctcacggagaaattcgaggtctaagcgcgggcgatgatctcgtaggcaagccaacaattgccctccggcgtatcggctcgatcgacaacactcctgcttcaaggcctcgtcaatacgcttgccaatgccatcgagttgagcacaggccccgttcagccacgagatgtacacggccgccaactcctcaggatctccgtggaccactcgaagttctctacagactctggccatggatgtgcagcaactcttcaagtacgagttaaaccacacctcacaaccttggagcgtttccacagcctgctctttcttcactgccagcatggttctctcaagttccgctacttcaaacttcgtcttccagtattggatacgacgatcttggccagcaaaggcaccctcgagatctgcttaatgtgataacaactaagtcaagcggtacacctcttttcgagaacacagttgatctagtcgggagggcgtcaaggggtgaatggactactaacctgaggaagtcgtcgccatctccgtctccgtaacaagggtctggtccacattgtcgggcgacacgtgtggttcaaactcgagaaccggaattatcgccggtgactcgggctgcccgcgctgctggacatcctcgtcatcagcatctctacaaaggacaaaagttcccgaggtcaacatacaaaagtaaaatgataattgcacgcacgaaggtggtcagaattcaaatgttacacatcatgtcttggaagtacaagaagtcctactcttcaaatagggggagaatagactctcccagatcaccgacttcttccatcacctccttacgcgtgttgcaggccgccccctgatccaagatctcgcgtagatcgtgttcaggacgcgacagcttcacacacgcgaggacatggcacgccccggtgtaaatccagttcgacgtctcctccacgatcctggccgcatgcttggaggggatctcccccatcaccgtcgccagttccgcaagggaggatgttagcgataactcgtcaagattcaccaggatggtagacttgatgccgcactccccgacgagctagtgcaggccagtgtaggtgacccgcagcgaaccccagatttccgacaggttgttcccgagttccgacatgcggtccttgagcccctgccgttgtcgctcgttgccggccaccaattccctcatcttcgtgaggtcttcacgggcttcagccaactcgcgcaccagccggtcagcacgcgcgttcgccagcactgcttccgaccacgcctctgcaatgtcgcggccgatgtcgcaagcaccagcttcgaggaggcgccccatctcgacttggagctcctcccaggtgaggacggcagctggtggatcacgacctgccgcgggatcgctgactgggccgttgggcgtcgcctcccggctgcgagcacgacatccgtcgaggccgcgcctccgtcacgacatccgtcgttcaggcgatgcgctggaagtccctccgacttgtcttgggcagcctttgcccgcgcctccctatgggatgaccacgaatcagacaatgcttgaatagaatcacggaaacctaaaaattcacctacttacttctcgctaaccgtcacaagacgttgtcgtcgtggaggcaggggagacgcgtccgaggcctgaaagacaaccaatgcggagtaaggcagaatccttctggctgcaggatctgacgacaggataacttaccgagggggtcgacgccttgcgacgatgtccgcttacagaggagaacttcctcccctttgtcggaacattgccaccgctagtggtggcagcagcagcatcagacgcctccttggctaccttctcttttagagacgccgccacctgatggtccgcgagcggcccgatgatgtcagtcagaggaagagcctacgcttaatcaagtcataaggtgatctcgaagggaaaatgcaggatgccaatcgagtacacttacgttgatagcgtcattgcgttcagctgcccccttctcacaaaggggcacggggatgtcactcgctgttgtcggaccactgatcatcacctagccgacacggcgctccatggcttcgctgttcagacctgtgaatcgagaaccaaatttcgataaatcaagaggaacgcgaacataaacatgccaggataaatgcgagaaagataccccgaggagaaacccgggtcgcgtcctccggtccggaatagttaaaggttggatgggcccgagcctgcagcgactggatccgcctaccaacgaagtctgcaatgacttcataccccgacaagccccgtactcggagatcgtcaatgatgttgataaacgactgaagagaggaggtcaaagggggctttgcggtccaagacgaaatcttgtctggttgctctttgggaacaacgaagacagggtccaagtctttgatctcaagatagaaccacctattccgccacttgctgcgagaagaagggcactggaaggggatataacgtgacttcaggccatcccgaagtcggaacccgacgcaaccagataccctgttggactccatccaacgcagctcgtagtagaagcgaaagagatcaaggaaaggctctaccccaatataggcctcgcaaagatgagcaaagatgctaagaaaggcgataaaattggggttcaaatggagaagagaaagaccatagaagttcaaaactaggagaataaattcgaaaggcggagggagaaaaccgcagagaatatagtcttcgatcgcaaccatgtgacctaagacgggctggggattagtacatcctgcttccctctccatggttccaagaccaggaggggcgtcgtcttcctgaagcttcttcagcgacgcactggtggaagatgatttgccgaggtccatcgctgatcgaagatcgctagagaaagggcctaggttgatgaactagggtttcttgtggcggcgaagaaggcgaagagcgcttacaggcggaatgttttcagcacggtgggcggacttgaagatggacccccaaaattcctttaaataggcgcactaccgacggtgcgaattccaaggaatagagagagatgcccgccggaaatttctgggtccgttacgcgcggcagttttttggacttcaatttaaattcgctcgtgaccattgggcttcaaatggcgtgctcgactacggcctgtctccgcggtcctcgcaccgggaacgacaacagtctcgacacccgaagtcgcgaatggttacgcgagctcattttaagcagatgtcgagggctactgtcagggttatggttaggcataccctttacacttcgatatacgtcacatatcagtatggtatacccacgcgcatacggatacttccttcgtattccaaggaaatccttcacggaatctacggatgggaagaatcctactcggacaagactgggtcgttgatgtatcgtatagggtctgatatctccgagttctacttggagacctccagatctgcaatataaaagggaccccccgggaagggcttaaggcatcgaatatcagagccaacacaacccacacagcctatgaagtcggagcatgcaaggagccaagccatcgggatctagtcgaaccaactcgactacgatcttgccggatccgacaagttccattgtcccctttgtaacctgtgttttccaccatataatcccacatcaactggattagggctattacctatcaaggggcctgaaccagtataatcctcgtcttttgtttacttgatgtcgtattacgtagatccttgtaccaacgtaccccaataccctctatatccggtctacgggtaccacctgtcgacaacactaatgattggtctaagtaattggtccaccaatttaataaaaatcagatctaatctaatgatctaaaatagtgggtccaccaattaaataaaaatcgattgtgagattaaatagtgccacgtggcggcataggagtgtttagagtgccacgtggcggcttgagagcgtttttaggatgtttaatggacttttagtatataatggaagatagatagatagatagatagatagatagataatagataatagatttttctcggcttgtgttttagagaaactgatgtataagcaaaccgaagaaaccgacccgagtaaccaagtaaaccgaacgcccaccccttagtacatcgatctacgactgaatgaatatttgatacatgctaaattcagtagtgcagataattggtattgtacgtattttcaggaatacgtggcattgtatgttctgagataatataaaccgagtaaattgcattgaagatacaagaacataacttgataggtgggtgcagtttaatgcataaacttgaaaactgagtaattggtacaccaaacttggttagatggtgcgcttttggtcaaagtgattgccacatggaatctttttccaggtttgcaagacacgtcgtcatttttgttacatgtttctactggttccttggatcggaacagcagtagactgaaggtccatttcagcaaatatccccggtttaatgttaacaacatcaaatcaaaagcactaaaaatctagatttagcaatgatacagggcaccgtgatctctttgatcgatacatgaaccaattcatagttatactgtcaattgaacaatgaagctagatggcgtctaagaaaagcagcatgaatgcatgatctacattcagaagctttatagttgaccaaaagcaatggatcaacctaggaagcacgagttcctgataaattgaaggaagccaacattaaatatacatcatgcggaacaaagagaacataaaaagtggtaggaagtctgtttcaaatttattggaatgcgagagaagcgatcttgtgcacctgatgtcccctgctaatgtggcaaaagaataataatgtgatattcactttgcctaaaatgcactataaagctaagttaatgcaccaatatgcttaaatttcaagttcttatactagaacgcacccaccctgacaagttcttatatcgtgagtgcaatttactcatataaaccagtacaaggtttatgacgcgtggagcgatgttgggagcagctaactatccgaaaggatgctgtgtatgcaacgttccttttgtttggctagtttggctctatgcaatggtggtggcaacagccagcacagcacagtcgagtgcacacctgtgctcgacgcgtggtccggcgttcgtggcggaagcttgtgctcatcatcgccgtcctctgtttcgggcatggccacggccgtcgagctccaggtttgacggaggcaggacaagccatgtacattggcagcgtaccactgatggtggagtgactgatgtgaggatgtctggtgagcatggcgcacaagaggcggcaagcgggtatccgctgcccgctggacgctggtggccatgaacgaccgattggcgtgtcatccgcagcgagtcagaacaaagcagagtggcgccgagcgcgtgccaattgccaattgttcggtcggcgcgcggtctcggttcagcaggtcaacaggaaggaacgaggcttgggcgcagtggaggggaaggactacggcgatgtgttcaaacggtgtctcacacgcacgagaggtttgatcggtggcggctacaaggcaagtagaacagtggtcatggactcacggctgatcttggtcttgggcaaatttttcttcatgacaccgtgaagtggtgtggtcatggactcacggcttgtcatggttaatgataagggataccttctatcctacaacttagagaatatacaagtatggtatatattcacgtacacgggttgtttccttatgtgttgtaggaatccatcacgaattatggaaaatatctttacgggtcgaatgatttacaaagtcctacccggtatggatagagtttctattgtatcgtacgggatccaatgtctccgagtattacttgaagatcaagatgatccactgtataaaagggaccccctgggggtgcaaggcatcgaatatcatcgcatacacacccaccacagtttacgaagccagagcatacggagccaagtcaccgggagatttcgtcgagtctattgactacgatctcgtcggtatcgtcagatctatctactctcattgtattacgtggttcctccatattaatcccatataaactggactaggactattacctgataaggggccagaaccagtataatccttgtcttctgtttgcttgatatcgtattatgtagatccttgtacctacgtaccctaatacccaactcgttcggtctaagagtatcactcgtcgacacggcggaccttagtcttcagcaaattttgctacaggacaccgtgacttttacggttttagctgtacgacacgacacaaaataacttttgggagaaaacactcctaaaagttggatatttgctgatagataccgcaccattaaaataataattttcggttgaggatgaaagagaaat

SEQ ID NO: 5302 - DNA, 7887 bp, Oryza sativa
acatatgggatagagagagaagagaaggggatagagagaagagagatagaagagctgacatgtgggtcaaaggacatttttaacatttcacacaatttctctctcatcctcaaccggaaattattattttaatgggtgcgatgcacactagcaaatatccaacttttgtgagtgtttccccccaaaagtttttcgtgtcgtgtcctatagctaaaaccgcgaagtcacggtgtattatagcaaaatttgtgtagtcttaatattgcgccgtctttggcctcctatggcatcaagacggaatgggccgaggtttaggggggccacacgtcgctcgacttgcggtgtgatgatacgagatttaagcgtgccaagtgtttaacaagtggcaccaccgcgaggttggattgatgctgatgggctcatagtggccaacgcgagctaagagaaggtataatagtgggctataagaaggctgaatgctgaggtggatgggagaaaagaggagagagatgagaagcgggctgtaagtttacaaccggcttaggcacaggaaccaagaaaatctgtgagacagacatgtggaccatatatttatagtaaagagttaaccactatatgagtgagctgatagataggctataagtaagcagctggctgtattattatcctcgctctaacggctgggctggaagcctgaaacgaggttgcgaggtggcacgacaccagtggttaaccagtgcaaggatggcgtcgaagtcgcgggtcggcgaggacgcacagtgccactgtggaggagctgcgctgtggcgtgtggctgacgcggtcacaatgcgtctgttggtggcgagtgtcgtagtgtgcgtcagcggtggcgcacgattggcacacggacacgggtgtggcgcgatcgcgcgactgtatcgctcgttcagacacagcggtgcgtgcgagatagtgagaggggccgaagcacggtttggcgccatttggcatgctggcggcatggacgtcggtggtatacaatacaagaggtgcactgtgcacggccgatacacaacgctgcgcgcgtggagcgtgcttgtcgggttgactggttgcatgcaagatgaaatggatcgatcagtgcgacctccgtgtggtgtggcaacacgacgcggccgcctggccagttcggcctattgagcagctggcgccgcttggcgcttggctggtcctggtctgctcggtttggctgcagttggaggttacctcgtgtaggtgttacttggttggtccaggcctgtatcgagcaggctcggctagcctcccatccagcaatccagcttgtggactgatacatgaagaacaatgccggctgggatttacacggaaaaaagaggattttttatattttattaaaatatctaaagatatattttaaagaacttttacaaataaatacccccaatgctttagtgggacaacttttatgacttgttaaatagccattggcgcgagctctggctattttactagcgaccccttgcagccctaccaaaaataacgcctgcccattttacaggacctttgcatgcaaaactagaagataaccctctaaggccatgtacaatgggatgcttaagtagacgcttagagaaaaaaaccgggtttttttttaccaggccggcgctacgcgagtcgcccgtcgccacgcgaagcggtcgtcgcttgggagcacttgcgcgaaaaaaggaggagcgtagcaagccctggcgctcagtaccaactaactaatcttgttttaggcatatggatcacacatggaagtattttagtacatcacctttgtcataaagatgacaataaaattaaaaattggttgacaatgagatagtaaaataaaaaaaattggtagactcattcactaccattgtagcacctagatgcttagatagactcttaaataactaagcatctgtggaatggattctcttcattggagattaaggctcttcaacagatgcttacatacttttttttctaagcatgtatctaagcatctggaccattgtacatgccctaagaggatggcaaaatgaccagctctcgccattagcacacgtcgatgattgtttgctacatcatagaaaacgccataagaaaatatgttttttttaaaaaaaacgtcctccaagaaacgtgagggatatagatttgtaaaggttttaaaaatatatattttgcaaatatcttaatgtaaaaatataaaaataaaaagaaatcgaaaaagagaagaagtaaaaggccaaaagagtgtgtttgatccctgcataccgtccagcctggttcgtatcgttcgattgagcctgctcagaatgtgcaatctcaatgggaataagtttatctgaggtcccttaacatctcgacgaatccgattttcgtctttcaaccaaaaaaaccaaatataacgggtccctcaactattaaaaccagtgcaaaataaatccaaaggcggtttcagctaacatggcgcctacgtggctaatttgatatggtcttcatctaacgtggcattgacgtggcacatgaatcaaaatttaacaacttaaaaaataaaacaaaatatgtggacccactgttgatgaaaaaacacactagcctgggagatctgcttagctctagtgcaggtctaaatcttgatgagatgcgggcgtgccagtcagtttgatcctgcaattgacaagatatgcaaatagtagatcaatgagccgatcggcggacaagccaatggagtagttctagccgatgccgataccagccgataacgatagggttttgagccatcggctatatgtccaatgtagataatgatataaaggcaatcggctgatgatagtatagtataacaatataatcgagtagaaaccaatcggctagcagtatgatataatagaattagcactgatccgaaggttaaagcatacatcaactggagatccgatatcataaaatccacaatattagataacaataaagtctttgttgtcatcggctaaatattatatatatatatgtatatatatacaatccttaaaagccgatgcaacgtccagataacttatcggctagcaccccgataaaacattagcatgaacctatcggcttaacatgatttatattatcaacaacaatctagtaggtcgaacctaaccgatgcagcacgagattgtatatgataatataatactcgatgagccgatagatctgtctaacgtgatggatatgacagatctatttacaacagcattgtgattgtagagagatatcggctaagatagaagatcagacctaaccgagacagttccaactaaaccgatgcgtctccaaacacaacacaattagagatagaattgagatatcaggtaggcaaatatatcaaccaaaccagagcgatccaagagatcgaagcgatgcagccttgaacaacactaacgtatccaatagattcaccaaggccggcggaatgtaggacttattccttcaccggagatagaactgaaccgatgcagccccgcgtcaggtgccaaattccaccagatgataagtaaaaacctaaggaaagagggtggcgattcgccgagagtagttgtattgatcgagagatatcttacaatgaccccgggtgtaaatatttatactcatggggagatactagtccttatagaacaagaatgaaactttcctaaagataaaaagaaaacataaagtccttacatgacactaaacacactttcctaaagataaaaggaactaacaaattattcctaattaatatataaacttgccatgccgcatccttcttgaactcgaactcttctgcataaatttcctttaattaatccgactccaccaagaacacaactgctggcgatttgacgactcccatcggccgattccaagactctaaagccggtactaactctaggcaaataataacttcgggcttaccaaattttggcattaacacccacatgtgattcaattaataaaataaaaaaaatagtaggacccacatgtcattgggccccacttactccacctcatcccctctcttctctatctcctcccctgctccttctcctctgtttcccttcttccctagattgtggaatttggacacctgcaggatgtcgcaacaacactccacaccaccgtcaatctccgccaccgcaggccacggcgccgtcccccttggtgggccacgacgctgtcctcctccgccaccgcgggcaacgacgttgtcctccctcgccgctgcgggaggctgcgggccacagtgtcgttctcctccgccactgcaggccacggcgccgtcctcctctgccaccaaccatgccgtcgtcctcttccgacgccaacctcgtcgatttctccctcggcgctgtcttcctccaccgccgcgagacacaccgccgccccttctctgtcatcctcctaagccaccggtcacgtcgccgtcctcttcctccaccgccaccggtggcagagccctgggatggtggtcgtgtcagctcgtgtattccacgatgggatgagggggggagatagagaagagagaggatgagttggaggaagtgggtctcattatttttaattttattatttgactgacatgtgggcccacatattttgttttatttttaaaattgttaaatttggcttcatatgccacgtcagatgaagaccgagtcaaattagccacgtaggcatcacgccagctgaaaccgtcgtccaaaccgccttgggacttgttttgcaccagttttaacaattgagagacccattgtatatgattttccagttgaatgatgaaaatcggattgatcgacaagataagggacctcatatgaacttattccatctttgtttggttatctgcacggagatttttgggtcctaaccagttagcagaccaaggctttcccagccaaccaaagcatcaaaatcctgcaagcccaatgacctcttttgcaggcaaccaaatggctgcttttgagtttaaattaaattcggaatttaattgtggaacttcccttttattcagaaaattgaaaattcaaaatattaaatgaatatggactttcaaatttcatttaaaacgaaattcttttatttagacgatttgttgatttttttttcttgaactcgtaacctggaatttgataactgaactaaaattttattgttttagtggagtattagttactcctactgcatgtttcagaacaaaaataattactcctactgcatattaatgatatttattgcactacaaatcattttttccctcctaagtggtatcagttttatttacaatcgtattgatacagggctcgagttcatgcatttcattattatttaggagcttgtgaattaaataaaaatttcattcccatttaacatttcttgtttgtatcagatacactcttgatccatgaattgtactatggtgtactagataccaacttattatttttcttttcacatatattgagtttgctttagctgagattaataaattggatttatgaattgctttaattacagtttgatgttcttatatttcagaacatatataaggaatgacgccatccttcatcctaaaaattttcagcactgaatacaatcggtttatagatttcaaggagaaaagaagaaaactcttggggtagcaagccagacacaaagggatgactgagccggtggtaatgggccaacaccattagcctatggggccgatctataagatgcaaattctctgtagtactgctgatacagtagcagtggctgacatatgggtccgggcccacacgtcggtgactgctactgcatcagtagtactgcaggcaatcccaactggttgagctgaatttcacacatttattttactttagctaacaaagattgagtgggcaacgaaaggatccgtgagttgtggcccattactgttgagttgtgatccaaattcatttgcacttaataaaggccagcttctgcctatatatatacctcatcatcccttttagggttccactatatatatacctcttgtaagccgccgtgcggcgatgtaacctcacctcagatatagtgaagatattttgctggctggcgcccgtggttttttctctcctgttttgggagggttttccatgttaaatctcgtgtcttttgtgattgatctattgttctttatcgtttgttcgcctatcgtttcctaacaagtggtatcagagctggttcccagattagggtttcgcgatggcgtcgatgaagtatgatctaccgctgctagactacaagacgagattctcgctgtggcaagtcaagatgcgagctgttctagctcaaacttcggatcttgatgaggcgctggaaagtttcgggaagaagaaaacgactgagtggaccactggggagaagcggaaagatcgtaaggctctgtcgctaatccaacttcatctatctaatgatattttgcaagaagtgttgcaggaaaagactgctgcagaactttggctcaaactggaatcgatctgcatgtctaaagatctaaccagtaagatgcatatcaagatgaaattgttctcgcacaagttgcaggagagtggttctgtgttgaaccacatatcggtcttcaaggagatcgttgccgacctagtgtcgatggaggtacagtttgatgatgaagatttaggtcttttactgttatgctcactgcctagttcatatgaaaattttcgtgacaccatacttttaagccgtgatgaactaaccctagcggaagtttatgaggcgctccaaaacagggagaagatgaaaggtatggttcagtctgatgcgtcgtcctctaagggcgaagcattgcaggtcaaaggcagatctgagcagagaacctacaacgacagcaatgatcgtgacaagagtaagagtagaggccgttctaaatctagaggtaaaaagttctgtaagtattgcaaaaagaaaattcacttcattaaagaatgttggaagctgcagaataaggagaaaaggaaatctgatggtaaggcctctgttgttaccagtgctaaaaactctgattcaggagattgtcttgttgtttttgctggttgtgttgctagtcatgatgaatggatacttgatactgcatgttcgtttcatatctacattaacagagattggtttagttcttacaagtctgtgcagaatggagatgttgtgcgcatgggaaatgataacccacgtgagatcgtgggcattggctccgttcagatcaagactcatgatggcataacacgcacgctgaaagatgtgagacacataccagggatggcgagaaatctcatctctctcagcacacttgatgcagaaggatacaaatactccggttcaggtggagttgtaaaggtatcgaaaggttctcttgtttacatgattggtgatatgaattctgcaaacttatatgtccttagaggaagtacattacatggttctgttaccgctgctgctgttactaaagatgaacctaataagactaacctgtggcacatgcgtcttggacatatgagtgaacttggtatggcagaattgatgaagaggaacctgctggatggctgcactcagggtaacatgaagttctgtgagcgctgtgtttttggtaagcacaagagggtaaaattcaatacctcagttcatcgcaccaaaggtatacttgattatgtacatgctgatttgtgggggccttctcgtaagccctctctcggtggtgctcgttatatgcttaccattattgatgattactctagaaaagtgtggccttattttctgaaacataaagatgataca

SEQ ID NO: 5303 - DNA, 528 bp, Oryza sativa
gttctagctcaaacttcggatcttgatgaggcgctggaaagtttcggcaacaagcaaaaaaaaaccggggaaacccttttggggaaaaggggtttggggaaacccaacctggggagaagaagcggaaagatcgtaaggctctgtcgctaatccaacttcatctatctaatgatattttgcaagaagtgttgcaggaaaagactgctgcagaactttggctcaaactggaatcgatctgcatgtctaaagatctaaccagtaagatgcatatcaagatgaaattgttctcgcacaagttgcaggagagtggttctgtgttgaaccacatatcggtcttcaaggagatcgttgccgacctagtgtcgatggaggtacagtttgatgatgaagatttaggtcttttactgttatgctcactgcctagttcatatgaaaattttcgtgacaccatacttttaagccgtgatgaactaaccctagcggaagtttatgaggcgctccaaaacagggagaagatgaaaggtatgg

SEQ ID NO: 5304 - DNA, 4225 bp, Oryza sativa
gaatagaaccatcatctccaaggctcgttgcatgctgtccaacgctcgcatgaacaagcgtttttgggcagaggctgctaacaccgcctgctacttgatcaacaggtcgccttctatcccacttaataagaaaactcccattgagatatggtctggtatgcctgctgattattcacagttgagagtttttggatgcactgcttatgctcatgttgataatgaaaaattagagcctagagctattaagtgtctatttcttggttatggtttaggagtaaaaggatataagttatggaatcctgaaactaacaagaccttcatgagcaggagtgttgttttcaatgaatctgttatgtttaatgacagcttgcccacagatgtcataccaggtggttcagatgaggagcagcaatatgttagcgtgcaggtagagcacgtggatgatcaggaaactgaaattgttggtaatgatgttaatgatactgttcagcactcacctcctgttttgcagccacaagatgaacctattgcccatcgcagaacaaagaggagttgtggagctccagtccgtcttattgaggaatgtgatatggtttattatgcttttagttgtgctgaacaggtggagaatactcttgagccagccacatacactgaagctgttgtttctggagaccgtgagaagtggatctcagctatgcaggaggagatgcagtctcttgagaagaatggcacatgggagcttgtgcacttgccaaaacagaagaagcctgttcgttgtaaatggatcttcaagagaaaggagggtttatctcctagcgagcctccgaggtttaaggcaaggttagtagcaaaaggtttcagtcaaattgttggtgttgattataatgatgtgttctctccagttgtaaagcatagttcaattcgcacattcttcagtattgttgctatgcatgatcttgagcttgagcagttagatgtgaagacagcatttttacatggagagcttgaggaggagatatacatggaccaaccagaagggttcatagtacctggtaaggaggattatgtttgcaagttgaaaagatctttgtatggtttgaaacagtctcctcgtcaatggtataaaaggtttgattcatttatgttgtcacatggctttaagaggtctgaatttgatagctgtgtgtatattaaatttgttaatggatcacctatatacttgctgttatatgttgatgatatactgattgctgccaagagcaaggaacaaattactacattgaagaaacagttgagtagtgagtttgatatgaaggatcttggtgctgctaagaaaattctaggcatggaaatcactagagacaaaaattctggtttgttatttcttagtcagcaaagctacattaagaaggttcttcagtgttttaacatgcatgatgcaaagcctgttagcactcctattgcacctcattttaaattatcagctttacaatgtgctaatactgatgaggatgtagaatacatgtctagagttccatattctagtgctgttggttctttgatgtatgccatggtttgctcccggccagatttatctcatgctatgagtttggttagtagatacatgactaatcctggtaaagaacactggaaagctgttcagtggattttcaggtacctcagaggcacagctgatgcttgcttgaagtttggcaggactgataaggggcttattggatatgtggattctgattttgctgcagatttggataagagaaggtcactcacaggttatgtgtttaccattggtagttgtgctgtgagttggaaggcaacattgcagcctgttgttgcctagtctaccactgaatcagaatacatggctattgctgaaacatgtaaagaatcagtttggctgaaaggattgtttgctgagctttgtggagttgattcttgcattaacttgttttgtgatagtcaaagtgctatatgcctcaccaaagatcagatgtttcatgagaggacaaagcacattgatatcaagtaccattatgttcgcgatgtagtcgcgcaaggtaagctaaaggtatgcaagataagtactcatgataatcctgctgatatgatgacaaagcctgttcctgttgctaagtttgagctttgctcaagcttagttggtatagtggtttagcccgagaggctatttgacgccgaaagtgtttttttttgtctttgttgtgttcaggatgaaggattgattcacgctacaagaaggaatttgtctcaaggtggagtttgttgagttgtgatccaaattcatttgcacttaataaaggccagctcctaataatgtacggatcatcatcccttttaggttccactatatatacctcttgtaagccgtcgtgcggcgatgtaacctcacctcagatatagtgaagatattttgctggctggcgcctgtggttttttctctcctgttttgggagggttttccacgttaaatctcgtgtcttttgtgattgatctattgttttttatcgtttgttcgcctatcgtttcctaacaattaccaccccaaagttggtggtgctacacgttcttcgcggtgggcttgttcgccttctccttctcacctgcagagttggaggaggagccatcgattttcttaccagacttggaggaggagtcgtcgatgtgctcggagttggagcaatgggacccgatcccccttctattggtagggaagatcatgaagacgaagcttgacggcaccgccatccccagcggcaggttcttgagcagctccttgtcgttcttgccggtgttcgggaagaagcatttctggaggccgacgtcgctgaagacgacggagaggaagacgacagccgagaggaaggcgtgcacgaagtcgacgtagccgaggtcccgctaatcgagctcgggctctaggtccttgaacagcttctgctcttctttcttgttcaggttgaagaggttgagcctagtcggcagggcgaagccatagtagaccttccccttgtagaggacgctgtcggtgaaggcgaagaagacgcaggcggcggagaggaagacgacgaggccgaggcttagccaccggttggcccggaagcactccccctggttggtgaaggacgccgacagcgactggtatgccagcaccgtccccgtcggcagaagccgcgccaagttcgccaacaccgcaccttgtcggttgccacattggcagcgtgtgccctcgcctcatcgctctcgctgattggcagttttggatcaatattggcggccgatgctttgtcttccttgttctgcggcgccatcgttgctggccgtaagcccttacttacctacgttctccgatagtgtgtgtcactgtgtgtaatattgtatagtaggtgtttgcatgcagatgcagctccaagagctttgtgtgtgtagtgtgtgtgcatgtgtgtatgtatatatatagaggtataagctgtacagtggtcagtggggcgtcactactgcgagcacgcaaagggcaaattcacgtaatattttgctttataccttcagcctggaaagttaaaaaaatggatacgtacgcacgtttctttagttgtgcgatttgtttattcaatttgaaggaggtttgacgttctgttcggggtaacaatgattaagatatatgcacactggagaaaccatctttggtcggtcgaccaaatttcacaatagtcccggttgcaataaaaatcgggactaaagatcagaaggaggtttgatgttctgttcggggtaacaatgattaagatatatgcacactggagaaacgtcggtcgaccaaattccacaatagtcccggttgcaataaaaaccgggactaaagatgatatttagtcctggttaaaaaaatttaccaaccgggactaaagattatttttagtcccggttcaaagaagttggtgggtacagttaagctccaattatctttagtcccggttggtataaacaaccgggactaaagatctatttttagtcccggttgtttatatctaccgggaccaaaataaactgccgatatctcctcggtatcccctccccttttttctctccttaaaaacaactgagacttagtctcggtatccgcctcctccccttcttccttcttcctctccccttcctcccccttccagccttcccttttcctccgatcccc

SEQ ID NO: 5305 - DNA, 4026 bp, Oryza sativa
ttgcatatttgtgtggataattttgtgattcattgcacgtttgtatggatctgtgatgtatttgatatgtttgtaatttttgtaggatttgtgatgtatttgatttgtgtgtataagtaactttaagatttgtgatgtagatttgagatgttactttgatttggggatttgggtttgatttgggatatatatcccactcgattcgggagaaaataaaaaagaaaaaaaagaaaaggggaccatctcactgccgcttccctctttttagtcccggttggtgttagcaaccgagactaaagatcccctctctttagtcccggttgataccaaccgggactaaagatcgatctttagtcctaggtatttgaaccgggactaaagatagcgatatttagtcccggattggtagtcccggtttaaaaaacaggactacaggggtttacaaaccgggactaaaaagcacatctccaccagtggcagtcgtcagggctttacgaacatttcgtgattcgtttgctactgcgcgcatacccgagttgcaaactgcaaccaacgccggatttggagcccacgaaccgaatcattgaaaggggaagcagttatgcccaagcaccttcaaagccgatcaattaaccggccgtgatacgcactaaaggtaccgatttatctaaaattggcactcatgatccctttccattcatgggacgtctgaaattgaaaaccggcaccattaattcttattaaaccagcactaataattatttgtacctttttttaataaatcggtacttataatagtgttattggtgctggttttaaaaaaagacgacacctactagagcgagccaagaccggccatgggtgagaccggttttttttacggtcaccgtttccacttagtagaagagaccgctgctctccccatccttatctgctctctccactcctcatctcctgtctcggagacctctctagcacggacgatggccggccacctctcgggcacgggcggtggctagctcttcctcgcccatcatcatcgttcgcccccaccattgttcctcctcctctcctccaccgcagccaccaccggtccatttcgcccatgacgtctcctcctctccaccgatgcagccgtaaccacttacggtcgtcttcgctcacggtgtctcctctttgccacagccaccgatagaaatcctcgcctacatcgcttcatttctctcttgaggctggctagatctactccacgagcataggagctgccgtattcaccgccgtgcactcgggggtgggcagaactgccgccttgcgcccaccccttggtggtggacggatacgccgccgcaagctcgggggtgggtggatccgccatcgcaaccacagggatggccctctcgacgaaggcaacatcggcaaaggtggcattctatgtgtgttcttcgctatgtgattttgttgattttgatcatccctctcaaattttgtttttcaaggttgattttgtgatcatgttcttgggtgatgggcatgacggtgatctcagtggtgatggggagccggctttatttttgcattccaagaacctcaaaggtgttgcttgcagggtactggttgggaaatccgccacctatcgccggttcccaaccggcatgagtcacctatgccgagtcgtcaaccattcatttgatagatctcatacttccatcaccatcacaaagtactacttccgtccaataataagttaatctagtattggatgtgacatgtcctagtactatgaatctggataggctcctatccagattagtaaaattagaatgtgtcacatccattactagattaacttattgtgggacgaagggaatatcactataggcctccattgcctatcgtgcccatcaccacctatgctagcactcaccttggagtggacgaatttgggcatcggatgaagtcataatcattaccgttgccatggtcttgtgccagaatcacatggacaagccagatttggtggccaagagcttaccgccacaagatcatcaggccctgaattcgcagcaaataaatcgaacctttccatgccattgggaggaggaggggaggttgatgaggatatggtgcagtactagccgtcaattgtctgaagatttgtgcatcaaattataggaattcaaagtatcaaaaggtcatatttagataggttttcaattcgtctttctaacagatcaaagtcatatgatttggatgttccaatcaaaagtagtggcaattttactgaaggttgcccatgttgtaaaagtgacacgacataattgctctgtttggagagtttgtggattctacggtatgattagatagttttcgtctattccaacactatccataatccataagtcaacaattatctcatctgcacggattgaattgtttccaaatgagaaattcgaagataattgaaggatcacataagatcaaacaaatctaccagagggggggagggtgaatggtagggaaaacctaaaacccaaaacctttttgcggaataaaagatttacctcgaatagagtagatgacgaagcactattgtcgtcggtcgaaccgcccacctgccaccggttagaccacccgaacacgtgcggtcagatcgccgctatcccaccggttagaccacccgaacacatgcggatagaccgtcaggacccaaaaagcactgacagatgacaaattcgaagatgaagattgaaactttcgactttttggcatcaactagtgtttacaaagtgcaccaacagcattcctcaccaaaatctcgaactaaactcgaaaccctaactttctctcaacttaagtctctcaacaaccgataccgggaggccacaccttccctttctatttatacacgaggtaggctgtgcaaagcctacaaagcaaacacaacttaggactcctaaccatgtgggaaaccctctattgcaagtatacaacttatccctttccttatctctatcaatcttctagaatttggactcccttccaaatttgactcctctttccatacatacacaatccctcttgcataccatatggattcttcatcaccacgtgcattgttctctatccttttagtatcccacatgatctcctgatccctagacatcaacttctcccaagtcaactccgatctatcaccggcaacactctcccgaggccgtaagcaacatctgcacatgcaaacaaccaagaaaccatattccgagcacaagtttatcccaacttgactcacattagtataacaatagtatccatacgtatataaaccatctagaagtcaaatcctcgaagaaaacatccaaatccaacaagataacccgaaaccaataatgatcaggatcctgccggtcataccattgggttggctagtctgacggctgcatgacatacggtctgacgggcgacacccggggtcaacagaaacatcacttcacaaaatcaatcatctattaaactctgaaatcttatcataagaaaccaatctttcacacatgatatatcgaaaaccaccaatgttttcatcacacaaaatataaatcaactccttgatattacaataagaaggtttctattcggttcgaacagcctggacaagcctatgatgaaacagtcgtggatttcacatacggactctattttggacatttgattacttgttggaaagctaattttatgactcatgtcaaggtttggtcccaccttcacattcttcatggtttatcggtaatctaccaaactagcatagggttgctgcaacaaaagtttttttttcttcgtgtccaagtcatctaacgagtttgtttcttgtttgtaggtcttaggattgttatatataagcaataggtgtgcgtccattgtaagggagactcaatattatgaataaaaattagctttagctagaactatgtgagggtctagctacccattcttcctatgatttggcgcgatcacataaaagggaaagaggat

SEQ ID NO: 5306 - DNA, 2770 bp, Oryza sativa
ttgaaactaagtttttggagagtttgtttttagaattaaaaatttaaaaagtaaaaaaaaaaaagctcaaaacgaacccagctacactgctccatgtcaccatgtgttgtgtgcaattggcttggaacagattaatggacctgaagaaatccagcccaaaatgctccgatggatctttctcgcttcaaaagaagcccatcttggcctgctatgagatttcagataggcctgtcttggagatcaccggcccagcacaacgcaagccgcaacgcactgtctagagtcactcttctagagtccctccgcagaaaacaatcacttgcacctaaaaacattgtgtgctttgatctagcacctatccttttcctttgtccagatgatacttgagctaccaaccattgaggattctcccttaagtgaggcggcaagtttgggcaccagatcaggtgattagttagagatcaatgtgcttgatgccttcatcagttctgtgtgttgcttgtttctttcaagcttctcgctgagttcgatggtgatctcgtgtagaaactgtttcttgctggtgtaagctgatgaaggattccttaattcagtgaagaaattctgaagatgatgaattgccgttcagttagtttcctatacacgtgtcaacagatttgcatttcagttcatgcttctttgttctgcagattattctgtttctttatgactgctaccctgctaagttactaacgtgttaatcatgttatagtgcttatgatcttcactgctgaatttaatttttatgcgtatttaatttagtcctctatcatgtttacaatgaagtgagtggctgatagggagagtttgatggtactgtgctgctgagatagctgtataatcctgaatattgtaaaccgaagcataacttcctatagtgcagaaatcacttacaggcttgcagctcccgctaagaaatactagtatgtgtgttagcttgtactttccatcgcccattttttatatgatatctgaggtattattcctttacctttcgaaattcgcatgattcatgtacctgtgctacttcactcttttttgtttcaatggacaattgaagacatgtactaatacacggttctgcttggattttatgtggctaacccacgtcgtctttcttgatcgatggagttatcatactttgacttactggcggcaagaaacctgaatgcgttaatttactgtacatattgcagtatactctaccttggtttagggcttggttagttcccatatttttttttccaaaaaatcacattaaacctttggacacatgtataaagcattaaatatagataaaataaaaaactaattgtacagtttgcatgaaaatcgcgagatgaatcttttaaacctaattagttcatgattagattatccataagtattacagtaacccacatgtgctaatgacggattagttaggcttaataaattcatctcacggtttcaaggcgagttatgaaattagttttttcgttcgtgtccgaaaacccattccgatatccggtcaaacgtccgatgtgacacccaaaaattttcttttcctgaactaaacagctaaaccgggccttaattgattcaccatgttccgagttctctgagtaaactctgtaaaaaaacgtcaacacatcgaaggtttcaagctgaaacgaagcaaaataacccacttaacctgaagttatgaactcatattctgttcataagagttaataataagaggaattttatggtcattaagaaagtaccttcagatacttaaattttggtacttttgggaattagtatatagaagtatcaaattttacactagaaaatatgatatctctaggtatcttctcaatgatgataaacttaccctaataataatctgcatgccaacattctttgatattgcactgaagttttgtagagcatctcaactgtgtggaatacagataagataattgtatatttggcatctgcaaattgtcattattatctgaagaagtactatgcctgatgaggatatcctccactattaaccgctggcaaagacgcaataaggggccaagtggtccagttgtagttgggcggcgaccgtgtgagcctctgaataatcccaccttgcttagcttgggaggattaagccaccttaaaagggagagccaccattcctctattggactgtattttagggagattggtcattttcccgagtgggtgtgcctaagaactgttggggtccggacaaccttaatttattgggcttcggccaacgccacctaggccggatatatcaatgcccatgaatgatgaatcaaccttaatttattgggcctcggccaacgccacctgggccggatgtgttgaatagtcccacattggttgtggaagggcaaatgacctaatatataagtagggagccccttatctcaatggctagatgaatcaatgatctgcgctactgaatttaatgtgtaaccaatatctagaaccagtttaccagatcattctgcaggttccagaaatgcagagtacgttgccatctcgattccttctgaaagcacacttctctattttttaaacaaagaggaattaatgtgcttctaaagagtatagactgattttgaattttaattgcaaatcttgcagctaagaatattgcgtgcttccatctgcacctaacttttttttactcttttagtttccaaaggatacttgagctgccaaccatagtgtcttcgatccg

SEQ ID NO: 5307 - DNA, 35505 bp, Oryza sativa
tttaatcaaacttccaattttagcgtgaactaaacacacccataaaatccctctgaaactaatatgtcaaactacttcatatgttcatcaatataagttaagggattaaaatttatccaccaatataagcattcaaataactccttattctaccaattatttttcgttcaaatttctttctatcttaatctcaactattctcctatcttaatccattgatcatttaattagggtatacacaggaaaatcttttcttcccaaccttgatttccgccaaacaacttcaaaataatggggaaatactttggatgcgactcccacattcccatggtaaactggtacgtatggtgtgcaccatcattatgttggtgactcctgcgattactgacgaaaaaggccagttagccatcaggaatcaggacgtacccgtaacactgctgcaaatgccgatgtttactgtcccaaaaagaagtaccgtacgccttcccgtgaaacactaacatcgaatccgacgctgcaaaaatggcttttgcttgagtgcgatgacagaaatcgatctgaaatgcagacgccagccggtggttacgatttaacagcagaaaacagtggctgctttgttgctgtctgtcagtgatatcgccctgagcccctgagtcggtacactacaatcatctgacattctgacatagactgcctcgggacactcaattgtcaacgtccgctaacttcataggagtagttgattcgcagtatcatgaggttaaagcacggatcaagaaattttacatgcttgaactctatatactcttttgcatgtgactccatctaacatgtaaaaaaaaaatccaatcctggtacaaatctgaatatgcatatgtccatgtccatgcatatgcttagattagcctaagctctcgatatttttctggctctgcaatgcattcacaaacaagactaggtatttaaggtcatgccttggataggtctatttttttaatacatttaagatatattaagggccatttcttttcaaattattgtaatggattatctacttgactataggaataaatcaaatatttttaaaaatatatacttcatacaaatagtttaaaatgagtggtctaattaagcgatatagtagaagaaagatcatttggaaaacatattttcaaaacataaaacaaataatcagtgtgaataatcttaaggaacagagcctaagatataatttctccgttcaaaagtatttaacgtgggcattgactgaacgttgtatattttcagctagccacctacttataccacactcatatatggcaatttttcttcgtgctgttatttcttaccggcctatctccacgctcgcaagtgtgacaatgaaagcggcatgcaggtgcggctgaaaaaaccgcaggcatgagctagaggtaattttcaactccatcgtctctgagattttcttcagtcaacatcgtcaccgaccagtccactgcacgcacgcacgcaggcaccacacgtcgctccatttcccgagctaagctaatttcccgttctcatattatatagtactatattgcgagtggatgatcagaagctgaacgtgacttcacagtatcatcatattctttaatagtaaaacctgcatcacccacataaattcacaattaacaacgcctagttcagtgacacatctggatcaggctgaaagctatcattctttatcgaaacgaaaaggataggtcgccttttacctcatcatcagcttttttttcattaggtccatgaggcgttgaaagagctataagctgtcactgccggcccggacgactggctgtcgtcaggggacgacgagacgtcgggatcatccgactcatccgcaccgcaaaaattgacaagcgattaacaccatctgtttgttttgattattttgatttgggctaggagatcgagcagctgggatatgcaaaatacagatgcaaatttggacaccacaactagagatgaagactgtcagaatcggtagcctcaacgatcctcggtcgatcggcgatcgatcatatttaacgaaataatacaatatgatattagatcattttctaatattcgtgttttatattgatatcaaaacgatgctaaaaagaatagaacatttaaattttacagatagctaaaagttcttaaacagtaccatttatctatctattatatactaaaagtccattaaacttcttaaaaacgctcctaagccgccacgtgttctcctacaaatgcttctaagacgccaagtggcagtctaaaaatctaaccgttgattttcttttaaattggtgggtctaacatttttaaccattagatcaaataaaataaataaaatcctcctctccacaccggtccccaccacaagtatgttcccctcctggccttctgtacgtacatactccctctctcccctcatctccggttggtatattatatgtcaccttaaataattctacaaatatgtttcactaaattatatcgataatattcaatctatctattatatagtaaagtccgtgaaaaattttataaatgcttctaagctgtcacatgatgcttatataaatgctcctataatgccacgtggcgctccaataaattaggaaaaatctgaaaaaaaaacccagcttttgatttcactaaaattaatattaataggcccatcactccaagccgttggatacttggattagattgatttttctatttcttacaaagaggcatcccctcttcccgtgcatatgcatgtacataactcctctccgtttttcttttaaggaagttttttttttttgctatcggatgaaattacatgttctattgtgtcattattatgactaaaatcacaaattagaatttaatacacctcttaactataatttagcttgtaaaaattatgaaaagaaagtgaccattattatattgtttcatgctatataataacttcactggcatgtaactaaaatagttctacaatgtcagaaaaatgtagtttacaccggtataattttacttgtagaaatatattccctaaagaaacatgtagatatatattaggcacatttcgacaacttgcgccatatctatctattatatgctaaaagtcaactaaaattcccacaaaatactctgaaaccaccacgcgggactcctacgaacacacctaagccaccatgtgacactaccactggtggagaaatggtctttcctcccggtttgtaaccccctatactcacggttggtgttactaattgagactaaaaatgctagagctagaaccggcggttggcagtttttttaatttttttttcatatggatttcactaatcattacatcccctaacagataaatccccaaatcaaattcatcataaattctaaaaaaaattacatcacaaattttgaaaaaccatcacaaataaattagaacgatagtattaagtaaattaaaacaatatgaattcatccgattataaattcataaagataaaagactgaacctccacaaagaactctactaaggccaggtttaattcccaaaaaaatttgttttggggtgtcacatcggatatatggacacacatttgaagtattaaacgttgtctaataacaaaacaaattatagattccgctaggaaactgcgagacgaatttattaatcctaattaatccattattagcaaatgtttactgtagtaccacattgtcaaaaaatggcacaattaggcttaaaagatttatctcgcaatttacacgcaaactgtgtaattgatttttttcccacatttaatcacataacaaattatcaaaaacaatcatcacaattcctcaaaaaaagaaaatcaattccgaaggccgccgtgcgcgcctccccagcccggccagccggccgccaccgctgccgacctcgaccggccgccgctgacccagagaggccgtggtaggaggaggaggcggggagggggaggagaggggaagtgggaggaaggggagaggagagggggatcggacaaaggaggccgatcgagaaggagaacgcctgagattgagatgggatcgaggaggctggagagtggagatggtttataatgagagaggaagtgcaaatggtttttatcggtcttattgataagagaggactcgacgtgcgctcgggagtatttttggtcccggttgatataaagaaccggaactaaagatctaagataattggggcctaactcgacccaataacttctttgaaccgggactaaaaatgatctttagtcccgattggtaacatcaactggggactaaagatcaaaaagtttttaaccgggactaaaaataatctttagtcccgatttctattcgaactaggattattgtggtttcttggcgaccgaccaaagattgtttctccagtagtatacaataaatcctagaaatcctaaagaaattacataatacacctaaccatcaattattttaatttaaacacggtgtacctattattttctactgctatcttaacaatataaaaacggaaaagacccacttcctaccccttcacacgtcatgtatgtgttcaagtgacgtctccatacgtacattatctctgcttctctcccttcacatcctctctttttttcaatggacaacattatgtgaaaaaacaataattagaaagattaatgattataattttaaaagttgtatcttatttttagttagtttcaattgttgttttatttataactaaataaataattcaagttccatattatccatatttttattataaatttaaattcttttgaacattggcacctatgttttgcatggaaaccaaataggaatgagacatttcgaaaaggttgactatatgcattatgttatattaaatcagtctacttgataaaatttgattaaacgtcccatattgcacttgtaagtaaccatgtatcatgtctcaaaaaatagaaaacgatccaacttaactcgatggatttcattattttcatcaattagatctatttttgaaagaaccataagtacacatgtcatctattttttgggaaaaaaaaacataagacaacacgtgtcatgtcttaccagctataaaaacaataaaagaaatgctgagaaaaaagaaacatctctcattggttttcactaaaatccttccacctcctccacatgtagagaacactgccctcccattccttatttttgtagctactaatctagacgataaacaatcaatgttgaaacaactacaattttttataacctatacatgtctgatttctatctaattattctctatctattaattaaactaacaatgtaatatttatatatgcctatattttactgtataagaattatagcatttgggcacagtccacccatgcactttgcaccacatctaaataccttaaaattttgacaataaatattatgtcattatgaaaaattctacaaacatgcatagctaaattaaatcaatatagtaccagaataaaattttcatatttaatttgccaaaagaaaaagaaataactcaacaacatagagtcgcaccatgctatgttttgaaacatgtatagctaaattaaacgtacacttcgtaaaaaaaataactaactaaaatatgaatagtctgagccactacataaaacattgagttcctttaattagagaaaatagtccaattacttaatttttttttctaaatatgctcaaataatccaaataaataaaatgatcttttataagttcagattaatatttcatcattataagttctcaaacatagtctacgatgcatgcccgtacgaatgcacaggctacttcctagtttatatagaaaaggacaatcgaacattcgaaaaatttcatgaacacttttatcgctaaacacaaatcacaaccttgcatgctcgcttctgaatgcattcatatatatgactttcccccaaaacatatattttattctgttagttttgttgtaaattaaaacctaccaaccttttgatgccctggtgattgtgatgacatgacatctttctttgctaagtgataattattaaattaaacaaacctagattgcaatccataagtcttatatacatggaacatgacacaagtttctcgtgcatgtttcatacacatcaactaataaatttaaggaaaaattcaagaaaaaaatagataatattttcagtagtattatacctatatgtgaaatgtcatattcaaactcaatatattttagacgaaaaaaaagataaaattctgatagattttcactcttaaaaccgttagatttttcttttttttgacggcaaaaatataatgaatttaaatatacgaatttgtagatacgtgtaatactatttaagagtacatgtcagattagttttagaattttctgggatatttgttaattggtaggtacaaggtatacataggaataggggtgaaaacggtacggaaacagacgtaaaccatctttatcgttttcgttttcatattattttcggaatcgaaaaccccggatacgaaaacagaatcgaatattatcgaaaccgaaaacggagcaaaaatgaatcggcgcaaatacggtaacaaaaatttatcggaataaaaaatctcttaaagtgataaatccaattctcaagtctcaacggtcaacaattcatcgtaaaacacaattatataaatccaattgttaagtaccaatcgtacattacaaaacacaatctatggaataaattatctatgtttaagagagtaatgctgttgataaatcccaatgcatgaaaaaaaatattcttatgtaattttagatttgcataacaaatattttttaaaaaataacaaccaatcaccatggtattcactattcagtgcttaagaaaaaagaatccagggtatttcagtcacaaaatttctagaaattctgagaaagtttcaggaaagttttccgaccgatttcgagttccgacagaaactgcccttatcattttcgatttcgtttccgagaaaatatttccgaattcgtttccatttccgaaaagttccaaccgacgtattctgttttttaaaataggtccggaatccgaaaagttttcataccgtttacatccctacttaggaagcttatatgcatagtttatatgtgtggttaccgtgtgcagtttttctagggagtgcatgcacacgtactactaattagtgtgtggtcctacagcctagctgcgcactactaatcttcaatttaattagcgtgatccttcatgtgggaaattaagtgctaaacgatgacatcatagatggaactgctgaattagcaaattaaattcagtaacatatatgtgtaatgtgtcatcgtagtagagtatgtgctatgttcacacgagatgttgcggaaggaaatgataaaaacagtcagatgggggctggaaattaagatttctgaaatttcagaatttgagagaaattacagaaaatcagttaaaaatatttgaaattgcaaaacaatttattaaattaattcaaaagaattataatatttggctcaagacaattttctaatggtagcatccgataggatcaaactgctaacgttatactccttccgtcccagaatatactcattccgtcccaaaatatagcaatctaggaccggatgggatgtatcatagtactatgaatctggatatctctctgtctagattcatagtactagtatatgtcctatacggttttaggttgctatattctgggacggatcaggagtaggatataataaccaccgtgcgcacgcgctactcaagcgttccgatgagttttaccatatattactcccctctttcctgtaatataagaagagattttgtcctttttgagggatcaaggataaagaaaaaaactaggatgtctcattaaacaagaggtgatcgttgttagaagtataaatatgacggttaaagataagagtcaaatacaaattatagagataagatatattctagagatagaatcctagatataagatagagtcctagagatagaattctagagataaatcgactcttacttgtattgtactccctccattctaaattgatctacatatttcataggtacaccaaaaccaaaaaaagctaataactctctcatactatatttactctagcaacaaactctatgcatgcaccatccccactatttcctagccaatagcaaaccaagatattgcatgtgggttataaatacttatgtgcatggatgcatgcatcaatatccatttactccaatgcacaaataacgaatatacttcatgaatgaacacaaatatgtagatcatttagcaataacctcaaaaaactatatgtagatcaatttggaatggagggggtactctctatcccttatgtacttctatatataccccataagaggatcaatgtaatagattagagaaaacatgaatacaacaattagattagatttttccacagtggtgagtggaatgtttattggggggcaaggcgtatagaaaatagaattagagttgattatgagataactagtacatcaatttcggattaaggccaaacaattgtaaattatggatgtagggagtatatataggtcaactagacacaaactctccccttacacataaatttcagctctccaaagagcaagaactgtcaaaatcttaaacaaatggtgtttgacttatggttcagcaaacaaagaacaaagtggagtgcattcagctgataggagaccatgattttgattcctaccagctataaatcgtacggcgaacagcttattagggagataggccctcgcgtcgccctcccccgggcagctcgcggcgcgacgcgcgcgccgccgctttcctcctcccaccgccccctcctccacctcgccgccgcccgagcgggtgccggcaaagccgcgcagccgcaaggacggcggcggcggggtctcgcctcgcccaccccacgctcggcggctgggggagctgtccggggcggcggcggtggcggccagatccacgccacatccggccggatctggaggggggtggccggcggggggattgacggtgacggtgccgacgacggcggcggacctcggcgactgaaggcaacgtgggcggcggaccacgacgactcgacgtcggtggtggaccgcggcgcgaccaggacgccacggcagggacctccgccgcgtcgtcctggtcgtctcgctccagcccggcaccgaggcgtgctccgtcccctggatccgcgccaccccggccggatctgcacgggcggcggctggtggcagcgaccggtgatggtggcggctggcggccgcggctggtgatggtggcggggagatgaccggtggaccacggcggctgacggcggcggccgtggtggtgttggctggcgacggtggcgccgtgcgacagacggcgtgtcgacgttagcggcagcatatgaaggcggggaaggagttgggcggctggaaaggaggagaccgggagcgggcgtggcgtgggcggcggttgcgtgtggcggcgttgcacggctcaagagggctctggcaagctcagcggctgcgcgaagtcgaggcgggctccggcagggttgctcgctggcggcgagcctcctgctcgtgatgtgtggatgtggatgcgttggcgtgtttggttacgtcgaggtatgactgcttgtgagacgtcatggactattccatggtcgttgatgtggggtgcttgtgtgcgtgatgtgaagacgctggcgaaagccttgccgtgcctttggccggttcaacgacgacgacgctcatgggcaccgtaaacctccttggaggcattgtcatggcattctttcatatttcccacaaatctccaggtgaaaaccttgttccgatttcggacgagaggcggcgacgttacgcgtcgtgtccttcttgggggcgtcgcttcggaggagttcctatgcatcgatgaccgtggagggtctttttcggttcaaaaactttcataccttggcgttcggcgaggccttcgcctccttgggtccgcttcgttattgtggtgggcgacacgctcttcggttgcttctgctgatgaagtcggagctgctcgctgatggggtgcggcgatgcttggcgacgatgacaagttgcagtctcttccaaggagtttggtgctggccgtgtgaaggaagtggctctttggtggcttggctgatgtccattgttagatgtcggagctgcttttcgctctggtgactttcgcggctccagtgtcgctgcggttgtgaagtcggcgctgctgggtcgcttgggcggccagctcggcaacgataacacctcttctgtgatgttagagctgtttaggccgcttctgtgttttagcttgacaatgatgtggtacaattgggctccgccgtcgatgctagttgtagttaggtctcttgctttcttctgtgtggtgggttttagccggtttcccgtaattaaccgtgcaactgtatggttttcgggcccggttttccttataaactgggtcaattctcttcttctaaatataaaagtggaacaaagttccaacttaggtttcaaaaaaaaataaatcgtacggcccagagatctttcaggccaacagatgctaactttttccatgactggtcttgccaagagaatttcttctcaagaaactgtagaaacatgattaatatgctccatatctctaggctggtaatacacatgcatcgagctacaattgggagagaaaatgccaaagttttattggtgatgttctaatgctcctagctagaaagcaaagtctgaacagcacccaccacatgcatgaccactcatctatcatgcgctgcatattccccactctctcatgcccatctctctctatctctcctactgctggttctctttgcttgaaagaaaaagatggtgtggttttttttagagaaaaaggatggtgtggttatagtaggaagcatgcacctgggtcagacagaacgtagcatcacaaatttccaattacaaattgtacgtaaatcttctgtcttaaaatataagagattttacccataaaatttgagaagaaggtagtacttaattcggccaaaatacatcctgcagaagctggattgaattcctttgtcgaaaaaaccgtaaacatactatgtatactagtttgatcttgcaaactttgttggtctcatcatatatttcattaaccggatatatccaccgatgaagaggttggttgaatttgtcgaaaagaaaaaaaaaacgaacttactactatgtacgtactggttcgatcacgcaaacttaatttgttcttctcatcataaacactgagatcttatactatacacatcacggccgatcgatcaagaacacaagcgtgtacgcacgcacgcgtcgcctacctgctgcagaagtgcacacagatcatgcattgagatgcaaagcattcatggtgctcatttgccatggcgtttttttttttcgatcagcaaatggcgcacgagttggggttctcctccatgctcatgttgcggacgtagtagtactgcggcggcggcacgtacgggtaggccggcggcggcggcggcggccggtgatactggttcatgtactccatgttgaagtactgcggtgggaggtggtgcagcggcatcggcatcggcatcggcgccaccgcggctggtttcttccctccggcgtcgccgccgccgccgccgccttcctccttcttggcggccttcgcgtcgccctccttcttgccgtcgccgttgccgtccttcttgtcgccgccgccgtcgccttccttcttgccttcgccctccttcttgtcgccgccgccgtcgccttccttcttgccttccccctccttcttgccgtcgccgccctcctccttcttgccgtcacctccttccttcttgccgtcgccgccgccgccgccggcgtccttcttggcctcctccttcttctcctccttcttctccggctccttggccggtccgaccgactcgatgtaggccgcccacgacgccttgcggagcttgctcaccacgtccaccggatccaccgtgccgatcaccgtcatcttccgcgacgccatgtccatcgaaatggcgtcgattcctgacacacgcacacacaacaatcaatcagacatatgttcagacttcagagagttcgttgatgtacacagaatcacagacagaaatggtggatgcatcgatcgagattcgagacgattgttcgtaccgataaccgaggagacggccttcatggccttctgcttgtccttgttgtcatgcaggtccagcttcaccacaattttctgcagcagagcaacatgtgaaacagagggttaaggttggcaatgtgtgaatcacaaacacctgaacatgatacaattcaggaagacaagcaagaaaaaaggttgttgggatctgaagaagaaaagatgatgatcctgattctacacgagctaatcaggatcagaatccaagagcaagaaaggctcaccttcgacatgtcaccagccaatcagaatggccaatcaggaagagaagaattggatgatcagtggagcagaggagaaaaagcagagcagagattagtggtggccaaagctaggcgagtgtatcaccacaccagcagctgccgaagcaggggaaggggagggatgggtgagattgctgggaagggtcctaaatactcccacttcccttcacgtttttgaagcgcccgccgttgattgtgccgtccgtgatactaccagtagagatcatcgtaaaagttctctgttatcgtaatagctacttattaacaaatggcttttctagttgtttaatggtgaaggcctatggcaagaccttttgggaaattaatacttaaagggtaaacctctttctggtatgtccagcaagataggtatttctcagttctgggctggtttaatgaaagtcaaagaccaatttcttaggtttggttcttttagatgtcgcaatggggtaaacataagattttaggaagacatgtggttgggatcgcgtgctttcaaagattaataccctacattatataatgtggctcgaaagaagcagtctactgtggcagaggtcatgagcacaacgccgctaaatatttcttttagaagggctattgttggccaaaagctaattgagtggaacgatttgatcctcaggctagctaatataactctgtcaaatgaaaaggactgctttgtatggtcgctccataagaatggtcaattttccgtcaaatctatatatgccgcgatcatgaactataatgtttggataaaaagagaattctgtgggacttgaaaattccactaaagatcaaggtctttatgtggtttcttcacaagaaagtaattctaacgaaagataacctggctaaaagaaattggggggagggggagacaaacaatgttctttctgctatgcacaagagacaatccaacatcttttctttgagtgtcatgtcgcttagtttgtttggagatgtgtgttttttgcttttaatatcccccaccccgtaacaccaaaaacattttcggtaattggcttagaggggtatctaggtccattaagaagatgattctaattggagctagcgctgtatgttggtcaatttggcgttgtcgcaatgataaagtttttaatggtaaacaattatctaaccctatgcaggttatcttcatgtcttcctactggctccacttctggtctacaatgctaccacaggaggagcagaatactatgcgcaatggtgctacactcttggaatcggtagccaagagtctcttattccactatgggtagcgtagttctataagaattgctagctaaaatattttatgtgatttaacgctagtcaataataaaggagagttggggatttgtcccatcaccttatttctcattttgatttacttttatcttacctttttattactattaaacttatggctgtgtgtcttatgacagaaaccggagatgtaatccatttccattatctaaaaaaaattgtaacacgaatgcagacatgaagtgattgtgcttccatgatcaaacttttggctaagcctaactcctaattatagattagggtggtcttaacaaaaccattctgcaataatcactagctagccgactaatcttgagtttggttagtgaaaaaaatgtttgccagtgctacactagaaaaccgaaaggaagtggttcttgctctgtttttttcagctctttcatgtggctgcttcttcctgtaggaaagcataagaccttttgctgatgagtgctagctgaccaagctgctttactccaattcatggctgtaatggcggattagagaaagtgatttaggtaagaatgtaagattgcgtctgcctactccaggagaggagagagacgtaccgaatatgatcgattacctcatgataggaaccggtgatgacatgttttcagcgcagccctatcagaagagccggtgtgcatgtttcttgcagcttataattatcatatattcctttatttgtcctggtttacctacctacctacttacattctttattttggttcatgtcaaagttaatgaaagcatattgtatggttcaaattaatgtttctagatggttttccgttgatactgggataataggatggagattttaagccctcgtttcttacatttttttttctagaaacattagaaaacttggattattgattgtagacgtccctataaacttgcaaaatcaaattcaatatgcatggacaaaaaaaattcaaattgcaaatgtgactatgttttttcaagtctaatctgatatttttctttctccatgtgtatatcgtattctggcatactttagaatatttataattatttgtaccataagtgaaaaacaaaaacatttaagctgtgtataagcatgtttaatatggcgatagaacaggaccccaaatatttagttataagtatatactacaaaggcctggttctattcttcaactccaattttaattttctcgttttccgttagcatgcttttcaaactattaaatgatatgtttttttaacaaaattatatatagaagttgtttaaaaaaagcaaataaatccatttttcaaataggagaagattaattaccaaatggccaattttaacttaggaagggaactaggaattgatcaaaataagaatggagaagtagttagtcatataagataatataacattgaagaattctttacaagggtattatagactttttaagatatcagtaagtgtttacataatatctttacttaatactcttttaggacgaatgcttaatgcaattcttagtgttacatttgcatttatgtaacgaaacaaacattacatttttgctattgttgtttcttaatatatggccttattttgtaactccaaggtttaatttctttggcttggccttaaaatccatgtaccttcagaggtttaaaaggggataaattttacggtccttggaaaatattaaaaatatttatacgtaacaaaattttacaaattttgataactcgaaatacatagttttataaggatgtgatataagttttataatagaaaatgtgatacctcctaataccttatcaagatggtagaatattggcagtagattgttcttccatgcagtagatagacttgattcggccctacacacaggaattcaaagttgccagcaacaaattctagccccatggccttgaattcagttaagcaacacgtgacgaacaatcttggcatgatccatgaaacaaaggacagagcgtcgtgcctccagctgtttagacttaggagagagaacatgattttgattccatcggctagaatagtacggctcagacatctttccaaccaatgctaagctttcatgcctggtacggtctttaatttctgaattttgttaccaacagcatcactagtataattacttcatggatctatcttttaattatcatttactccctctgtttcataatgtatatcattttagtattttccacattcatgctgatgttaataaatctagatagatacattctagcatttcccacattcatactgatattaataatgaatgcataaatgtggaaaatattagaatgacttacattgtgaaacggaggaagtatgtcttaagaatgtcctagagagttatattttcacgtgtgtgcgcgccaacgcatgtaattaaaaaaagtattgcggagacatgaaatgcgaaatatcacacgtgcttatatacatcgagtcgccttgcaatataaaatgccaagagattatcggtgtggttaattatattgctgttagcaatagaaattatgcaaagttgaattaatatagcccctaattaattaacatgcatgaccaattatcacattatccgcataacgcaccgcaatattccgcgcactctctcgtgactgatggcctagcaagaagaatatgatgtggttatcgtacgtagcatcagaaattcccagttacaaatatagagtacgtacatacctacgtacgaatttcgtactgcaggcaacataacaattttctgtgaaattccttggaacgtacattcgatggaattgattcatgtgaggcttattaatcatgctcgtcctgtgccctgccggccgctttatggctagttcgatctggcatgcatgcgtggcaatggcaccaaaagggcgaagccagtcccatgtccgccgccccacgcggccgtgcgccctcagctcaattatttcaccctgatttccattcaatccatcgtcgccatggccctctctcttgttctcatcactgagtagtgccagtggccatccgtcctcagcgcctgcagcctctgctactgtcaatttcgaatattcgtattgatcgtagccacctctttcagttattaattccgtactaaatgagttcttgagaagttgtctcttcggttggtaatttggtattgtcgaaacatgaattcggcaataataaaaggggtagcgcacgagacctaaaagtagatgaatgaggagacaaaggatttagacaggttcaggccctctcaatgaaaggtaataacctactcctgtttggggatttgaatccgccgggtatagtatagatctgatgaacatatgtggtcatgcccctagagggcctcctgctcacattatataggatagggggcatgattacaagatagaagccttaaccaatacggtactggcttcctaaatctactttacaatattatcaaatcaggactttaggccattccatattatatagatataagttatcccctacaaccagtcggataaccatgccgtgtgggtatggggtacccataatctccacagtagcccctaagaccttcacaatcgagaagataatctttcctcgaaccagattactctaaagccgagtgcttcaatcatcttcgccatggtctcccgagtacttttaccaaatcagaggactgtggagggctgaaaaataaggtcaggtgcatctaatagatgcacctaataggtgtagcccccgactatggttagttgaacaaaccaagcatatagtcaaggaataaataatccaaccaactgagagtgatttttgataattatagtcaaccaagtgacttgatatcaatatatagcatatgcggtatgaaatcccgaataacatgatctatgtgatataccaaatgctttgtaaagcatgatgcatgcaatctaaagttgactatatcattgaaaattcacatagcaaaacagctctaaagaagcttgtatgttgtgaataaagaaatttccaaggtattgggcacacaccatgcgcacactgctttaacagatgtgcttaaatctctaaaagacacatggtttcaccacacctggaaatatatggcctatgtggtgtaaaatccgagtaaataaactcataaggatttaccaaccgtctgaaaaatgaccacattatttaatcagcctaagccataatattggtcaataataatgcacacttacgtgacaaaaagcaatgatagtgtatccaatcaattgctttataaacccaaacaacgcattgactatataaaaaagtcagcggggcagctatgagaaacttcactgttgggcaccttttaaaatgcattgtaccaactcctaaaaagttgagtaactgcgatataaaaggattttaaggtattgggcatttgatcacgcgcactttggcctaagcgaaaggtgcctaagtacataaaagaatgtgacaggccacacctgaaaatatgggctgcagacatattaggcctaggcaaaaaaatatgcctttgacaccctttaaaggatggagcatgtaacatgctcctgagtaataaatcttccgggtgatatagaccaactgtagctcataagaatagcttctgatctgagtgattatcccttatgggatactccaaaatagatataaaaattgaatcccgactagcgcaagtagtcggttgatagcccttgtggggaataatgaatagtccagccgttaagcatatgaaatcgactcgtgaccataaattcatgttgaatgtatccggaacaagtccaaattgaagatatgatccttgtgattgagttgataagcccctgagcatatataacttgtccttctgtcatagtcaaaattttccattggcaatagcttatgcagtcgacatgaaggcaaaatgacgaacatggggatgatatcgcccgtcagaggtgacgaaaatgttggtggtggtaaaaacaatgacaccaatcaaagatgatgaagtcgcatagccatcgaggcgaaaaaactagtcgacagtagtcaggtcagctagcagtgaagatgaaggcgcccaacaacaacgacagagcagtcggtggcgacgaaagcaagccgactatgaagaagtagacacgcatcgatggtgatggcgaaatccaccaattatgaagatgaagaaaatagtcggcgatggcaaacgcatccgacggtaatgatgattagcggcaacagagatagccggctatgatgacgaagttgcccatcaacggcagcagagtaggctatgttgaagaggcttgacaggatgttgatgaagatgacgatgttggtaatccagtcaatagcggtgtagcaactgatgataatgacgaagacgctcatcagcgtttgcattgtaggtcaaccgtgaaggtgaaataataagtcggcgaagacatagtcatccattagcaacagcggagatgtcagggctaatgaagcagaggtgctagtgatgatgtcagcgacaataatccatcaaactgttcagaagatatcaaagctcaagtagtttccttgacgagagcgtgtgcataaagaagactgatgcaacgcttcttgatgtacgaagatgactgcagaacttagtgttatagctgttgtaaatgcttcacttggaggaaagtagatgctgttgtccaactcgtctaaaccaagctgattggctgataactccaaactctcgaacatgtagattaaatcttgaacttgatactttgagaaatttggagtagattatggcagcgtccagaaaccaaaattgctagtgaaataattggagttgctgaagtagaatatctgcttcgaagcaaagatgaagataacgactcctggagttgactcgttggctgattaattgatttcttcagcttgttgaattttgagagtcttgtatttgtgtagcccccgactctttggttagttagaaggcaactgaacatagagtcgagaactgtagcttcttgtcatcgagtactcattgcacgagtaaagatatgtgttgaggatgtccgaatagaaatcttgaaaattagggaaccacttgttgtagtagaataacacggcatcgaatatggaagtgcatgccgagatgtcgaagctcttgtagacgtggttggtgaagtagcaaaacatgcgaagttgcgacaattgggtttgccggtgccgaagataataaagatgaagtcgctccaccatggtgacaaagttgcatagccgtgacgaagtgaacacgagtcggcggcaacggaagcaaaccgtagcgaagacgcatagttgtgaagataaaaacaccagtcggcggcgatataaccagtcggcgacggaagatgatgatgtccatcagtagtggtagcggtataaaccagacgtagaggcgagggcactagtcagcagcagacgagacgaccggcaatgaagacgataaggccaatcaacactggcagaatcatgcagccatggaagtgaagagaccagtcggcagcagacatagacagcttgcattgaagatgacgacgcctattagcagtggcagcgacgtggccagctgtgaagacgatagctccagttggcatcatacgaggtggcgaaggcaattggtcagtgaagacgtagacgcccatcaacggcggcataataggccagccgtgcaggcggaaacactagtcggcggcgacggaggcaagccaacagtgaaagtgtagacgcccaacaacggtggcgtgaccaaccaaccatgtaggcgaagacaccaatcggcggcgaacgaggcggccggtcggtgaagacaacgacgcccaataacagcggtgtgaccacccaaccgtataggcgaggacactagtcggtggcggcgacagcaagccggtggtgatgttctgactgatccattcccggagcgtaagagataagcttaaaaccatgaatcccttttatgcatatttggatctggatcctgcagaacaaacatataggatgagtagtatcttatgtaaatataatactcgaggagaattcaagtatttttaaaatgtttataaatatgtatttctcctcttgtcaattttgatttccccgagcgaatgactccttacgtttaaacactctgcccgactagtcatagcgaatgactcccaaacatgcatacgagtgacatgagttcgtcattaatggaacaaagattcacggatcagagtttactactcgggtacttttgcaattgttaagagtagaaaataaattatcttatctctatacttttgatttattccgagtaatacttagcactttgtgttactcggtccatccaacgagcccccgggtgctaggaatcggcccaaaggcaactatccattgacaaaccaaacggaaagcataggaagatagaactccataactcgataggtagctttgtactcggattatgtcgcaaacaatcaagataaatattatgaaaattgttgaaaaaatatgatataacatctgtagcccccgattcactagtcaacggtaaaccagttgatgtagtgaggcagaggaaaaggaaaatatcatataaagaaaattaatgaggacttagctttttcgtattccctcggtgacaatagaagtagccgatgtggatgtgggaacgaagtcgtccatcaataacaatacagacaccagtcggcggcgacgaaggcggtcgacggtgaaagcgaagatgcccaccaacagcggcataataggccagccgtgtaggcagagacaccagtcggcggcgacaaaggcaagctgatcggtgaagaagtggacgcccatgaacgggggtgtgaccaaccaaccgtataggcgaggacaccagtcggcgacgacaaaggtaggctaacggtgaagtcgtagacacccaacaatggcggcataataggccagccgtgtagacggagacaccagtcggcagcggcgaaatccagccggtcggtgaagacgtggacgcctatgaacggtggtgtgaccaaccaaccgtgtaggcgaggacaccagtcggcggcgacgaaggcaggcaacaacagcggcataataggctagtcatgtaggcggagacaccagtcggcggcggcgaaatccagccggtcggtgaagacgtggacgcctatgaacggtggtgtgaccaaccaaccgtgtaggcgaggacaccagtcggcggcgaggaaggcaggctgacggtgaagtcgtagacgcccaacaacgacggcataataggccagccatgtaggtggagacactagtcggcggtggcgaaatccaaccggtcggtgaagatgtggacgcctatgaacggtggtgtgaccaaccaaccgtgtaggcgagaacaccagtcggcggtgacgaaatccagccagtcgttgaagacgtggatgcctatgaacggtggtgtgaccaaccaaccgtgtaggcgaggacaccagtcggcggtggatgaggcggcggcgcacaaaggcaaaaccccctagcccgcggcggaagaggcgtagtcgggctgtgttggccgggcgaagaccgaagcccccgacatgcggcgtcgcatccaggtcgtgcgtgccctaggagcagtcaggccgcgttaggcacgcaaaggcggcgctggcccgcagcccccaggcgtgtggaatctccaaacatgcgaacaaaatagcgaacacaagcttcagttaagttgtgattataaataaatctaattagtaattagagattaatgctctgtagatataatgcacgtgtcggtgcatatatgcagtatgcatgcatgttggttcgtttgctaatagcatgattgactggagatttggtcggcattaatccagcaacacatgcatggattaatacgtggcagagatgacctcagttggatgccgcccgtctcgtcaccagtacatgcaaaaacagagagcagaacagagcaaattaatctgattagaaatcaatctaatgatgatagattggagtatccgaggatgccatcagggagagatcggtcttgctgcctcgcgacaccagcgcgaggtcaccacgagcactatcgcgagcgcgatgcgaggccaccgctgacaccgctgcaggcacatgcagcacacgatctccctccttgcgtgtcggcagtggcggcgttctccggtcgggcggaactgatgaggcctcgtcggggagataactcctaaaagtggcatctccttcttagttagattgaatctctcctgactggtttgaatccaagtcagagaacgagagcttgttgatgttgtcggcgacgaggaagcgacaatcccgaagtgaagacgaagccggtgactcatggagttgattccatcgcacttttcgacgggtaattcgacgcaacccctacctagcgcgccaactgtcgaaacatgaattcggcaataataaaagggggtagcgtacgagacctaaaagtggatggatgcggaggcaaaggatttagacaggttcaggccctctcaataagaggtaataccctactcctgtttagagatttgaatccgccgggtatagtatagatctgacgatcatatgtgctcatgccccctagagggcctcctgcccaccttatataggatggggggcaggattacaagatagaaaccttaaccaatacggtaccggcttcctaaatctactttacaatattaacaaaccaggactttaggccgttccatattatactaggaaacgtaatacccaagtcatgatccgttacatattttatatagatataagttatccctataaccattcagataaccatgccgtgtgggtatggggtacccataatctccacaggtatcctcttcttcggttaatttggtagccttaagttcatacgtgaatccaaattctggattattcaacttaatagcatctactaacactctcagtccatacgtgaatccaagttctggattattcaacttagttttttcttcaaattcaaacttgccaaaacccattttcaatataataacagcccttgacacatagaactaatcttgtagaatgagcatgacactactagaaaaacggttttttacacgcaaccaaaagcacaaaaccataactatttgcaagctagctagatcttatgacaaagaggccgaaccaggccatcagtggacatggagaggcactggcaggtccgactcggcgtcggtggtgggtccgactccacgacgatgaccactgctactcggctgctggatccaaatggtagtgagctaggaagcggcagggtggcttgatccggatggcgactggttggggagcagtggggaggccaagtccaaacaatggtggaggtggtggtggcatccaccctaatctcccatctccctctccaaactcctctcgatctagaaatgacgacaaccattgctggatctgggtggtggcgggccaaggagaagggggttggaatacagtaacaacaatagctgcgtggatccggcagtaagaaggtggtggtcttctagtgagcggcaaagcccatgcgacagtagcttcgtgcacgggcgcttagaggagtggagtggtaggctttggtgacaacgactaagcccgagcgacagcaacttcgtgcggccgaccttgggaggggctgatccgctgttgaagctagggttttgcgactttttggaatttttattttttatgcatattttttcaggtgggcggcataacttgattgccaatgaaaatcacttttcacatgcggttgtgctgcccaaaaatatgccgatctttacaaattaaaggggcatgtagttcctcaatctgccaacgaaaatctgttgttgagatatgcaaaaatctttttttactagtgatagaaaatgatgaaggaaaaaaaaccacctgtcgcacttacgggcgataactatccgcagcaccgtcgtcccacttcctccccttcctctccccttggtgtctgcaaggatagtggcgacatggcttcttattgtaccttgagctcaaagccgacggcatggatgttgccattgtttagacaaatctaaggatagcgctggcattggtggtggggcgacggattgtgcggagttgcagctaaagcaccgtggtggcgtcgatggcagtcatcctaccatcctctcatgcttggtcgttacggatgagcagctatgacggctggctggctagggagatggaagttggtggcgttagggatgggttggagcggaggagcagttgaggtgccagcctggtgtagcaatgctggtggcaactctttcccttcacatgtgttagtcctccggagagagtgttgatggtcgataagtgcaaactttaaccgttaactcttgcataaaagaattcaaaataaaatatcaaacttagtggtaggggttaattacaaaccgtttccacgagttttggtaaatatatgtatgcaggtggttttggaagaaattacacccaccatacgatgaaattcacctccggccaatcatgatagtcaaaaccaacctaaactaggaccaaaccatcctcaacccccataggggcccaccaatcatctcctggtgaaagacggtggataggagtggcacccacaggtcagccaaactggtggttccgcagcacgctaaagggtgctaatagcagtgcacagcagcggtcttgctgatagtaggactggaagttggcttgcggagggttgttggtcccatgtggcagaggccttatgatcagtggcggattcaccgcctggcttgggcagacagttgctcgggctgcacgagtgcaaatgagactgatttcagcaaatctagtaaaagtgagtgtgaacaagaatggtaaaatccatggatttaatgacttcccaacaaatctagtagattaaactttcaattacttcagttggaccgtacaagcagcaagccttgtaagccctatagcatgaaattgagttgtactgttcaccagaagccaatttacctgaatcacaatggatgatgtgacgcactcgagcttatataaatcgtctgttttacaataacattatttttcttcaactattgaaaatttacatgcatttaaactaacaaaattgttttgtctttagttagtagtaaaatgaaggtatagacattatatatgtggatagccattttggttaggctttcccaggcttcacgaaattcctggctccgccactgcatatgatgcaacgtttggatggtggaaactgagatgatgggtgacgaaccacggtcaatgttgtagggggttctaggcaaaagcctcgcccaatgttgcactggggcggcaacaattacacctttgaacaccgtaaccctcctgagggcgctgccaaggtacctcctcttggcaagagtctctggtgaaaaccatgtccatcttggataggcaaagtcagcgcatcatcaatggcataacctccatggaggcgttgtgtttggagtctacacactggatagtgtgcagactcagtggagattgttgtaggccagtggaatttggccacgcatagcggtgttcggtttagtgctaggttccactctcagcgacatgtgcttgtgtggttggcgcgttacatgggcatgcagttcggtgcacaatcaactttgattgccttctatcgagtttttgcaaacttttttttcctcaatcttaacgatatttgaatggtctttttctaccaccattccagtaaaaatctatccagttcacattctatccaaaatggattatctcatcaagcaaagatttcacttgtatttttttttcttcaattggaattgtagaggctatttaccgatggtcgaatctgtcatgagtgcggagaggcaaaactacggatgacccatcacggttttgagctttttttttgggttaattggatccatgccactacaaatttattgattcaaaaaaacaccactactattaatgatatcggctacgtgccactggaattttggaaaaattggaacaatgccactccgtcacgttttctgtcaaaaatctccgttaaccccaactgcatgtgggacctagctgtcagttccatcttcatcacctctttcccttacctctcttcactctatctccgatggtcatcatcctccaccactaagagggcttggagccgctgccatcatcgatcccatccacaacgtgagggctcgggaggcaccgccgcggctatcgtcaacctccaaggcgagagggctcgcaagccaccactgtcgtgccgccatcgacctccctcacggcgggctgttgtcgacgcgacctcgtcgcgcgagggcttggagccaccaccgtggccattgtcaacctccatagcgagagggcttagaagccaccgccgttgcaccgccatcgacctccttcacggcgggagggcttgggagccaccgccgtcgccaccgtcgtcttcaaccccattggcctccgccgccgctgctgtctttggccccatccgcagcatcggtgacatcatcggcgagggaggtagaggcgcccgagcccttccaccgcagaggaggtcgacgacggtgagagagacggtcgcggcgggctgtcgttgacctccttcacggcgtgaggactttggagccaccgccgtcgccaccatcgtcttcgaccttatcggccaccactaccatctttgaccccatccatggcatcagtgacgtcattggcgagagaggcagaggcgcccgagccctcccgccatagaggaggtcgatggtggtgagggagacggcacaatgtgtgtctgtatggtggttggggcagtcgcggcttgcggtcagcgtgaaggggtggcttggcggtgaggtccggtgaatgaggggtgatgccaccgccattgctggtggtgatggtggttggcgtatgtgccggagacgaagaaaacatgacggagtggcatggttccaatttttcaaaattcccgtggcatgtattacatatcacgaatactagtggtatttgtttgaatcaacatatttgtagtggcatggatctatttagtgggttcgcgctgccgtttgtgtctaggacggtggaccgctcagggcgggttcctgctggatgctagtgaaacggaccatttttgaaagaagaatctggattctgcaaccgtttgctttgccgcgtccttgtagctagcaagatttgaggtatcaggtggtgattcgagctgcgatctcaactttacttttgatttgctcatgtccttttcgatccttattctaagtgatatatattttgaatatggacattttttttatttctttggtacgtaactattattaggatgtctatttgaagataatgtacggtgcccatcatcaaactttactcgccaataattgaacgcacgtaaactggaatgaggtgataccgtatcgatcgcaaggatggtaaccaatcctggcgaagaagtaagaattgacaggaagcactgaacgtgacaatgtgtggtactggagttgtggtacatgactctacttctccctgcgtttcatgttataaatcttttttttttcggggaaggctataaatcgttttgactttggttaaaattaaatttagttaaacttaaaacagtttgattttgaccaaagtcaaaactatgaaacggagggaataatcatcaggctttaaattttgaggaccacgtatattacacataacctggggaggaggacctttaatctaggttgtacttctctaatctttaactaaatcctatttttcactaaagcatatcaagtggctggttaattttctacattactaatgttaccaaaaataaataattcaagtcagccaacacatcaaactgtcaatatctacatttgtaatctcgaatattttgaaattactaaaaaacaattattttactaaaaaacaattattttaaagggtgtactgtgctcgacaatggtccgggttgctaagagaagagggtcgtgatgtcatgaaggaagggtgtactgttatgcacttttgttcagggacatggctgaaaatttttacccactaaattataagataattttcgcttaaacggaagacccattattttgttctattattttcgaataacacgctatttgaaaataaagtttacactgttatattctatacccactaaattcattatttaagatctatattgactaaattatatttaaaccaatagaccattactttagactattatttttataaaaaatatttagtgattgagcatgagtatgtcctaactagaccgtattaactctcaaccatgaaattactcaaaaagtcttattttaattttctataaaactcctatttactcatctatatactgccataatactatttacccgtctatataatgccagtatatactggcaatatattgtaccgtaaaagttttctaagtattaccaatatttgcaatatcatctttattcttcctgtgcaggggtgaagctggttgagagtatcattggggtaagctctattggtcggcatcataaaccctggatttttcaccttttggtctttttaatacttattctacaaataaatcactaaaacaacttattcgactccttttcgcggcaccaacgtcattagtgttgtggtccaacatgatgattggaataacattggggccatcccctcgcctccaggtgaaagctaagtcactgtagtgtgaaagggacggcgccaatattgttggtgccaagaacctatttgtaaaataattaaaaataacctatttgtaataaaaaaatatttacaaatagatcctcagtacagtgacgctggcacagtcacttgcgtcaaggatctatttataaatatttttattacaaataagtgcttttctataaataggtactttttcaaaaaaacatacaaatatatcctagtcgtcaatgatgttggcgctatcccctacacattaatgacttagtttctatttgggtgctagggaatgacgccaacgtctttgatgttgtcatgttgaaccacgacgccaatgttgtttgtgccacgaaaacgattatttatagaataagtttgtttaagtctatgaatacgtttactaaaaagataaaaaaaaagtgaaacatccctccataaaccttgaattgaatcgaaacaatggcttactagaatattttggaatttttcgggtttaatatttttgaggatgctggttacaccaagtatcatatttttgtcatcacttttgcaacgccgtgatacatacggcttacaagttgactggtccgatcaaatacatgacgtaggttcttaatcaatagacgaaagcatatactccaccgttctcaaattttagtatttctaatatttggagtttacacaatataaatatttcagggacattgattaattctaatacacaagaatccgagtattttttttaattcaaaaaaaaagatttcagtattcactaccggagaaaccctcttctctcccggttcgcaaccccctttactcccgggtagcgaactggaagggagaatccgtcactaaagatggcggtctttaatgccggttcaaatacccgggagtaaagatgcatgtttagtcccggtcggtaagatgtagccaggccaggaccgattgctactttattttattgtttttaacattgaatattgatttcactccatccctaaatagatcatcacagatcacaaatccaacagatcacagaacaaaagatatctccaaatcctcaaattgataatctccaaatacatcataaattataaaacattgcatcacaagttatacaaaaatcaccacaaatacatcacatgaatacatcacacacaaatcaaatacatctcagatccaatcacaaattcaaaaaaaaaaacgctagcccgccgccgtctcccgccgccctcccggactcctacttcgcgcgcgcgggccgccgccgatgcgccccaccgccggcctcgctggccccgccaccgcgccccgcccgcaccttgccagctctgtgagaaaaggagaggataagactgtgtgagagaaaggaggaggaggaggaataggaagataaagagaggataagagtgagaaggaataggagatagaaatttttgaggataagtgcaaagggattatataaggtatattgatttttagggattaaagatctataaaaacttttagtcccggtggggaacaacaaccaggactaaagttaggatcgatctttagtcaaccgggattaaagatctctgaggacctgacagcctttgacacaaggtgaaccgggactaaagatcaagtctcagttggtgttaccaaaccgggattaaagatcgcatagtcctcttgcacaaataaaccgggagtaaagatctttactcccgatttttagcaactaggattattgtggaaatggaccgaaccaacaaacatcacttctccagtagtgatttcagccaattaggtgcttatgggaggcatccaaacaatttaaaaatcaaaatttaactaacaagataattgaaaatgagaatcttttctctaagaactgcatgtattaagaatggaggagtatgtactaatgtacaacgagatcactatctacaagttacgtcgctgtcaagtgtgtcacagcacactcattcaattccacctggaatttgcgattcctgctgacacaccatgagtcatctacccttgaaacttcccattgccaactagattagcgtaggatctacaagggcaaatgacaaaagcgatcgtcggttttggcccgatcgaattgaatgatatcggtagcagccagctgccgctcgcgcgcacggtttcgacgtccacttcgaccggccatcgtcggtgggcggcagcaattttccccgcgagcctgcgtgacttccacgcgcgagggcgggcgagcggcacggccaaccgctcgtgtacgtctctccgcgccgcgcacggcccacgagcgggcagcacgcgtgcgtgagcaatgatgggtgagtaattgttggcttattctctctatctaaacataaacaaaataaatataacacatcgatatcagttcagatttaactcgtgataataaaaggtatcgtactcccgccgtccttgtaaaagaagtcgtttaaaacagcgacacggtctccaaaacacaactttaacttttttttctataaaaatatttattgaaaagtgatatatatatatatatacttttatgaaagtatttttcaagataaatctattcatataatttttatattttcaaacttaacaacttgcttgagagttattcatgatttatattcccaaggtttgacttaaacattgtcctaaacgacttcctttataagtacagagggattatagtataatactccctctattccataatataaggcacagctactttttctaaactaggaaggtagcccacgcattcgcgcgggcatgcatcgtacgctaagctggggacacttatagcagcaaaatattaaccagagaacatctgctacgatttctccataaattatttttgttggcattaattgcttttataattttctaacctatgagctttatcttatatgatattttagtaatatctacaagtaattatttataatcttctccatcatttgaaaagtaggtagaattattttctttagaaaacatgtcaaaaaaaagataaagtaaggttttttttaattgcatatatattatcatggtttaatagaggagaattgggtgggacatgaagctccactaaatgtatgggtttatatagcctaatataactgatgtattttgagaggtgatccatctataaacatttcatgtacacaaggtcagacactccacacagcctaacatgaatactataatggcaacataattgtgctgtattaattttgaaatgttatagtattcatattactatagcatgaatacacatttgttttttatataagatcgatccaacgataagaaataatggttccaccgatttaaaaggcataggactattccaaaaatatagcttaaaaattatgtgtgattaaaattcaatattattgtaaagtgagtgtagctcaactggttagtttccttatattagaacttgccaccgggttcaagtcctatactttgacatgggtgctcgcatttacgactaattattctttcagtggtgggtggcgtatccatcgacagcgagacgcccgtggtgatttcttaaatctcaaaatatgtcgtctaatcttttggagatacacaaatgggggtaacctatgtgtttgggagttaataggggtgagtgtgcgtccattaagttgtgagcgcctacgtttgttgtgtgtttcaaaaaaaacattcataggggtaggctatgtatttatgcattcataggggtgagtgtgcatgtgttgtgagtgcctatatttgtaatatgtttctaaaaaatatcaaacattattgattgtttttcttttagtttaatatctaaacaatatgaaggggatgggcagtgttgtgcgcatgtgagggcgaggaggaggtggaagagattttatttttgtaatttttctaaatgatttaagtgatagccgatgatggggtgcttcacttttttttaagaatttctaagatactttctttgctttataggacgtggcacaccacaattcaagattatgtttaagaaatagatctaatagttaaaaataatggatacatcaatttagttgtatttttaacttaggacatgatagagagtgacttatgaacgctcgcgagggagtttaattaatacatatttttaataaatttttggttgttaggatattatttttttaagagatattatgggtcctagttttgagttatatatttttataaatacatttaattttaattttagatcgattagaaaatactttgggtgttgtattttctaattaaaccacttagattgttttaaattgttctagtcgaagtacatgttattaatcagaaggtttaaaaatctacttgatattttcttcaaaatgtatgaatcggtgaacaatagttagtccgtagtatatatatgacacaaagtaatgaatttctttaataatatacttaacttagatcttcagttttaaattttatagtaaataatctaatggtgtgcaccaattaaaaagtagctatatgatttagataatatagttgtttaaaattagttttcataaaacatttttttccatctaactaaaagagaaaaataggggagaaagaaaataggtggggaggcacgtatgtactgaatgggaggggtggatatgcggggcttgttttcttatccttcctttttctatttgataaacaaatctaatgatagaaaataatgggttataaatattttttccatctaacaaattgatgaaaataggagaaaaataggagagaaggaaaattggtgggactgggaaggtacatactggttggagtaagtacaggagaggtttgagatatgggggccttttttttatccttatctatttggataaataagtctaatgatagaaaacaacgggtccactgcatgttagtgaaaatcgatggacggatgttttgtttattctcagatttttttgtgattttcttaaatttattaaaatgccacgtggtggcataggagcatttaaaggagtgccacgtgacgacttgagagcgtttatagcacatgtgcaggcaccttacttatttagtgatgattaaaattttattataaatccttatgtggaaatgactttttaaaggaaaaagtctgaattacacccttaaactacaacgacggtaagaattgtcccggttatatataaactcatttatcatcattgtttgtaaacatatgagttcataattttttgtttttttttcttttattatacatttgattcacctatgcatgttcatgggtattataagatagaataatctatattgtcaaaattatttgtgctaattattaacattatatagatgagaatgacataattaaaagaagatatgatgtggttccataagacactttcattgaatgtgtatatgttttttctggcaaatactaagcacgtacttgttcctctcttttggagacaaattttttttctcttagtgtaggtgtgcgtatgtgtatttatatgatggatgtgcatacatttatatatgcgctcgtgaatgccttttatataattagtaaaaaaaatattgtcagggttatggataccacatacctaataatagttgactgaatctcggcagggcccaccacatactatgtcctatacggaaacaaccttcggatataggaggagttccggataaggaaagacacccagagttctacatggaaacgataaggactacccgga

SEQ ID NO: 5308 - DNA, 402 bp, Oryza sativa
aacaaccgggagtaaagatccgggggtatatatattcccggtgcgccctcgtcttcttcacaaacacttagacgttttcggccgatcgatctctctcggcctctctccttcgccgccactgcctagggcaaatccccgcgccgacgccgtcgtatctcgccgtcgtctcgagctcgtcgtcctcgccgccgcctccgcctcctccgctgccgccgcatctctgggctgagagccgccgccgccagatctaccttcatctcgatctctccgatctcgatcgctctccgtcgcgccgcccgccacgagacgccgcgccacgacgacgacgcgccatgccgacgccgcgccaagccgccgccggcacgccacgccgccgtcttcgccgccgcgcgcgcaatgccg

SEQ ID NO: 5309 - DNA, 405 bp, Oryza sativa
  unsure (1)..(405): unsure at all n locations
aatttgagatatgccatcctgacccacatgtcattgactcatatgggttctacatgtcattgagatccaatggcatatcttaacttttgcaaattataatggcatggttccaatttacccaagaataacagttggatctgccctcatgggtagcattacgatcaagctgccatggcctccccatcaacaactgacaagcattcattggcaccacatcacaatccactttatcaagatagctatcactttatgagtaattttctgtgtgcccgcttgattcatccattgaatataacgtggtggagaaagcattcgagtagccaaggataaagcataccccaagtctaaannnnnnnnnnnnnnnnnnnnnnnnnnnnnnnnnnnnnnnnnnnnnnnnnnnnnnnn

SEQ ID NO: 5310 - DNA, 593 bp, Oryza sativa
agctcggtaccccaaattaagctagttcaaattaatgaagtttggagccaacagttgatcacgcacaccgactgggcaactgacatgcatgcaatctctactatgggctccttcagaatttattccatcaattttccccttttgttgaatttgttggttggctggttatgatttttagggctatttttcgcaccattgactattgattagaaatacctggcaagctaagtaatcaatttgcatttgacgtactgtaaatctgtaatcagggtgtgaaaaaccgccggtaaccgcgcggttaccgcggttaccgcccgtaccgcgggggtacggttacccgtaccgcgcggtacggtttaataaaattcgtccaaatcaaaaatttaaaaaaaaagaaaaaaatccaaaaaaatagtgaaggtagtgcttgatttatagtgttttatggtgaagaaatttctcaaaaaagagttatatttattcaaatttgagagcaaaacggagaaataaattgaaaaattgaaaaaaaaaaaaaaatgggcccggcccgtacttgggcacccaatacacatcgcgcggtaaccgcgccaaac

SEQ ID NO: 5311 - DNA, 691 bp, Oryza sativa
gttgatttcttaacccgcagcctgtcccttgccattcccctcctctacgtgagctaacctggtgcactcattcttctctaactaggatacctctcgatggcagcagtgctatctccactgatcgtggccaggatgtagaggtgggtatgtattcgttgatactctactgattagaatttgacgaaccactgtcattcaatctgctgacacatattgcagttaatgtctgttcttcctgcctgtataaacactgtttgatgcatgtagaaatgtgtaccttgcaatgtcatgcatggatcaaaatcagacagctcaagataaggtattacaagcacacttaattgaacaaattcgacatgctgcactttgattgacaattttgagggcaacaccaatcttgatttgagtgaaaacttgctttatgtttctatttgttccatttctgtcttttcacatgcaagtgcaaccttatttttttatgagacgttgctgtacaagattaccagcattttcttcccaatgaacaatacagaatgttgtttcttattaatggttctatccagcaatccagtcttctataggttgtcctgtttttgagcagtattcaggagggcagatccctcccttgaatttggaagtgactagtatattcaatgcgtgcgcatatgcaatgctctttgcaggcacacaa

SEQ ID NO: 5312 - DNA, 579 bp, Oryza sativa
  unsure (1)..(579): unsure at all n locations
nnnnnnnnnnnnnnnnnnnnnnnnnnnnnnnnnnnnnnnnnaatttttggagagggccgagtaggtcccgtggttttttactcctcatctcgaggatgtttttccacgtaaatcattgtattatttgtgcaagttgctttgatcctttataattacttctgcagcatccttcacttctagagatgggctaagtgaaaggtttggaactgtcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatcagtgacgggccacaacttgaggcccgtttgagataacaactaggcccgtcacagatgactcatcagtgaccggctatatacttaatctctatcgggcattaactaaagcccgtcaccgatgactatttttccatttttcatatgaaa

SEQ ID NO: 5313 - DNA, 583 bp, Oryza sativa
tctggagatttgtgacagtgaccacttgtggatcaaggaaggcaacttccggtgcatgcttctgacaccattgccaacttaacctacacacaggataaacgatcttgtaagcaagttaaaccgattgttattaccagaatgagttgggcgacaatacttacaaggagtagcacttaaggaggcttgtgtccaccgttcggagcctgtagaggtcgaaaagatccttgaagtcgaccacgacataatttgttggaccaaggaatggctttccatcgtgctctccaaggatatcggtagctttactcggcttcctggcgttagatttctccatgtagtataagtgaaggtccttccaagcggtgcccattgtggcaagcacgtcatctccaaccaatggcatgcctagtttgaacttcctgtggagcaacgtatttcttcttgacctctttgcccttagtctcttcctggcccttgcccagatctagcttccttggagctagaagcgaggcctgcacctttccttccctttctctcccctttgcttcgggtttattgagagttattctctaaggggaagaatgtg

SEQ ID NO: 5314 - DNA, 1396 bp, Oryza sativa
  unsure (1)..(1396): unsure at all n locations
aatgtttcaggacaaatcctctctatcctagcctatcctttgcttggtgtccttggatgaaccggaggaagaattaatcacacacgttcccttggattcgatacccttggaatactccgtagaggaaatgttacatcggtatatccgtgcgcttgcggattctatctgtgatcataagaaatatcaacagggccctgtaccacttggctccactgccgcacgtgtttgttcccatggattttcacaagtgctgccgcaacctcccagagctccatcgagcactcctcccacatgagagggtgtagagagagagagagaggggaagatggaggaaaaaagtgtggtatgggtcccaacgtattttttttgactagaatgcggaatgccatgttagcgaaaaccaccacgatactacgaggggcttgatttacaccgataatgatagttaggggatactctataccgagtgttgcggttgatgggcatgaatgaaactcgaccaatagttgagggatgataagtggactttttttttgcggggaggagcaagagatatattactcaaccaacagatccttactgatatgctgagaaataaagctacaagaatcgcctaaccaaaaacttgagggctggtcagtgcgagctttatgagccaacatatgattaatttggttttgggatctctgtatcttctttataacaatttccctctcaccaagtatcaggcatttgatctccccgaagatatgcaatctttcctttgtcgtatacgcctccgtcaagaacaatatcattagagcaatgtgatgagcacccaacaacgagtaccctaatttatccccctctttcacggtaccaaataaaacagctatcaaattaattcagaaaatatgatgacgatataccaaagcactcagaatctaatccacccgtgctttcacacacgaatagaagaggaggcacacacatgtaccaagcaacaaaaccaggtaagacttcctgatcttgtttcttctccaaccaatcagttatcaggcggcaaaatattcagatagaagctgatgggatcgccaccagctagttcggcagggaccaaaccctaaacatgaactttaggaaaaccaatctgcctcctgttgctaatacctaacatatatgtatacgtgcatgcaagcactagtactggacccaacacaggctcgcaggcccagaccaacaccgactgcaactcaataaacaaattaatatagtgactaaataggcctttacaaaccaggtccaacatatattaaaataatgtggccatgacccctcatgaccttggctaattannnnnnnnnnnnnnnnnnnnnnnnnnnnnnnnnnnnnnnnnnnnnnnnnnnnnnnnnnnnnn

SEQ ID NO: 5315 - DNA, 1481 bp, Oryza sativa
  unsure (1)..(1481): unsure at all n locations
gaatataacgtggtggagaaagctttcgtgtagacaaggataaagcatacaccaagtctaaactgatagcattagtgaaactaccaccatcaattattaatttgcaaaccttctcttgaattttgcactctgactgaaaaatattacagcgctgcccctttgcatcaacattagagccatctcgctgaactgcatatgcaagcatagataaaccattattcttttcagcaccatcatccatagatgaatcatcaatatctcgatagcccgtagtaagagtatgatcaagttgtacaccttctgaattttctaatatactctcagaaacatagccttctttagtcatcaacgccttcttctgattaggacaatctctcatataatgtcctctccctccacaagtataacactgtacacttcgtgatttagaactagatgtagcagtagattcaactttagatttggatttactcaccgaactagcagcaggtttagacccatctctagaaggagtagtcagcttgaaagacatcgacttactagcggcacttccatcaccatctcgctgaaaagaacatgaacggctagtgtggcgacttgttagttgctgctccaccctttgagcaatgtgcaccatattttgtatatcataataatatgatatctcaacacgttctttcacatcatcgttgagaccagtaagaaatctagcgatagtagcttcatcattctctgttacccctgtatggctcattaacaattccatctccttataataagcatccacactaagatcaccttgtttgagttgctgcaagcgtgtatacaaggatctagtataatgttcaggaacaaaacggcgagccataacctctttcatatatatattgccaagtatgtggacgaccaacatgtaccaattgattccaccaagataaagcataaccagtgaattcaatagatgcaagacgtgccttcttatcctctaaatagttgtgactattaaagatctgatcacaacgcatctcccactgcaaataatcctccggatctccagaacataaaaaagcaggcatggaaatttttatcttaccaagcccttcatccaacggaacacgagcagcacgacgattccgattgtcacggtgaatatcatcaacaaccctatccataaaagcaggacctcggcgaggaggatgtcgaggacgacgatgatgatcaccttcatcagaacacaagcctagactctcatcctccgcatcatactcatgatgttcaggtagtggacgtcgaccctgtctagcatgttcctgacgtggcagtggtagacgatcgactaacatagaaatactcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5316 - DNA, 1529 bp, Oryza sativa
  unsure (1)..(1529): unsure at all n locations
gtcacgagctatgagctttttggtatatttttgttatagtttttagggttaattggatccatgccactgtaaatgtggcaaattagaaaaataccactactatttgttttattggctaggtgccactacaaatttttaaaattgaaaccatgccactccgtcactatttctgtcgttctctctcacgtcgtcatcctctaatctcacgtaggcacggcgagggcaagaagacgaggcggccgccggcgaggacgtcgcgagcgcggggagcggctgcggccacggccggcgaggatggagacggacgccgagtggttgaacagcagcttgccgacgtcgcggacggcagagccaacaggtcgaggaggcggagtggcggagttgccggccggcgtcatggccgccatgccgccgtgctaaccgtgcagaggctgcatccacgccaccatgccgccatgacacgcaccgcgtgcttgacgcatacgaacatggacctggcattgacagccatgacgcggtcgtactcgtcgatgtcgagcacgccgagcgagtccggagcctgtgctcctatgatccggcgttgctgtagaggacgtcgaggcggccgtggcgcgtaatggcgaggtcaacggtcgcggcaacatccgccttgacagtgacatcgctgtgcgtgtacaacgcgcgtcagcgccgagcttggcagcgacggcacggcgttcgcccgctgctgctctcgctccccatgccatcgccaccgccggagtgccgccgcggggttccgttgctgctgctcctgctcccgctcccggagcgcgccggagtgccgcccgcgacccgccgcgtcgccccgaatcgtcaactgccgcgccgtcgttgggggcgggctgcgccgcggcggccttgtgctgctgctgttgtgtgtaccgtcgctaccgtaagtggtggtcgccgggggagccgaggcggcgagccaccagactagctcgtcggcggggctctccctgaccaagccactatgcacgcagtccatggaggacgagagctgctcgtggaggacatggagatgcacggcgaggatgagctcctcttcctcaacggcgtccgacgagaaaggtggtaatgcatagcggcaaccgcgcgaggaacgaggcccgcagctgcggcaaccggcattgtgaaaatcaacgatgggaacggcgccggaggtgaagaagatgaaggccgatctccccgttccccgtgtctccggctgaggttcttgaggcttcttgaagaggacgtcgaggcgacgacggtggcgccatggcttgctccggcgtgctccggtttgacggcgacaaagacgatgtcccggtgatggcgtctagtcccggcagcccccacggcggcacggaccatagagttaggaaattaacgggggaacgacggaaaaggcgacgggatggcatggattcaatttcccaaaattccagcggcacctagccaatatnnnnnnnnnnnnnnnnnnnnnnnnnnnnnnnnnnnnnnnn

SEQ ID NO: 5317 - DNA, 719 bp, Oryza sativa
caaattcatcaaagggatattctgcagattcggattgccccaccgtatcataacggacaacggctcccagttcatcagtgccgattttcaggattactgcatcaggctgggagtcaagatctgcttcgccgacgatgaggaggaattttgaacggagggtaatttggtcaaatttatggttgtaatggtgtggaatcaatggtgcgttgatggcgatggcatttctggaagaaaaagacttgtacgatggcattttatggattttctctaatttaaaattttaagtaatactctctccgtcccaaaatataagcattgttggacttcgacaatgtcttcgagatgctacattgatcaacaatatctataaaagtaagatgttttaaataaaaaaagttacacattatgataatttgcttaataacaaatctagtaacatcaaatttacatgattgatctgtttttgttcgtttgctattaatagtcaaaatttaaaagtttgatttgccactattctaagaatgcttatattgggatggatggagtattttttttcttgtatactaaggatgtatgtgaggtgatatttataagtggacgtgccgattggatgggctaggctgcgttattctagagcacagattgttaaaaattgtaaagtaaaattacttgaatcacgtcgtcttaaatttatgagaaaaaaaatgctgcaacaatag

SEQ ID NO: 5318 - DNA, 1601 bp, Oryza sativa
gaggctattgagttctgtgtcaattacatgtccgatgctgatcctatcggagttcctgcgtctcgtcacgagggaaggttgtcacgtgttggcacaattggaaggaaaagaatcaggcctgatcaagcatcgtacgcgtaggctcattacgctgtgctccaacatatggcagaagttggcccatactttgaggagcacttagcgaaaatctgagatgagaacttggggcgatctgatgcatggattaacagagaacataattctcggttcaacgaatggttcaagaatcgtgtgataatgtccacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatctgcgagctaaactacgtcaagttcaaggttcgtttgttccgctgccattgggtgaatctaagcactggtgtcaaagccgacaaggaaggtttcactttagtagatctatctaaggtgggatacgtcgatgaaccatttgtacttgcgaaacaggtcgagcagatattctacataaaagacccttcaaacaggaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaagtcataaccttgtgacatgcatttgtacttatctattgtaatgaatgaagtattttgttttattacaaatgaccaaaataaaagttgtagatcctgatgagaggatcaactttgtttttgaccatatttcaatttgaaatcatgtagtatttacaaatgctgttaattagatttgttatattgtcaaaatcaatttcaagttgttgggaaaaaaattatatagaaaaatgaccaaaataaaactagtagatcttgaaaggctctacaactttgttgttgaccatatttccatttgaaatcatttactatccaaaaatgtattatgactaataaaatgaattattacacagcagctatatattttgcacccacaacaaataaaagatggaaaatgagtcatcgtgacgggccttagtttatggccgatagagattaatctatctcaatcgggctttatcttagggcctgtcacagatgactcatccgtgacgggcctaaatgtcatctcaatcgggcattattatggagcccgtcaccgatgagtcatgtgtgacgggccctacggcaaagcccgattgagatgactcatcactcttttgtaactagggtttctcaaatcggattgaaaaattttctaagacctgctatagttcccgcctccttagaaccctagcgccgccgccaactcctactttaccgccactgccaccgagaccgtaaccggctggcaccgagcccgccgcc

SEQ ID NO: 5319 - DNA, 7044 bp, Oryza sativa
atttacaaatgctgtttagatttgtcatattgtcaaaatcaatttcaagctgttggaaacaaaggtatatagacaaatgaccaaaataaaagttgtagctcttgataacctctacaattttattgttcaccatatttcgatttgaaatcatttactatccgaaaatgtattatgactaataaaatgaattattacacagcagctatatattttgtactcacaaatgtaaggacttatctggaaaaatagaaaaatagtcattggtgacgggccttagttcaagcccgatagagattaatctatctctatcgggcattatcttagggcccgtcacagatgagtcatccgtgacgggcctaaatgtcatctcaatcgggcattattatggagcccgtcaccgatgagtcatgtgtgacgggccctacggcaaagcccgattgagatgactcatcactcttttgtaactagggtttctcagatcggattgaaaaattttctaagtcctgctatagtttcccgcctccttagaaccctagcgccgccgccaactcctacttcaccgccaccgccaccgagaccgtcaccgccgccaccgagcccgccgccgcctccaccgagcccgtcgcctccaccgaccggcgacgccctccaccgaacctggcgccaccgccaccgagcccgccaccaccgccctcgccaagcctgccgccgtcgccaccgacgctgagcccgcggctgccgccaccgagcctccttggcccttcattcggaccaccgccacctcctcactgacgacccccaccgagcccgcgccgccgccaccgagcctctacaccgactggaccggtgtcggccttcctcgtcgtcgccgcccgcgtcctcaccgacgcacgttgccaaccccccaccgagcccgacgccgcccgcccggcgccgacctacccgaccggcatctccactgaccggcgccgccctccaccgagcccagcgccgacccccaggtgagtcctccattgcgcatgaatgatgaatagatgaatgtggttcgattgatgaatgtgatgaataaatgattagatgaatgtatttgaatagttaaatgtgtatggatatatgaatgtggatgaatagatgattagagatgaatgtggatgaatagatgaatagatgaaatatttaatttatttatatgtgatattcaattcattttacatgtggatgaatagatgattagatgaatgtgtttgaatagatgaatgtttatgcatagatgaatgtggatgaataaatgattatagatgaatgtggatgaatagatgaatagatgaaatgtttaatttatttatatgtgatattcaattcagtttattagatttgtgagatgtgcaatttagtttatttatgtgaataagtgattttagaactttggattctaagccattgaagcactgaattgtgtattttcgttattttgaaaaaaagtagacgatgtctcagcaaggtgaaccaatgtcgacgacaactagtgggtcctcaagggcacgtactcctaggacagggaacaaaatccctaaggaacggttccgcataacagtggtggacgccgtagggttgccgacatctccaaggaaaatattgagccgatttaggtctatctgtggggtcatagggaggcagaaattcagtattctgcaagatgacatcaagctcatgccggccgcagagaaggacattgcttggctaatgttcaaggagagctttgattatcctgtggagcatgaggaccgtctcaggcgggctgctttcaaggttatgggcaatgcttggaagaacttcaagactaagctagtcggcgagttcgtctacaacccggcgaatctagatccaagagagaaatttccttggatcacggaacaggtctgggaggaattacatgcgaagaagtcgacccccgagtccagagctagaagcgaggcatatctcttgctccagaccaggaaccagcatccgcaccggctgggcaccgccggatatgccagtaaggaagaggaatggcaacgtgaggatgaagaagcggaggaatcatgcacaccgctcgtgtttggcgatatcccacaccctcgggctaggaactgggccagggccaggtaccagaagaatgatgatggcacaatcttcatgccaaatgcagaagatcaacgagtgtacgaagctatagtaagtgtctagtcaaactagatgttcgcattgtttcccatcgtgcagtttatttaaccccactaaattgtaatgcagatggagttggttgccgagcaacaagcctcgcaagaggcctgctctcaaagacgtgaggacgacctcctcacgaaagcgttgggcaacaaggaacaccgtggacggacacggggcgttgggtcttctgttccctggaagtatggatttccagactacgcgtggcagtacaagaagcggacttccaacaaggcggagaaagatgcacgccttgaagccaagatctgggcgtcgataagagctgagctgacatctgaattcgatgaaaagctcgagtcgatgagggccaagattaggcaagagatccgagaagagcaatagaacccccaggccgccgttgcttctgcgcacgaagagttaggaagtcccacccaaaaacgcagcagttgcgcatcaactgagttggcggaaaatccaacatcggtcgacagcgccgctgaccatataacggtaaccatgaacttactcaatacatgaaagacttaccgaatccatatgatatataatattctaaaaaaattgattaatctatcgcaggaaccaacgagctgcaccctcatagttagggtgatgccgaccttcacggttccagcagccgagggacttgcgtacaagccgaccccatagacaaaagtgcatggagcgcaactcagggccgactgtgcaaaagttcaagtcgactcggtgaagcccgaatacgagctgttccctctgaagtatctaccaaacgacgaggtcctctcactaggaaatgctcgtggtaccttcatccaatggcccaaggacctcattgagatcagggttacagtgaggctaaccacttgcaccaggctgtcgttcagcaaagagacccgcctctgctccttcagcccctcctgctcaagattgtcatgcacaatcttacgatgtgcagttgcagtacgacacggattttggggaggaccgaacggaggccgacagcaaggcgattcatgaacccccactgatgaagaagagcaggaaggcacactcttccccttagagaattactctcaataaacccgaagcaaaggggagaggaaggggaggaaaggtgcaggcctcgcttctagctccaaggaagctagatctgggcaagggccaggaagagactaagggcaaagaggtcaagaagaaatacgttgctccacaggagttcaaactaggcatgccattggttggagatgacgtgcttgccacaatgggcaccgcttggaaggaccttcacttatactacatggagaaatctaacgccaggaagccgagtaaagctaccgatatccttggagagcacgatggaaagccattccttggtccaacaaattatgtcgtggtcgacttcaaggatcttttcgacctctacaggctccgaacggtggacacaagcctccttaagtgctactccttgtaagtattgtcgcccaactcattctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcctgccgagacaaggagtacattatgtgcgcctataatcaatagtaagtgtgttaactaaatatacacaacaaaatgacacacattccttgagtacttaattaactttcactatattaatgccgcagtgcccattggatccttctggtcataacacctaagtggagtacatgtcactacctgaactccagaattgataagaacgcatataattggaccccaattcaactagcaatagatgaagcgtgggcccaatatgtgcaaagaggagacctcaggaagacaggacatgacaccctcatccacaaaaaagacttcccggtgaagcaacaaataggtgaccagtgcagattccatgtgtgccacaacatgcgccttctgtatagagaaaaggtgaagactttggctgagtttgaggtcggtggtctcaattgtgatagactaaatatattttagtacttatatatgatcgatcaattaatctggaattatgacaatgtagggcataataaccaagtctgcctaccagctttgaggaggttcgcgaggagatagccagcttcatcctgtgcgaaataattaaccccaaaggaatgtttaggcttaaactaaaatgatgaacaatgttgaacttttatgtttaggcaatgatgaacacttattatgcaattgtgatgatgtaactctgatgtttatatttatgtatatatttcatatgtttatgttaaaacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtgtgtgtatgtgaatgcatatatatatgaatgggtgatgctggggagctggggatattggatatctgtgtttgtttctgttatttttgcagcgggcatggctagcaaaggcctgaggctagccaaaaaacaaatttttttgtgaattatagccatctgtgacgggccataactaaatgcccgattgagatgaggtgtcacgcccagaaattcccgaatagaattccaagcagaatgtgcattaaaacccccgtccaggaccggtcggggtacacaaacgacaaatttgacatacagatccacgtcttacaaacattataaaagtattacataaatgcagcggaaaataaaaagataactggagctaagccttgacttgcaccgcagcgggaacaccactccacaagtatcctcgacggcacggacgaagcctactcctcggagaagccaccatctgacgcatactcaaactctggggtttggggaaaatatagcaagactgagtactacccactgtactcagcaagtcataccggaataggggtatgatgcagggaattatcaagggatagctataatggttcctttgcataaagcgagcatttataaatagtagttgaaagtagtaaaaccgttgtaataattaatcaatattaatcatccactgtccaatgctataccacgttgcaacaggcccaaccatccacctatactattcaattccattagactagtctagggtgaatctaatcacggtgaatctggttgaccgcccataaccgcgggcacggctattcgaatagttttactctaatcaaaggtgtacaactgtacccacaagacacagccccacgacatgtttccatgtgccgacatgccaccacgacataccggaaagaggccgtgacaggacccttcgcataaccccctctagccaagcacaccacacctcaagtttcacccccgtccccagcgggcaacgggcagtcccctctcgtgcctaggtgaatccaaaagcgacagaggccgtcgcagggcccgccccgctccatcacgcccacccttgcctggatgtgtcagctagaggaaagctacactacaagcctagccattgcccacgctggcttgtggtaagtacgaggaattcttccagggtttcccacgaaccagtccttaagtgccatgggcgcgactagcaaaaccatgcacccacagcccaccataggattcattttaattagcaacaccaggacggtggtactaatccaacatcaacactagaacctgaagtctatatattatatgatttcccccattgtgtgctagttgaactaagcatggctaagcaatccctagtccaatatctagtcatgtcatatcccaagctaacaaaggagcatggtacaaaaatagcatggctataacagtaggtaaacatcccatagtattattgtaaaacaatgcaatatttgaacaaaaacagtaaaacatttgcaatataggatcaacatgttcaagtgacaagcatgacttgccttgctctgctgctggaggaacctcggcgactatttcaaagtacaccggagcgttgggagagccggaatctaagcgacatacaaagcaaacaatacaaacaggctataagactactgaaacagagaacaaaaccatttttaatggaatctatgcatttttattgatttactgagacttgaatgggcttaaacggagctcggatgaattagatatgaattttggaatattcactgtgtttttactataaacagaaaaatccttaattgatttattgcgcaataattaaaatcctggggagagagagagcggcgccaacatgcgggccccacaagagagagagtggtgcacacgtggcgccgacgcggcgcacacgcggcggccacgcggcagccatgcggcagccgaaccgacggcctcgatctactgcccggtagatcggacggcggatgcggctcgcggccggcgcgcgcgggcacggctcaagccggcccggcggccatggcgcgcggcagcgcggcgcgcacgcagcggcgacgcgaggtggcgaccggcggcgatagcggcggctaagcagctaggcggcggcgcggtggctaagcggcgcgggagagagggagaaaggggaggagaggcctcaccgacgacgatcgacgacggcgagcgacggagggcgatggcgacggtgagacgagcttcggaacctcctaacgaacaaaag

SEQ ID NO: 5320 - DNA, 10204 bp, Oryza sativa
ggtttatatatatataaaccatgcatatatatgtttcaatacatatatacatgattaatatatatgtatttatatatatatatgttatgcaaatgcatatgtgtgtatatatacatacacaacacacacacacacacacacacatatatatatatatatatatatatatatatataaccaaaatatatatttacattaaagaaaatgtgtacacatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcctaagtctttctctcatttttccgcggaccaaatgatggaaccgataccaagccctacatggagtttaaagctatgattcgtagtagcaattaattataacaagattcttaattaacataggaatttatgacagtacctgtttataagttcgaaaaccttgtcaaacgtagactcttttttatccattgagtcatatacgttgacggtgcaggcctccaggtcgaagagtaaaagcacccagtggaatctgcaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgatcatctctctaccggtggcgctcatctccatgtacagttgatggaacttgtacatttgagtgggtaggaactgcagctgctcaggcttgataagcggtttatcgagttcgtacatgtatttcactttcgccttttcgattggtgcacctcatatcaattgatccgtagttagcccggtgtcatcaataaattcttgtattccaaaatcttcaccggtcaccaacggctcgatctcctggcttgcttgctctccaagctgagggactggtttggactttccagaagatgctttctcgagtgttcgctcatagtccgatagctttatggccttcttggcaggtgcagacatacccctgaagaagttcttaacactcgagtctataggaatcttcttttctggacttcgaggcttcaattgtctcctgacttctgatgccacataagcgtcaagctcctcttgcgtgcaatcgtaccctagatccttgttcttggcggtgtgaactttcgccttcttcgttgcccttgtgggggcaggcggtggagcttggggggcccttgacttggaaggtgctgaacgaggagcctgcggaggagtcggtgtaggagcctgaggaggagtcggtgcaggagcctgaggaggagttggtgcaggagcctgaggtggagacggtgctggagcatgaggagacggtgcaggagcctgaggaggagatggcggagccggaggagatggtgcacgagacgccgcttgtcgccctgggaggatgatgtatcgcttgcgccatagtataatggcgtggcttgtgtctcgtagatgcgtctcaccgtctcctccagggtaatccaactcgaggtcctcgtacgcgccttcgaccaactcaacttcgaccttggagtatcctgctggaatcgtcctacagtggtaagtacctaaagggtccgttgtgatggccatgcccgacgccaccttcacgtggtgagaggttatttattagtaatcaacgtatataagcagcaacttgtcgaatggacaaatctaaaatctataaactacgagcttacctttattgataagtttttgaagggaatatgcagctcagatggtgtccgctgagtgatgtcatcaacggggcaggtggttttgtcctgggtttgcatggcgtccatgctctgtgatcctccctgccccgttgaggcgcagttgctacgatttcctgaagggctcacaattgcaggaggaatggttggctggggatcattggaccaatgtgcggccatgcgttcatcaaccttccttgccacctcctcttgcatgctgagctcgtagctcgataccctgaactcaagatctgcaatcttcgcctcggtatctctcttgctcctcatccgactcctgtacgtgtggatgtcctccttgaacccaatcttccaaggaatcacccctttccctcgtgttcatcctggatgctctggagtctgcagggcgagtgacagctcgtccttctctctgtcgggtcggaacgtaccctgagaagaggcttccactgcgtccgttagtcgacgcgtagcctcgcgtatctgatcgctgaagaccagggagccatcaactgggttgagcgttccaaagtgagcatagtaccagaacttcgatcgttccggttaattagcggtggccggttcgatacccctctcaagtaagctagcctccatctcctcccacttcggcatcgcgacgctatagcctcctgaccccaagtggtgatggtacttcttcttggcggcattttctttgtttctttccatcatcgcctgcccttgttcacatgtcttatgtgcaacgaactcgtcccagtgatcccttagctttgggaatgtgtcgaagttcggtgtctgccccttcaggatatatttctggtacagatctcccttgaagctctgaaactgttctgccattttatttagagtccaccttttcactttgtcctctgtacctgtgggaagggtgaatgtctcgagcattgtggtccacaacatctctttctccgaatatgggacaaagctctcatgatctccgtgtgcccttgttctgcgccagtacaccgtactgacaggcacgttatcccacacaacccaaccgctgtgacgtatgtagttcttggtggcttccgcctaggcactaggtcggccgtcttcgtccacttccgttatgatgtgccaaccctcaagcttcttcgcggcacctcgttgcccgcgtgccctcttctgtccagcggagggttgacttccactagcctcctcctcctggttcccctccacatccctctatacgtgcccctcctggttcccctccgcatccctctccacattcccttcctggttcaagtactggtttggatcctcgttcccctcttcttcgttcaagtactggctgcttccctccgcaattgtatcttacaatatatgttcctcatcgcgatcagctatctgttcatacaagaaatagttcctaagtcatgagacatttttgctttaacaatcttatatgctaacaatcatatatgctaagtctaaacacaaatctaataatcttatattaaaactataataatcgtatacgaaaactcaaataatattgtattaaaactgtaatagtcaactatgctaagtctaagtgacgtatattaggaccctagctagtcaataattatatactaagtctaattacaaatctaataatcttatattaaaactcaaaaaatattatattaaaactctaattataatgctaagtctaagtgtcgtatattaaatctaatagtcttaattgcgttaaaaatctaacaatcatatatttacatcacttgcctgcgcgaattccttcgagggctagcaaccactccggcttgagggacgacgacgacaacgtcttttctgcaacatacaaaaagatgtattaggagaaacgcgaagtaacatatattgtatttctcgttcgcgttctcattaagttcacgtttcgttcacgatcgttcacgttcgcgttctcgttaagttcacgtttcattcacctacgttcgttcgttcacgtgcgtccacgttaacgtacgttaagtaaagttcgttcacgcacgttcgttcgtttacgtatgttcaaatacaacattaagttcacgttcgttcacgttcacgttcgttcacgttcacgttcattaacgttcgttcgttcacgttcgttcacgttcacgttcgttaacgttcattcacgtttgttcgttcgttcacgttctcgttcacgtacgtttcgttcgttcacgttctcgttcacgttcgttcattcgttcacgttcacgttcgttcgttcgttcacgttcacgttctcgttcacgttcgttcgttcacggggcggcagcggagcagcggcggggcagcgcggccgcggctttgggtgcggcggcggcggggcggcgcggcggtgccgtgccgcggcggcgtcgtggcgtcccggcgtgtcgtgtcgccgcggtattgtggcgcggcttcgtcggcactgccagggcgacgttgtcgccggtgccggccgcatcgaggtcggggtcggaggcggcagcggaggcggcgatgacgacacgcgcaagacggcgtcgagatacgacggcggcgtcggtgcggggatgccctaggcagtggctgcgaaggagaagccgagagagatcgatcggggcaaaaatttctaagtgttggtagagaagacgagggcgcacatcgggaatatatatacctctagatctttagtcccagttaatgagaacaaccgggagtaaagatatctttaccggttgttctcatcaaccgggactaaatatattttcccgctatttccaaattctttttaaacccggttagggttaagaaccgggactactgataagcgcactgaatattaatttccattacatatgtgtttctaaaatagaaaataatgcattaaaattatttaaagtcgaaaaattaatgacaattacttcgaaaaattattgttgtctgtagtaaattaagtggataaaacgtaataagcaaatatatgatttaaattaataaaaattctaataatcatatatatacttagcgtatgaatgatattaaattgttaacaattgtaattaacatatgtatatacatacgacatgcatgatttaaaattaataaaaattctaataatcttatataattagcatatgaatgatattaaattaattgttaaaaactctaattaacatatgtaaatacatatgacatgcatgatttaaaattaataaaaattcgaataatcatatataattagcatatgaatgatattaaattaatttttaaactctaattaacatatgtaaatgccacaagcatgatttaaaacttttaaaaatcctaattatcgcgtataactagcatatgcagggtttaaaattgttaaaaactctaattagcatatgtaaatgccacatgcatgacttaaaacttttaaaaattctaattatcgcacataactagcatatacatgatttaaaattgttaaaatctctaagtaaaattgttaaaaactctaagtatcatatgtaaatgccacatgcatgatttaaaacttttaaaaattctaattatcgcatataactagcaattacatgatttaaaattgctaaaacctataataaacgtacgtaattaacatatgccatacaacaactgatttatatggataatcaatacatccaaaatagtttacatcgtgtacacaatagttacgacaatacatcagcggtgacggttgaccgcacgtactttctcctcactattgttccctccttgtgatcgctacgtgagtaaggggtgtcttcatttgataggaggatgctagggtcaatcgttaccatgaaagggggttccccatcaaactgatcgtaatcctcgtcagtcttgtcctcaactccgacgatttttcttttgcctgagagaaccacatgacgcttcggctcgtcaggccctctgcccttctttcctttgctagacatttccttcacgtaaaagacttgcgttacattattggcaaggacaaaaggttcgtccgagtatccaaccttgttaaggtcaaccgttgtcatcccactatcatcaatcattacgcctccaccagtcaacctaacccattggcaccggaacagagggaccttgagaggaccatagtcaagttcccatatgtcctcgatggcaccgtaatacgtgccagttgttccatcgtgtcccattgcatcgatacgaacaacgctgttttggttcgtgctcttcatgtcttgggctctcgtatagaatgtgtacccattgatctcatatccctggaatgtcgcgatcgacccagatggtcccctcaccaggaaggccagttgttggttgatcgtctcgttacccatgagatgttgtcatagccacgcggggaaagtatcaatgtgatgccgtgtaatccatgcatcggacttaccgatgtttctggcgtgaactagagccaagtgctccttgatgtaaggagctaccaatgaagattgttgcagaaacgtgaaatgggctttacggaataaattgttgtctatcgtcattattgctttccttccgagagttccctttccccgtagtctcccttcatggcgtgattcaggtaccccgattgggcgaaggtcttcaataaattctacgcgaaattcgatgacctcctctgttccataccccttggcgatgcttgcctctggacgagcatggttacgaacatacttcttcagaacgcccatgtacctctcgaaaggaaacatgttgtgtaggtacacaggcccgagaatactgatctctttgacaaggtgacaaagcagatgcgtcattatattgaaaaatgaaggtggaaatatcaactcaaaactccacatcattcagaagggcttctaatctatccggatcggtgaccttctgcgaaattgcgttcatgaatgcacatagctttgttattgttgcccggacattgtctggaaggataccccttattacaactggtagcagttgtgtcatcaacacgtgacagtcataagactttaggtttgtgaacttcttctccttcgtgcttattattcgattgatattcgtggagtatccagacggtacatttatgctctccaagcattcaaacatactttccttctctgccttgctaagagtgtagctggctggactcaagtaatggcttcctttctcctttggttccgggtgaaggtcgccgcgttgttccatacgcttcagatcattacgtgcttccagtgtatcttttgactttccatatacacctaggaagccaagaaggtttacgcaaaggttcttagtgaggtgcatcacatcgattgcgtggcggacgtccaagaattccctatagggtaactcccaaaatatagagttctttttccacatcgccgcgtgaccatcttcgctctctataggctggcttccaggccccctttccgaacactactttaagatctttaaccacagcaaacactgttttcccgctgcgatgtttaggcttcgtacggtggtccgccttatgttcaatgtgcttgcctctcttccgtaccgggtggtttgctgcaaggaatcgacgatgaccatgtacacaaccttcctacagtgcttaagatacgtactttctgtttcatccatacagtgagtgcaagccttgtcccccttgttggactgtccggatgggttgctaagtgcaggccaatcgttgatggttacgaacagtagcactcgtaggttaaactcctcctgtttgtcctcgtcctacacggggacaccttccttcttccacaacagtttaagatcttcgaccagcggtcttaggtacacatcgatgtcgttactaggttgcttggggccttgaataataatcggcatcattatgtacttcctcttcatgcatagccaagggaggaggttgtagatacacatcgtaatgggccaagtgctatggccgctgctcatctctctaaaaggattcatgccattcgtactcaaaccaaaccgtatgtttcgtgcgtcctttccaaagtctttaaattttctgtcgatgtttcgccactgcgaaccatcggcgaggtgtctcagcatcccgtcctgttgacgctcttcagtgtgccatcgcatcattctagcattccccttgttcctgaacaaatgccttagacgtggtattatagggaaataccacatcaccttagcaggaattctcttctttgttagctgcccatcaacttctcctggattgtctcgtctaatcatgtatcatagtgctttgcaaacagggcatgcttctaggttctcgtacttcttaccgcgatataggatacaatcattcggacatgcgtgaatcttctgaacttccagtcctagagggcagactatcttcttagcctcgtacattgtctcgggcaatttgtttccctccgaaagaatgttcttgacgagtttcaataaattgccaaatgccttgtcactaacaccattttttgccttccattgcaagaactccagagtggtatccaactttttgtgcccctgctcgcaacctgggtacaacgacgttctgtggtcctctaacatcttgtccaatttatgggcccccttttctctttcgcagtcctccttggcgtcctgcaacatctgaccaagatcatccgcaacgtcgttaccatcagcatccctttcctcctcgcccgtttgatttccttcaaatccaacgtactgagcaaagtccagaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccttatgcctgttagcttcggccactctcaaaaaatcatgcacgccatcaataaactctttggaccgccgatcagcgtacatccattgccgatccatctacatgacatgaaaaaaaatcatacacaaataattattcttacaataatgacagtcatacaataattataaaataattacaaactctttcaacagtcatacaataatgacatatcattattcatacaaaaatcataaaatattacaccaaataattcttatttactatttctaaagtttacaactaatattaatgtgttttacttcttttaattttcattttagtttgttttctattatttaagattaactatcactatattttccttctcaactattttataaaaccttctttagcaaataaactaaatttctatatattctttcttccccacacaaattttctctctcatcaacttacaactaaattttggagacaaaaaagtgtgcaaaacatagctccaaatgtaatatgacaaaaaaaacattggaggatgaagttgctaaccttttaggcacctctgatttctatataatcaccaaaataaatttactagaaattttggcatgacctcccctcttttttgaagaaaaattgaagcttgctcgggcagttggaggaggaagaagacatatatatataggggtaggact

SEQ ID NO: 5321 - DNA, 665 bp, Oryza sativa
gtcgcatttgtctgcggcacgcggatgtcacgccggtgccgtcgcacgaagcggccgcatatgatgtcacagtcgccgaaaaacctcgccgccgtcgccgggccgacggaggaggaagacaggatcagcgggatgcagacggcaacgacgatggctgcgttaggagaggctgcacggcaagaagccatgtaaaatggtgtgttggtgattcacaagcaaagatggagatagctcgagatctttgatgcttaattgatgagcaattgagcaggtgtggtgtgcccatgcaatggagccactggtggagaaagcgtttgtagtaccggttcgtaacccccctttagtcccggtttctaaaccgggactaccaatacgggactaaagatcgctatctttagtcccaggtgaaataaccgggactaaagatcgatctttagatcgagctgaccttttttttttgcatggccctgttgctgcatggtttatatatatataaaccatgcatatatatgtttcaatacatatatacatgattaatatatatgtatttatatatatatatgttatgcaaatgcatatgtgtgtatatatacatacacaacacacacacacacacacacacatatatatatatatatatatatatatatatatatatatatata

SEQ ID NO: 5322 - DNA, 489 bp, Oryza sativa
gacttatgcctcattaagtagacataaccatatctactaaagtcatcggtaaaggtaataaagtacccaaaaccacatctggcagttgagctcattggtccacatacatcagtatgtactagtaccaatagttcacttgtcctttactttgaccccggaaaggtgcctttgtcattttgccaagtaaacaagattcacatgtctcaaatgattcaaaatctaacgagtgtagaagtccatctctatgaagcttctccatgcgtttctcatttatatgacccaagcgacaatgccatataaaagtgggattcaaatcattaggaccttgcctttttgcattaatgttatagattgaacatccatcaagattcacaatatataagccactcatcatgggtgcatggaaatagaaaatgtcattataatagactgaacaaccattgtccacagatctaaaaccataaccctctgcttgcagacaagaagcag

SEQ ID NO: 5323 - DNA, 1550 bp, Oryza sativa
  unsure (1)..(1550): unsure at all n locations
nnnnnnnnnnnnnnnnnnnnnnnnnnnnnnnnnnnnnnnnnnnnnnnnnnnnnnnnnnnnnnnnnnnnnnnnnntgatccggtaacaaatacccaagaatcagaattttaagtattttttattaattcctataacattaatacctgaggtggaactctttccaccctgctgcttctgcttgagctgctctaggtatttcttgcagtttctcttccaatgacctgtcttcttgcaaaagaagcactctgcatccttagcgggccctgtcttttgaaccttggtcttagagttgctagtactcgtgatcccatcatagtttagctttcttttttgaccacttttcttgttgttgggcttgcgcttatgcataaccatcacatggttggagtttttcttaatgctttcctcggcagtcttttgcatttcatgcaattctgccaaggtcttgttcaggttgttcatgttgaaattcattatgaacggctcaaagctgggagggagcgactggagaatcaaatcagtagccaattctcggctaaggggaaagccaagcttatccagactcttggtgtaaccaatcattttgatcacatgtgggctcactagattaccttctgcaagcttgcacgcaaacaaggactttgaggtattaaacctctcagctcttgcttggtcctcaaacatgttacgtagtcccgtgattatcgtatgaacatccaatgccttatattgcctttgaagctcaggggacatagtagcaagcatgagacagattatatcaagataatcattgcatcgttttcatgttccctacgttgagcagcaggagcattgttgggcaagttagctggaaaaggctctgtaagcacaaactcttgtgctcttgcctgagaacaattctcaggttgcgataccaatccatgaagtttgttccagtcaacttctctttctcaagaatagaccgcaagttaaaactggatggtgcaggctgccatgatctacaatagaaatatatgtatacaaaatcagcagcatgtttacatttaacctttcattaaacaatttaacaaaagatactcccactatgtattgtgaaacaaaattccctctagtaacatagtgagtcaagatcctcattttattagtgtctagggagttttggcatcacaattagacaactatcaaagtaggtaagcaacaccttgctaatcacatcatatgtgactcttgtgctgttggggtgacatctccatatccaacccaacctatgtcccaaggttcaaaaccgttttgataaccttgtcaagtaaaccaataatctccgcatacagatgtccgagatctatcctattttatcatgataaaaagtgacactttgctatggcaaacccatcacttatgatcacaaccgtaataggtgcaattattggaagagcataaattacacttaatttttctgagggaatccatcctactatgtcatatcaaatatataacagcaataaagtaagatagatataaaaccccaagcgaaatctgaggggcaacgc

SEQ ID NO: 5324 - DNA, 1291 bp, Oryza sativa
  unsure (1)..(1291): unsure at all n locations
tcaccttgttaaattcagtgtcctatacttcaaaaaaaggtatcttgttgctgcctttagcatatccttatgcacattctagttcttgaaaatgtcacaaatatacataacttatgatttttttttcaaaagggaaaatgtcaatatcaacatttgctttaggcttgtacgatgctattgtctttatgatcatcacgattcctcgtgtttttaggaaaaataaacacaataaaatgatctagatttacctacaaaatatcagcatacgtatagaaaaataaatgtaaaactggatcatggcatcttgcagttacagaacaaattgggcaatttatcaaacttgggaagccacacataagagagcagatttatatgctttttagtgcatgtacaattcatacaacagaagttaaacaccattatatttgccaatatattcttgagaagttaaatacatttcctttctatggaatcccaacttcgcctaagcatctgtagctagaagtgctcatctcgtccctttcctatgtggtcttcctcaaaaagactcaccagagatggttgcagcggtgattaactttctgaacttatgtcatatcttacaaagattcctctccaacaagctcatttttgccacataattcctcatatttgagctccctttggtgcatctgcttgttgccctcctccaaacctatggctagaggtgccaccatcccaagtaggttgcctcctcttgcatgcacagatgaaaaaaaaaggtctattaagaactcgttgaaatgctgaaataatccaaagagcaatacatatatagaaatccatattttaattacattgatagcacacattgtgccactggttaaagaacacagaaagtgagaatatctgaatctgtgatgttgaacctgatcatcacctaattctctgatatttatactaccaattagattccccttgactgaccagtaggatgagacagccttcctgatccaaagcacaccaatatatcgtcatcagtataatccttcagaataaagctcatagaccacaacaagttcaaaaacactacacttgaatgcaactttaggtttatacagacgttagtgatgcagtactttgcagagtcaactgaatgcaatcaaaagaggaagttacaacttgtaaatataaaggggtggctgttgatgcgaaaaaacacacactggcctgggagatctgcttaannnnnnnnnnnnnnnnnnnnnnnnnnnnnnnnnnnnnnnnnnnnnnnnnnnnnnnnnnnnnnnnn

SEQ ID NO: 5325 - DNA, 10131 bp, Oryza sativa
  unsure (1)..(10131): unsure at all n locations
annnnnnnnnnnnnnnnnnnnnnnnnnnnnnnnnnnnnnnnnnnnnnnnnnnnnnnnnnatcgccccaagttctcatctcagattttcgctaagtgctcctcaaagtatgggccaacttctgccatatgttggagcacagcgtaatgagcctacgcgtacgatgcttgatcaggcctgattcttttccttccaattgtgccaacacgtgacaaccttccctcgtgacgagacgcaggaactccgataggatcagcatcggacatgtaattgacacagaactcaatagcctcctcggttatgtaaccttcaatgatgctcccctcgggtttagctctgttacaaacgtacgacttcagaactcccatgtacctttcaaacggccacatttcccttagaaaagccgggtcacatagttttgtttgcttcaccatatcaacagggagatgaaccattatatcaaagaaagacagtgggaaaaacatctccaggtgacagagcgtattcacaatatcggtctgcagcccatctagatcttctggatctataaccttctgtccaattgcattgaagaaggcgcacagacgttggatcgtgtgacgcactttcggtgctagaatgcctctgatagcaactggcaagatttgtgtgattagcacatggcaatcgtgagacttcattccaacaagttttagatcgtccaatttaacatacttacttatcctcgctgaatagcccgatggaactttaatatccttcaagcatgataacattgcgatcttctcatccttcaacagtgtgtggcaggctggaaggaggtacactttacctgtctctgcatctcgtatgggctggagttcactgcgaatattcatgtcctgtagatcaaggcgcgcgttcaacccatcctttgtcttcccgggaatattcaacatcaggccaaccaaactctcacacacattcttttctacatgcatgagatcaatgcaatgatggatatcaagatctttccagtaaggtagccgccaaaatatggattttttcttccacatacccttctcctttgtcttgctacgttttcttttcttaccaaactcattgcttatgtccttgaccatattgtggacctcatctccggacaaatctttaggagcaggctgaagttctctcttaccattaaaaattttattctttcttctaaatgcgtgacgtagcgggagccacctccggtgacccatgtataccatctttcgtgatttcttcagccaccggctttgtgtatattccttgcaatcggagcatgccttctttccttttatagtttgtccggaaagattaccgagtgcagggtagtcattaattgtgcagaacaatagaactcttagcttgaagttctcctgaccatatgcatcccaagtttccacaccttctttccaaagaatctccagatcgtcgataacaggctccaggaatacatcgataccattgccgagttgccttggaccttggattaacaagcacaacataatatatttccgtttaaagcataaccatggcgggaggttatagttcgcaataagaactggccaagtgctgtgagtactactcatgtcaccaaaaggattcataccatccgtacatagacatatcctcatgtttctagggtcggcatcaaagtctttgtgttttcgatcgatattcctccattcaatcgaatccgctgggtgtctaagcataccgtcattccttctctccgtggcgtgccaacgtactaacttcgcttcgttcgggttggcaaagattctcttgaaacgatcaatgataggtagataccacacaacctttgctggaccacccctctttgacttatttctttcgtcagcacttttctttcgcttgtatcgagaagccttgcagacaggacaagcatccaagtccgtatattccttgtggtacaatatgcagttgttgggacaagcgtgaattctacggacctctaaccctagtggacacagaacctgctttgcttcgtatgtcgtctcgggcaatgtgttctcaataggaagcatagccttcaaaattcctaaaagttctgtgaaactcttgtctgtccatccgctacttgccttcagcttcattaggtccaaggtaactgacaacttagtgtgttttgctttgcatccagcatacagagacgtctcggaatcacttaccaacctgctgaacttcattccatctctctcattctgggctgggtcctcaacgtcacgtaacatgtcttgcagcagatcgtgatccacatcaaccatttcaccgcccaatggagaaggtataaacatgtcatgctcatcttcatcttcctgattatgcgcaccacttctgtctgctgctactccacttcctgattcttgctctccatgcttcacccaacatgtatagctctccatgaatcctcgttgtatcagatgaccatgtacgtcctctccgctatcaaacatattctcattcttgcaatctgcacatgaacaacacatgtaatcactgtttcttctgatccgatcctccttcgcggcgttcataaaatttattacgccctttctgtactccgtagaatgacgtttcaaatttttcgcatacatccaacttcaatcaattgctacaaaataaaaaaaacaaattagaggcacatattataagatcagtattgcaaaagtaagacgtgatgaaattgctcaattaatgattaatattactcacttgattgatctatttttatcacttttgggaatttaatttcggttttccttgggaaaaggacaaaaaatcaccccctacagcctcccaccaaaatagtgaacagtgggatacaattacactaggtagtggggggtatttatactgtgcaacaaatatctgtaatggccctaaaacaatcaaccgtgacgggcatacaagtaatctctatcgagtcttaataaaaggcctaaaaaaagagtgtcatctgtgacgggcaccaaacttatctcaatcgggcctcaactatagcccgtcatagataagtgtcatccgtgacgggctttagttttatgcctatataccatgactgtgcgaccatatctcaatcgggcgaaacttcggcccaattaagattacttccttgtgacggcccgcaaattccagtcttgttatgggccgtcacagatggaaggatctgtactagtgtatatgtccgtcctcctccattatggtttttgccttttctcctacactgcttcttctccagatccggttatgaggaagtggttggtccatgatggcaacggtgcatacagtaacgacagatcatatagagatgatgaaacgcagccagtactttttctcccgtttattttattcacatatgatggttgataaattcttattttatttcaaggattgtcgatatctaggatagttcacaacttctaaaccattagagcaatggcggagccaaggcccggccagcctgggccattgcccaggctccgcctcatgaacatacactgttaatacactgttagttctaataaagggaagattaaccacgcaaattatgaaattagtaattgaggttcaaatcattatttgtagtttgcattagtttctctccaaaataataactatgtagtgtcaaattgtttacatcaatgagaaatggtttgtacagagttatacggatttgtgcgcttttatcatctatcatttgacttgcctaggctcataaaattttctgaatccgccgctgcattagagggcattgaatctataccagctcttcaatcgaatcccacaatgtttgctaaacaactataatgttcaataaataatatgacaccggtttttattagataatatgatattcgaccattcatttcattaaaaatgttatataagtgccatttatttttattgtgacttttaacatgatatttgatgcataatgatgaattgttggagaccgataaagcactaccagtttgagaaccatcggtaatagtacctgcattgtagatttagagggatactagtggagagagaaggggacggctgataagcgatcagccacgtggggaggcgcgcacggggccagccgcccccttcctctaatctctctgtatctaatctactacttctatacgtatgtatatactatatatgtatataatatatatagtatatacatgcgtgtatatatataagtatatttttaatatataaaaaatatatacacatatacaaagtttgtatagatatgatgtatataaagtttatatacgatgtatacaaagtttatataggacatagacaaactttgtatacgataaatacaaactttatatacatacgtattaaaaaataaaaaaactagaaaatacacaacatatacaaagtttgtatacgcgtatacaaatatgacatatgtgtatacaaacttggtatacatacgaatataaactttgtattcataaaccttaaaaaaaccgggaaaaaacagaagagaaaccagaaaaaaaaaaggaaaaccaaccgaaccggaaaaaaaaaaggaaaaccaaccgaacggaaacggaaaaaagggggggaaaaaggaaaactcgctctccctccttacccgcgcggcgcgtccgccgccccctttccacgcgcgacacatgtccagtcacgcggggaggggggcacgcgactgatcgtcaactagctttctcgagagataagggcatgatgctagccctatacattatggttatatttttagcaggcctcagcctgagaccaagtactagtactcgtccttggtttcaatggtacgagagtgtctttggaccctcatgtcagataaatcgtgcttacaggttgcaagctacacctctctattatttcctctattttaatatgggtgagtcctatgattatttctataggtgttttataccctgtaacaaattttcctaattgttatgattgatgtgtgtcccacctctctagtatcgcatatgaactatacgctatggatgcatttactagtcctatgcaagcagtgactatactaaatgtcagtaacaattccaaaacaactatagtttttttttcccaactacgtaagcgatatcacctagtgaaggctgtgtagatttagtcaatgaacgcatgcatttaccagatctagtagtatcgactatagatccggtccttgtttatgttatctgattgattcctagcttaattgcttgcagacgcactactaaaacaagcgtgtttattggatctagctagctagtacctgtatagttgtgttgatagtgatattcttggtaagagtgcttctcgtgcattggcatgttgaaaagttataggtgaaatggatatctgagacacagctataagtatactgatcaggatgggcaagtaccccagatcctgcattttgtacttacccttctaaaatttattcctttttccccgcaaacaaaaaaaaattattccttccactttacttttgtactcaccggacataaggatataaagttccataaattttttaaggccataagaagactgaatactgaggtggataagagaggagaggagtgagagaagaagcggatggcacgattacagccggcttaggcacaagaccaaaaaaatatgtgagagagacatattgaccatatattaatagttaagagctaaccagttagctaagaggtagactgtaaagatctatatagtaaacagctggttatattattagccttgcactaaggttctaaggttctaagcacaaactccaaagtgtctatgcttaaatgatgttgtggaggagagaagacaagaaagagagaagcagccacccctcgtataaggggaaccctccacacaaactacaagaacaaaagaaaatgagaggggctgattggtggcaagtgtattgagactagtgtataagttagttttattttttggatagatgacgtggataaaattggaggtgtgaccaccacctctattataaaacttgccctaagagttagagggtgtgaccagaaaagattgacgtggcaccaataagaattctctcgacactgtggtggaactaatcatcattaattaaacatcctaggtaatgtgctaatcagccattacttgtttcaatcacggccataatactccctcgaacatatttcttttattactaagatcaaataagaattaactagaaccaagagataattaatattaaaatggctcattggatatcagtcgacaattaatttagtatgtagagactataaatatgatcatttgtttttaaaataacaaaaaaatgaaaatacttcacatttttaaatggagggagtaattaacaagttccacgtacgtcctagactcatccaaaagtcagaccatcgtatgccaaatataggcttatgtattggcttaaataaatcagaagatctagctagcttaaattacatgggaaaccggacacaattaatttatagctgctgagattaaattacatgagaaaattttcctcccaaagccaacctcatttactagcattcatggctggtgcatgttactcacacatgtaatttagtgatagggctaattaggctaagctatagatagctcctttttgcaattgcatcctgtgtataaattttcgtaccactgcggcttaccttgtcaattactaacacatagtcatcgatctcgtcttcttctctctctagctacctagctatcttcctcaagctttgcaagcttgacacgcagaagcatatggctcccggcgctgcttcccctaaggcggccaccgtcgccgccgccgccgccgtcttcgccgcgctggtcgtcctgtcctcctccctcgtcgcgccggcggcggcgaagatgttctgcagcaactgcgacgacatctgcaacgcctcgtgcgtcaactccgacaccatcgccaagctgtgcgccccgcagtgcgacggctgctcgccggaggcttgccagagctgcctccaggcgctgaagcaggagtgcttgacgggctgcagcgactactgccacaaaaactgcacttaacaacgtatggagtaacgagaccctgcgtgccagcagccttgtgtattgctacaggttgtaatgttaggattctgtttaataaaaatgaaagtgtttttttttaatttttcagaaacttattgagatttgaggaaatgtaataggaggtagcataagtttgcaatatctttgaacttcggcgctagtgctacctttactggaacagtgaggaactcaaataaaggagtaaatatagtgcaaccggttttccattcctataataacaaggaatggacgtgtagacggagttataaaaccaagaattaattacatgcatgtgtatttaatcacatcgttccaataaaaccggacagtgatccactacatgtcaatgatatgcacacccctaatgttgcacttgaagcattggctcaattcgtcgagacggcttcatttctttctttggttcgtactccgtaaaatctattagggcagtcccaaccctccacctaggatggtgtctatggcattaaatacattgctatgtaggatttttagcttatgtggcactatattaattaagagagagaagagaggaagaaactgggtctcatgcaagacacagcttcaacacgagaagctatgcactagacactgtcaagttttgcattgggagataatagtgtcttcataatagatgaaaaataaatatgattggtagagaagagcgatgatgtatttattaatggcccactttaagaaactatgggttgtagagtgtagtttatattatgatgtcttattgacatggtaccatagacactacttatggacactatgggttgggagactgaccttagggtctgtttggtacagctccaactcctaaatttagctctaagagttgggtctggagtggagttgtggagctgcctaaacccagctccacaactctagttcattttgtgagagagctccacccagctccactcccaattttggtggagctgaaactgtttggttgagctccaacttcagaaggggtggagctgaagctggagctgtgccaaacatacccttagtgttggttcttaaatgtaccagcactgatggccctccctcataaatgcccaaagtttttttttaatttcaatttagggaacctgcactgatgtggcttcccatgtagcactaaaggcatttttgggagcaccgtaggaaaagtccccatagtaaaagttatattaataaaccaaaaataatatctacaacagggttaactaatctaaaagaatttgtctatcatctaatgagaggcgaaaaagaagaaggtaaaggtcttttttaaagaaagacctccaagaactgatctaaaggcttcttctatctttagttactgatgtgtgattaatgattgggtacttctatctgtaatggatcacgcataatggtgaactgttatagggtaattaatgaatcattaacgtttaagaaccataagttcctgctccctctgcatccgaaaaataatactatatttaccttttgatatatattcatatatgtgtcacaaggagtatctttttagatgcagggtccatattaggcctcttaacatcacttcatgtttttttcagattttagccatccaaccaataaatagtactcccttctcctccttattttttctctgtatttattaatggaggatatgatagtctgttgacatatttcttgatatgcctttgattttctaaaacaacagcttttttgggatgagggatcgagtagcctaaacaagccgtgaccaaattaatgtcactagatctggtaattggatgcgtgcattgactagatctggtccttgtttatcttatctaattgattcccaattaaattgcatacaaacgaactaaattaacaagtgtgtttattggatccaactacactggtggagaaatcgtttttagtcccggttcgtaaccctcctatagtcccggtttttaaaccgggactatgaatccgggactaaagatccctatctttagtccccgttcaaatacctaggactaccaaccgggactaaagatgggagtgggcaatagtttttttttcatttatttactatttaatctctaatttattttctcccaaattaggtgggatgcatattcctaaatcaaaccctaaaatcaaagtaccatcccaaatacacaaatcaatcaatcatatacactacagattatacaccccaaatcaaagaatcatcccaaatacacaaatcatgtacatctcagatctatataatgagattccaaaaaagaaattatacatctcaatccatacaatgaattacagattcttcatctcaatctatacatggatcacaaattctttgaaaaaaaaagaaaaaaaaaggaagcaaagctgccagccggctgagccggctgccgcctccccggcccccaccgcgcggccctccgcgccggccgccgccgcgctgccctccgccggccgggccgcccaccccctcctgctgcgcacacgggatcgagttgggaaggggagttgggaagggataagaaggaaaagagataagaggaagggaagaagggatgagataggcttagagatggagggagagaggagtttgtgtgaatgagaaaagagtagatgagaaaagaggataagtaatagggattatatagtgcgttttgatctttacttccggttcgtaactccaaccgggactaaagatcctagaggagcctgacaacacttgacagcatgtgaaccgggactaaagatcacgtagtcccgttctacttataaactaggactaaaaaccttctttagtcccggtttttactgcaaccgagactattgtggtttttgatcgaccgggcaaagatggtttctccactagtgctagtaggacctgtcttgcaagtttttagggttttaccaataaattatttggataattacattattagatagctttggataatcttggagctaggcttgtttagagc

SEQ ID NO: 5326 - DNA, 1931 bp, Oryza sativa
ttagcattcatggtcatgtaatttactgattagggatagctagctactccttccatccctcaaagtaatttcagccagggttggaaattatagaacgaaatcggtcatttcggacccctccgatacgatattatttcggcagaatttttttatttttttattttttttcatgaattttggtaatatttgttcaaattcaactaaactttattcaaaattacggaaatttcagcatttcggcgaggtctgatcaaatcggctaaaccaaaatttccaaacctgattttagcctataacttttacgttaagtatatattgataacaaagacaatttagaaatttgccatgaaatgaaaaataaaattttagtagtttcatgctttaatttctaactaatgccgagtcatcctatatattgtggtggttgatggcggtgtcgcaattgtgaaggatgacgaggaatgagatcaagcgaggaaaacatctatcattgctaccgtctaatagtataggaagacaattttaccacttcaaatttcctactacaataagagaggacaaaataatctaaacgcttatatcacttatactatcagtatataccaccaatatattataacataaaagttctcaaattatctcacattgattgtattttatagtgggttctatagagctctttaataacaagtcgttttttttctccatattaacgaaggacttttatcctccagcttcatttgtgttggttaaaacatttagagacgaagggagcagatagtagcgtcgcgttttctgcctataaatatagtcaacacagtgcatcttccccagtgcaccgcatcggtttggtccattaatccgagcatcaatctcagtctcctcctcgctctccatctatctcagcttcttcctctagctttgcttgacccacacaattagtagtacgctgacaactagcatgccttccggggcaaactctcctacggcggccatcgccgtcgccgccgtcttcgccgtgctagtactgtcctcctccgtcgcgccggccgcggcaaagatgttctgcggcagctgcgatgacatctgcactgcttcgtgcatctacgcagacactatccccagggcgtgcgccccgcagtgcgacggctgctcgccggaggcttgccagagctgccttcaggcgctgaggcaggaatgcttgacgagctgcggcgactcctgccgcaagaactgcacttaattatctatcaacccctgtgatgtacgtcgtctcaacgtgcctgttgtacgtcaagctctagcttctggacttgacacatatatatgtggatgcttctgtttacttgcagatacagaggctagctgttcggatttctatcctttatcttaaaaagatatgcatgcttgtgtatttttcatgctacatgtaagaatgttatgttgagttgtaatccaaatttatttacatttgataaagacctgcttcgccgtagtggagcggaggcccgtgcacctggggacgcccgggggtgcgggggcagagcccccacggtacggatcgtcatcccttttagggttccaccatatatatacctcttgtaagccgccgtgcagcgatgtaacctcaccctagatatagtgaagatattttgctggctagcgcccgtggtttttttctctcctgctttgggagggttttccacgttaaaatctcgtgtcttctgtgattgatctattgttctttatcgtttgtttgcctatcgtttcctaacatgttacactagtatagaaatcatcatagggataacttaaagctcctgatttacttatgatctttctcattctttgaacgtgtctaaaattgaaagctggcatttttatcccttataagtgccggtttattaaaaaaaccggcacaagcataatag

SEQ ID NO: 5327 - DNA, 9975 bp, Oryza sativa
tgagagaagatacatggttttttaaagtcactggtggcaccgagtcctctcccctcccccatccgtatcctcttctccatctccccatctcctctcctctccaagtcgcctctcctctcctctgctcccgtccttggatacctctccagtgcgggtggcagatgccactccctccaccgttgagcctcctcctctcctctaccacagccgcaatcggttctattggcccacgacgcctcctcctctccactaatgcagctgcagtcgccgacggtcccctttgcccatgacagctcttcctctcgctgctgcagccaccgacagccctcctcacccgcatcgtctccaccactctcgagggtggccggatctaccaccatgagcacggggacgggtggatccggcaacgcgaccacaggatggcctgttcaacaatggtagcagcggtgacagtggtattctctgtgtgttcttcttagttgattttgattctctctctatttactttggggatggtgtcatatgttgattttgtttttgaatgtcgattctgtggttgtgttcttgggtgatgggagtgatgatgatctcagtggtgatggggagctattcaatgcatcagcttgattcgtggcgatgcattgagctggcatttttttttcattcctgaaacctcaaaggtaccgctgcagggtaccggtcaaaaaatccaacacctatgtccgattcctaacaagtataatcatccttttttatagtgttaggactttgtgtaataaaatgtatttctttattgttattgagaaagtaaaatactttatagcaaaacttacaatatctttgggctttggctaagtgcgatgattagttttgtgttctcttttaattttgcaaacttcggtatggtgtactctcttcgtcccaaaaaaaactcaacctaggagaagatgtgacccctcttaggataatggatctggacagaccctctatccagattcattattttaggagaggtcaaatctcctcctaattaagtttctttgggacggagagagtaacagttttggtttttgctgaccagaaatattcatgcccaagctggcaaggcccatccatcgcttgccagtttcccacagccaattaagagcaagtttaatagtatagctaactactagctccaaatcatttatagccaatgtaatagccaattcatactatagttgtttactacactattaatatctggtcccacctgtcatatacacattacgtcttgaagtccgtgctgtagctggctacagatcagtaacaccactgctcttctctcttattttattctttaaaatatatttatagattatagtctgtattccagctctaattaatgctaaaagtttagtagtggcttctatggtctcgtgccctttgacctcgatggtttcgatcgtctcgttccctttgaccttagattgcctcgccgccagtcatcggcctcccctccttcgttctctgacaaaatttgccaaatgacaaaagtttatgcaatttactgactggtatcataaaagcatgtcatgaataattacggaacatattctgcccaattgaatagagaaattataaaaaacaaaaaacaaaaatacccataaagccacaagcctggctacatgactagttttcctgtcatggcccatccaaaagttatagtgtcttcttgctgaaacgtagagacttgctcccttctttccaaaataaatgaactcctaaaatttaactttgtcacaaatctaatcaatttatacttttttacctatattctaatccatagttcaattgataagttttatccctacagtactcttcacttatcaatatatctattctattatatactaaaagtccattaaatttcctacaaacgtttctaagccaccaagtgacgctcctaaaaacactcctagattgccacgtggcagtttataatctcaccatcaattttcatttaaattagtgggcccattattttaggccattagattagatctattgcttactcttaatattctgtagatatgggtgaaaccgtttacaccagaaaaacatacgtacgtactatggaaagaaacgatcaaacgattaacgaacccttcagcatacatacgcacgtacgataaatagctatattaaaaaaagataaaagaaagatactgttcacttgaaaaaaaaattacttatataagcacgagtaaaaataataaaagctataagacctaaaatatatataagacataaaaaatatatttacatcggtataagaaaatagacgttttttaaaataagattttctatactataaaaacaaaatttattactctacaaataagatgatttagcgtttctacaattactcttaaatcgccacatgcatggctctctaacattttgctatcaattttcatttaaaatgacggaccattattttagatcattagattagcccatttcctcttaatttcctgggtatacaaccgaatgctctattgaaaaaatacaaagacatatacatttatatgataataaagcccaaaaaaactagaaaataaaataaacctttacatattgttccctagaaaaagtacgtacggatacacgagtaaaaataaaagccataagaccctaaaaatatatatacgtcggtaggaaaaaatagacggtcttttaaaaatacgattttctatactataaaaataaaattcattactccacaaatatgatcatgtagcgtttctgcaagcactcttagaatgctacgtggcactctataatttcgttgtcaattttcattcaaaatgatggatccattattttagataattaaattagcccgcttactattaatctcctatgtatacgagaaaccatttactggatgtttgattgaaaaacaaatacaaagaaccatacgtacatacgataataaagttataaagcctaaaaaatatttatcagagtacgtactacgattaaaaaagctataaaacaaaataaacaattagatatactgttcccttaaaaaaagtaagtaatagatggtctttttaaaataggatttgccatactataaaaatataatttatcactccacaaatatggccatgtggcatttcagcaagcactcttagaatgctacgtggtactctataattttgttgtcaattttcattcaaaatgatggatatattatttttggattatttgattagcccgcttccttttaatctcatgcatacgagagaaaccatttagcgatgttcgattgaagcaagttaaactagataaatataaaaaacaaattaaatgtgtttacacgcaaagttttttagattatttttaaattttatagtcaacttataatcaggtgtattcaaatgttgataacatatcatagttatattataactaaatacattatagcacctggagctgacatataataagtaatgtcatgataatcttcaaaataatttcacatcataatttatggtcaaatatcacttaacaattatataacactaactgaaatatacatgcatgaaaaatgaaacaacattatattttttaattatatctgatttaattttagtttgtgtgagattgagattctcaaagtttttttttaatttttcataactattggattggtatgctcaggcaatgatcttgctataatacgaccccttaatccatcacaagaactatggtcatatacattttttctttgccaaataggtttgataacaaatgaacaatcctataacatgagcatgaaactattcatgatatattctcttatagtagaggaattataatataatggtcataagtgataattgatgaatgtaatgacataaaccatagtggcataactacaagtgcacctcaacaaattagttattataaataattttgggaaataaatacaattttagaattagtaaaggtgtctcatgcaattatggacaataggtgatgaaaacaaacaagatgctaaaatatagatctttgtcaaaatataaaaaatgatataatactctgaacattgtcacggtcacgtgtttgtttagctatatatatttttagtgatcaacttcactcatttctaaagatgacattgtatttgtaccataaaaattaagtagttttgattaacaccataaacaaaattgtgtctaaacaaaacataaagaaactatattttatgggaagaaccgaataactatttgcatcatatccatcttctctttgtttccctagagggcaacgagcatagataccacaactatagcatggggcacacatatggttgacttgatgcaggctcaatggaggccacattgataatagtgctcaacttcctacttactggtgcaatcgtctttaagggtgtcgacagtgaactaggattaattaaaattgtgctccacaatggtcatgagactgtgagaggcacgactatatcgacctatgcttgaaggaatcttgatggttcccccattagaggggcatgtctattttttaacggtgctatcctaataactaataaccaatagaagcgttagttttagaatacttatccgtagatttagaaataagtgttcgcataaacatttaggtacatagttgaaataaagttttatgtattaatgatgtattagacttattttggtggtttagatggagttccatttattaaaatcatatctatcttttaagaacaatgataataagtaatggtgataataggagagtttacacttacctggacaaaagtgaattttgattaaatctaagagacattcttatcatttatattaaagtctacggtctatttcacaacataattttttattactacgaggcaaaatctataatttgttatatgtatatggtgagatataacttaattctcttagcattatttatataaacaataaataaaatgcccgtgcatctgcgcgggcttcttttcttgttatttataaattgtggatatttttccttacaatctaaactctctcgagttgatttatttcgagacggagggacttaagcagtattggcttaaatagatgtgatgaagatcttggtaggttcaaatgtactttgtacatgggtagggctgtcaaaaagctcaaggttcacaagcagctcgagttcggctcgttataagttcgattcaagctcggctcgtctgataatcaaatcgagctcgagcttacctttgaactcgcgagcctactcagccgagctcgaatagctcgacgagctccaccttctctttgtttctctcctttatccatcccctctatctccctcctcattgaattcttccatcaacaaaacaatacggtactgtcaaatccatcagagagtatagcatttgtttgacttcttatcttactttccaaagtagtactagtagtactacttttctccatcaaatcatcacagttctacttttctcttgaatggagcaagctcgtggctgagtttccaatagcaagctcgagaaaaggctcgaggctcgaacgaaccgagcccaagcttaattccaagctcgatgtcaaattaggctcgagtctgttccgagctcaagcctacatagggaagttcgctcaagcttggctcgttgacagccctatacatgcggactgaacacccaatttagttacttcaattaggttatttgatatttcctttgaaaaccaccatcttacagcattctacttgcaagctacttgcacatatactaattaggtgagattgagaagataagtatatctcagctttgctgccaataaatatcgtcggctgcatgccccattacactggacaccactccggctagtcaattaaccatcctgcagctgcaggcacaccaaacacacgcatgcacaataatccacacaagatggccaccggcgtagcctcgatctcctacggctgccgtcgccgtcgccgccatggcctgcgtcgtgctggttgtcctctcctcctccgccgtcgcgccggcggcggcgaagatgttctgctggcagctgcgacgagacatgcgcccattcgtgcgagtacaccgacaccgtcgccacggcgtgcgccccgcagtgcgacggcggctgctcgcctgaggcttgccagaactgcgtgctggcgatgagccaaggatgcttgatcatctgcggcgacgactgccgcacacactgcacttaattaattagcgtacgtaaagatcgagtaaaccatgattgtctccggtttccattatttttaacgttgtctagatcagcgcgtactacgtgtgcatgtaagtcaaattttatcaagtatcgttcaggacttgctgtaataaatgggtgtattttcattgttattgagaaaatgcaataggaggtagcacaacttgcaatgtctttggacttggaagacactattgctacctgttggaaatttggtcataattcaatatattttaatccaaaatattaagacaataaacataacatttgcaatttgaatagatctagtgatagtgctagatatgtacaacattagcatgtttaatataaaataagcatcagaatagataaggcaacgtaacaacattgcgactgatagtagtaggaaatgaagaacgaatggtaatagtaaatcgttatatccccgagaacggtcctccgttggagtttgaagcagtattgcctccgttggtgttgacgggagcctccttctccttgtctccaatgttactgttgtcgccggtgttcgacatgttggcgcagacgatgcagaggaagacgaacaaaagcagtcgcgtgtagcgctccccaaaaacttcgcctgtctacccatgcaggttctcaagcggacggagtttcggaggcacctactcgttccgatcacccgtgtgcgcgggatgaacagaaccggggaaacagagagatagcgcaggaactgaaggagagtatcacgtaggaacagcagcaggaggaagattcgatctttgagagcctctgccttgcgttatatatagagagatctccattaccacacaaataaatctctcatttgttgtgaaggttaccacacattgaatctattatttgttgtggagattacaacaaataaatctctcatttgttgtggatgttacaacacaatgaatgtctcattcgttgtggaggttacaacacaatgaatttcatttgttaatggtgactttattctcgtctattacaaaacggaagagcagcaggcaggctcggctcagtcggccgccccgcctcgccacgcccattgccgaggccaactcggcgcacgcgcgcgtgtgtagcagtccaaccatcacctcaaccggtcaatagggaatctccaatatcaccctatttaagttgaggttcttctacctaaattttcaaggcagtattattgtctctaacattacttgtgggctcttgagattttagttgaattaaattgggcctagcctatttattccaacaatccccaccaaatttcatggctcacaacaaatgttctcaaaactgaacctgttagttataccagtgttttgatggagactgttaagttgaacttccacctaggaaaagagctacaccatatcacaactgaacaatggactatgcattgaattgtcagtcttgtgcgattcaggtttcactcaaacccttaactggtactgggctgccgtttgcatcccctctgtttggatcatataagtcatactcctggacttttcatgagtatctagagattacccagatctcatagactataactagcaattggactcatataggtgtgttccttctaagatattctgtaggatgacatctctgctttatgaaaagccactcggatcacattaaggtgtataccatcgtaccatacagaatagaagagaagtacatcatgaagataaactcattttgagggtctcttctctcagttacccaatagtttgttttgccatccaaattcacgggatctccgatcataatggacaggttaccaccattgtgcatctctaagtgggtctcaagcctatctccctcgatgcacagtctatcacattatgtggtagccccttgataaactgatctgccagatttttagccgtcagggtatagtcaaatgctatcactccggagtttttcctctttctaacatacttcagtcttcttttaacatgcctggatgacttcatattgtccttcgaactgttcactttaataatcactgtttaattatcacagttcatcaggattactggtactgaaatttttaaccaccggcaagtccatcaggagctcacgaagccattcggcctcaactgtggcaatatctaaagttgtgagttctgattccattgtctcattaagatggtctgcttgcaagtcttccaggaaacagcgccccctccaagtgtgaacacatacccacttgtggcctttatctcatcagcatcagatatccagtttgaatcactatagccctccagtacttttgggtacccagcgtagtgaattccatagctcattgtcctttttagatagcgcattactctttcaagagcatgccaatgatcatctcccggatttaaaacaaaccggctcaacttgctcacagcaaatgagatgtcaggcctcgttgcactagctaagtacatcaatgaaccaatgatctgggagtatctcaattgataccttgctattcttcaattttttcttaatagcacactagaattatgaggagtaagagctaccttgcagtcactataaccaaagcgactcaggaccttgtccacataatgagattgcacaagtgtaatcccaccctcatctcctctcagtagtttaatgttaagaataacatcagtcactcccaaatccttcatttcaaagcttttggacagaaagtccttgacctcctcaatcacaatgaggctggtcccaaagatcaatatgacatcgacatataaacacaagatcactccctctcccccaccatagcgatagtacacacatttgccaacttcattcacaccaaagccaagcggatataagtgtatcgtcaaacttctcatgccattgattaggcgcttgtttgagactatacaatgacttcaacagcttgcacaccattccctcttgaccttctagtacatacccatctggttgatccatatagatctcctcctccaactctccattgaggaaagttgtcttaacatccatctgatggatgactagaccatgagaggctgccagagtgagtagtactcgaatcatagtcaagcgagcaaccgatgaataagtgtcgaaaaagtcctcgccttctttttgggtataacccttggccacaagtcttgcgttgtactttttaattgtaccatcaggcctaagttttttcttgaaaacccatttgcatcctacatgcttgcacccatatggacgctcgatgactacccaagtaccataagacataattgagtccatctccctgcgtaccacttccttccaattgtcacttaatcatcgtctacataagaatatgcctcttcaatggtacttggagtatcatccacaagatatgcaatgtagtcatctccaaaagactatgcagtcctttctctcttattctttccagtggctacaatgatatcctactcacgattatcctcaagcgtttgatcaatgtgttctatcggcacaaagtgttcaggggataaaatatgttcttggctagaagtgctaggtgcatttttcataggaaattcattctcaaaaaatgtggcatctatggactcagtaattgtaccaacacgcatgtcgggtactccagaattttctattaagaacctatatcacacactgtggatagcataaccaaggaaca

SEQ ID NO: 5328 - DNA, 756 bp, Oryza sativa
ccaacaacctctccaagtgactctctaagctaaattttagctattctagccaaaagacgtctttcaacatcctctccaactggatggctaagccatccggctagccaaaactctcaccctccctccactagtcaaattaggaagctaaaaatcactagccaaccatgggcctcatacacattccacctccatctccttcggctcttctccaggacggcgcaggcggccacgacctcgacgccgccgccgtgcaccgctgcaaccaccagcttccggcaccgctcgatggctgtgagcgctacctgcatctccaggatggcgcagcggagcccaccagccgcaggcgcggggtcgccgccgcccggtgaggaggggccatggcggggttcccggggcagtgcgggccggcaggggagagcacgacggcatgcgcggctaggatgcggtcgaggagcgccatggcgcgtgggatctccgcgaaggcgtccgggctgagggcgttgagctgggcggagcggttgaggcggaccttgtaaaccaccgtggacgggtcgggcggcgtcacggcgagcgtcttgaacccacgccggagctccgcctcgagcaaggcgccgatgccgccgaggcgccctcctagtgtggcgagggagggaggaagcggcggcggggcggctcgacgagaaagaggattggagagaggggaaggaagaagaaagggggatgagaatgactggtggggtccattggttaatagag

SEQ ID NO: 5329 - DNA, 5335 bp, Oryza sativa
  unsure (1)..(5335): unsure at all n locations
nnnnnnnnnnnnnnnnnnnnnnnnnnnnnnnnnnnnnnnnnnnnnnnnnnnnnnnnnnnnnnnaatgactggtggggtccattggttaatagagagtataatgcggagagtctgttggaatagaatgcaaatttgactctctaaacttttgttaggttggccaaataggtatttggagagctaaaaatgaccactctattaaagatgctcttcgatttgaacttctttcatgggggatacataccgtcttatagcagcttaatttagaacacgatggcgaagaggacactccattagagtagcaaaagagtgcatggttgaattcaagcatgaggcaagcaataagaatcaaataataaaaaaagccagatttggtggagaaacgtcccccaaacatttttttcaaaattttttgctataagatattatgacttcatggacactctgtaaacgtcagagccgtcctaacaattttggggccagtgaaaaatataaatgagaccttattttctaaaaagtaattgattaatacataagggttatatatttggaacggatattcacagccactgtttttttaccactgtttgttctttgatatgcactgtctgacaagcacgtcaggaaaggtagcatcgacctaatactcttttttaagactgtttttagatcgaggggcaaaaaaaatttttaaggtgtcacattgaatatacggatatacatttgaactattaaacatagtctaataacaaaacaaattatagatttcgcatgtaaactgcgagacgaatttattaagcctaattaatttatcattagtaaatgtttactgtagcaccacattatcaaattatggagcaactaggcttaaaagattcgtctcgcaatttacacgtaatctgtataattagtttttttttctatatttaataccttatacatgtgtccaaatatttagtatgatagggtgaaaaaacttgctaggggatctaaataagcccttagatatattctgctattaaacaagtaggaattgtttgcaatcaatgacaactaatggtatatcaaataagctcattcacctgtatattataatggcgatctggttaagtaaaatatcgttgcaataattcattttttcttactaaatagaaaaatataatctaagaacgcatgttcacatccccgtcatgaaactttacgattaccatcgaacacttgtcggaattgagaaaaaaaaacagcttgttctagtggtggagcaggaagagtgaaattcaaaaagcataatctaaagatcataaacatgtcagaacatcaatttcaattgaaacatatggttattaagcctctgcaggcccggtaaatgtaaaaattagcttatgaacacgtcattattataatattcatttctagttgaataaaagaaaaaaaacacataaaaaattttgaaatacatctggatccacatgtaaggtatctatctcaacctctatctccaattgcccttcatcctcagcctaaggccggcgatcacctcgtgatgtggttgttcaacgcattcgaaaggtccaacgttctacagtaaccaaacagaaacatcgaatttagataatcttggactaacctagccatcagaatgtaaagtaatagtggcatatatcctatccatatgagagtaaagttaccctgtttctcaaaaaaaaaaaaaaaaagaaagagcaaagtaccctttaaagtacggataatttttcggacgtcggatggagatccatcgtctcacagccctccccttcctctctaccctctaccgagtcgagcgtcgcgtccgccgccgccggcgccgccgccccccgcctcttctcccacccgcgcgccaccgctctccgccggcgagccgtaacactaacccgctcctccccccgcccacaccactccattttcttcctcatctccggtctgcaaaacggtagttaaacaacggggatatgttcgccgcgaaatcaaaccggggaagaatgtacatggcgacgaggagcgccgccgccaggctgctctcctcctcctccgccgccgccgccgcctctcccctttggtccagacgccggcgccgccatccattcctccatccgccctcccgctccaagaccacctcctcctcctccagcagcagcaagcctcctcgccgcccaccgcctcgcaaggacggcggcgggccgcgcccgtgcctcttccaagaactctccggtctcgtcgccccatccgccagcgatgaccccgcgtttcagcctcggcgagatgggcaggagcggtgtggcctcctcggccatgacactgcgcagtgcgcggaaggtgctcgacgaattacccctgagggagcggctgcggcttctggttctttcaccggtagcgttccgaacaatgacgctcttgggttccttcctgatggtgggattgggcctcgtagcactgcaacaggcggtgctccggacagtgagcaatctatccaggaggtgggcgatggaaatgctggagatgttgagaatatcagtgaggttgtgcatagggtaacagaagttttgcgggcagaggtgcctggattgtctgtggaacagaggctggagaacctgggagttacatatacaccgaggcttgtgagcttggtgctcaacaggtgcttcaagaagaggcatttggggttcaaattctttgactgggttaggcaagttcctggattccagcacaccacggagacgtacaacgcaatgctgtacattgcgggtgaggagaggaactttggggccatggagaagttgatggatgagatggataaggagatgtgtttgaaggacatcaagacatggacaatcgtcatatccagttatgggaaggcaaggcagattggcaagatgctatctacctttcaggctatggggaaatcgagacatgtggcagcagatagtaaagtttataggacgatacttcatgctttatgcaattctgcaaagtccgagcttgctcttgagttctacaaagatatggcaaggaacacggaggttggatctgacatttttcgacttctattgtgttgtctcgcaggatcagataatgctgaaggtgttttttatgtcagagatgatatgattaagagcatgaagtatccagaggagtattgttatctggaagctctacggagcttctgtgtttcaggaaaaatagaagaggctcagaaaatcttccagcagatgatgaacaagtccattgctagctcatctgcatttgaaatcctattgaggggcctttgcaaagatggaaggatggataaagctcttcaagttatggagtacatgaaaagcaactcatctgcgagcagtgccacctttggttctctcattgatggctacctgaggaaaggagagcgtatgaaggcacttgaggtgcttcaggaaatgagggaatatggatgtgttccattggcatcatcttatactcagctcatgcaacacctctttgcatttgatcaacatgaagcagcatgtagattgtatgaggaaatgcaggaaaatggtattgaaccagatgttgtggcaatcacagcactgataggtgggcatgttcgtaatggacatatatctgaagcatgggatgcatttaggaatatcaatgagaatggtcagaaacccacattgaaagcttatacagtgttcatccaagagctctgtaaggcctccaggccccttgaagcactaaaacttctgaaggaaatgctggaatcagatttcaggccttccgagcaaactttcagcaggattatttccactctgtatgacaatcactatttggaagaagctagcaatattgagaggatgcgagcatcttttaattgttgtagccctatagaagagctgcaacgcagaacattggatcaagttgactacactgataaatttgaaaaatcatctggatctggtccggaagagaaggaaaggacagtggagtttgttggtcatccttcgtataaagactgtgaggtctcagggagctttccttgtgatgacacacaggatttagaacaagcaaaggattacaacaatgaagacgttgaacaaatatgtcggattctgtcatcttctgattgctggagctcaatagaacaggctttagagatgacatcaatatcttttactccagatcttgttgatgccattatgaagcgttgtaaggcaaacagtcgtgctgctttacaatttttttcttgggtaggcaaacgatcttactacatgcagacaacaaagacatataacacagccataaaactcgctggctctgcaaaagattttaagcacatgaggcatctttacagagagatgatatgggcagagtgttgcccaacagtggatacatggaatgtcatgatttgtcagtatggaaatgctggtctaactgaaatggcccttgaaacattctaccagatgaagcagggtggctttcagcctgacaaaactacttacagtcacctaataatgtacctcagccgcagaaaagggaggaaagtagatgctgcagtcaagattttccatgaaatgtgtcgtgcaggctatatacctgacaatggaatggtttgcacatatctttctgtgttatgtgagtgtgggatgatagatcgtgctgaaagctcagtagtactattatgtaaacatggattttctattcaggctggctactccatactcattagatcattgtgcaggtctgatagaatggccgaagctctcagtttgttcgataatattaagaattatggatgttcaagaagtgcatacatgtatgggagtctcattcacgcgttgttgaggagggatcgctttgaagatgcttcagctaagcttgcagaaatgaagaatttaggtatagctcaaagcacacatatgtatacctcattcatgatctattacttggggaaaagggatgtttccaaagcgatggatgtacttaaggagatgacagaaaatggatgtgagcctactgttgtcacttactctgcattgatccgtggtcacatggcaatgggtatggtttcagaggcttgggatgtcttccaacgcatgaaactgaagggacctgtgccagactttgagacctactcaatgttcatgtcatgcctttgtaaggcaggtagatcagaggatgggttgcagcttattcatgacatgctgaatagtggtatcatccccagtgcagtgaacttcagaactgttgtccatggtctgaatatggagggcaagtacaagctagctgattctgttctccagtcaaaatggcaattgcggaatcg

SEQ ID NO: 5330 - DNA, 6257 bp, Oryza sativa
gaatgcccagatcagtaatcagaggaacactttatccaatttagagcagtgaactgttgtaacactggctgcatgaggaccttataaggtattccttctttctcttgctttgacatttattcttcattcaacagtgcaacctagctgtgatcgctaaagataccgcccctgttgatttcttaacccgcagcctgtcccttgccattcccctcctctacgtgagctaacctggtgcactcattcttctctaactaggatacctctcgatggcagcagtgctatctccactgatcgtggtccaggatgtagaggtgggtatgtattcgttgatactctactgattagaatttgacgaaccactgtcattcaatctgctgacacatattgcagttaatgtctgttcttcctgcctgtataaacactgtttgatgcatgtagaaatgtgtaccttgcaatgtcatgcatggatcaaaatcagacagctcaagataaggtattacaagcacacttaattgaacaaattcgacatgctgcactttgattgacaattttgagggcaacaccaatcttgatttgagtgaaaacttgctttatgtttctatttgttccatttctgtcttttcacatgcaagtgcaaccttatttttttatgagacgttgctgtacaagattaccagcattttcttcccaatgaacaatacagaatgttgtttcttattaatggttctatccagcaatccagtcttctataggttgtcctgtttttgagcagtattcaggagggcagatccctcccttgaatttggaagtgactagtatattcaatgcgtgcgcatatgcaatgctctttgcaggcacacaacattattttagcttcattgaattctgacatttgctgttttggcaaatagttatgaacctctcaacaccagtctgtgttttgtaggtaccctactttgaatatgctcacttgcttgtaatttgcagtataattgattaaagttcctcctgaagtaacttccatcaatctattcgcgcagttaatatgtgtacgcatgatcaagtttcagtattgctatttgtatcacagttattctttatgggttggttttatttactttgcttcacttacaagactgctcagagattataagcaaagctgtgtctttgtaatatgtgggggtagaccattccttctttaggaaattcctgatgctgattccctgtactggaatctgatagtagaaattttttaagaaatttttttatgctgattccctgtactgtaatctgatagtagaaattttagcactgagccactgactggcgttttaataatcgcagagctcacactgaagtctgccctcatgctctggtcttaatttgtcatattactgatgaaagtcttaggaaatggtatgagcaacaaatgaaccacatagttcttttctattgttgtatggcttgataggtataagtaaagtacctttgttgttgcttgattccttgcaatacatcaactgtaaactatgtgttgaaccaaagttgcaaagttttgctgctattcttgctacttaatcttcgtttctgtgtctgttcagaaggaagcccatgacttgaactgaaaaggtaacgttacaaaagaattagtacaaggccgaaagcaacaggaagggtctccaactgaagagaatagaaaaaaaaaatccagaggagaccatggcagataacagagaggttcaaagcctttgcattgctctatctcaaagaccccgaaccatcctcagttccatttaaaacgtgcttaatagaaaggtaatgtttcagtaaaaaataaaaactaacgttaaagcttgggttacagtacgattacgtcttgatgcaaacttgcaaagtgagagtctgcttccttgataaaaacaaattcctgaagacttggtggtttgttgtttttctacaatattgctttgagttcttgctaaactatagctgtgtaatgtaatgatgtagctaagtttcagattctgtggttcattagtatgcagagatataagcgtgatatttaccaattttctagctctcataatgggttccatgttcaagtttactagtgtttcagtaaagcctaagtggaatcttgataatctctgaatagagaattttgatttttttaaaaaaggatttaaaattctgctaagtacttaagtaccatgccgaactggtacatgctatttgtattttacttatgatctttgtcaatttctaagattctaatcatggatacgacttgtctaggccacgtgtgattcataatggtgactggtgggcgtcttctatggctgcagcactcttggaattcaacttggtaattggtgtgaatcatcaaatatattgttacatggttccgaagttctaggacggtgttgcataattgcagcatattgttattatattaatcattctaagatgatgttttcgcttcaatataccatgtaaggtattcaattttgtgacatagccgtgaaagtttctacctatccatcatttctcaatgaaacgtatgtaatgtatattttgaactcatcatatgggattctgaaatctgaaataagaacgtaactgtgttggctcgaggattcactgaattaacagagttaggctccacaagctttaaacttcaacttgtccatgctttaaactgctttgcacccactgaacttttcaagtgtagcacattttacatataacttattgagcaaagaatgaatgtaattcttggtaataacaaatatcagtttccatttcattgtctgcctagtgctgcctgtatatatctgtgatgaaatatttttacagcgaggagaaatgtggaaatatgtctttccccttcctgcagcattgcaaccatggagtgaagagagcgctggctggttgagtggtggtgaggaagcatccggcattatttcatcctaagagcaatgtagtaaacatgggtcatccaagaacatgggctagcctccacatctgttgccactgtacactttacaattagagcttctttatggtttcttccactgcgcgttcataatacctcattctctgtgtagctttcactgcacggtcgaaatccctcctttcaaatgcttcctggaaggaatgggaccaggtttccagctttctcttaatctgataaaggtgatatagtgcgagcctagaaatcagtcaagcgtatttatgcttcgaaataacaaccatgacataattgtgcttaacagaacctgagattgtatcttctccagggtttgagaatcattggcatcattaactgcttcacgtatctccatcatctgcaaattatgtagaaatatagctttgtttcttcaaattgatcttgaattgaaatatacatgtcatcgcaattactattacttctgtgtgaagttattgacacaagcgtcatggaaatatataaactagtgattaagtggctgcatcagaaccacagaaaaaaagattcaaacaggttacctccataagaagttcaggatcagtgatagtcttttcttcatcaatgggtatcccctctagttggagctgcagaatggttttatatggttgagaagcaatttaaaagatgatgtagatggatgcttacatagatgttccatgtaaaaaaggtcatatgtttacaggtcaagtatattttttatattattttgagtggagatggagatggtttagcctcatataatcataacctaatatgggttaaaatgagatgaaataggctgtattttttaagtattactggaagaacttaccaagtataatgcccttgacaaaggtttgctcagtgtgcggtatgcatcaattacaagtgctgattgctcagcagcaaaggctctctctttctacacaaaacagaagccaagtcacaaattgttttgaagacaaaggtacgaatactatagattggtaagaatgccagggcctagggagagacctcagatttagaatgaactaggtcaggatgtaacttcttctgccagtctttgtatttcccttctaaattgttatcctttatggtgtattccctttctctgccaaagtaatgaagtaaattattgatgtatgattaaggcatagaaaatattgacagaaacttatgcaattgtagaaaattttgaaaatattattttaagagtaaaattcataacgtgattaccatgatggtaccactgtatttatcatgaagcagatcattggaacaaattgtgaatttgccatatcattacaggagaggtcaaacacttagggtggacaaaatatacagtgtggatacaagactatccaactgaaacgctcacgagttttctgaaggggagatttggaaatttaataaattataagcattaagcaaataggtagaaaatcacgaaaccatcaccaaacaaactacttgcgttattacctaaacagccaacatggaaatgaatagaagggaacttatcacttatcagcataataaactatgcagacatattcccccaggtaggattggtggatagagcaagttggaatatgaacttcgaactatatccagctaatcccaattccacctcccaataattcttttttttaatattacagatcagtgcatcaacaatcaaacattatactaacataattgcattgccctagaaatttccctaaaatgacaacatgttttggccaacctaagagtcgcatcaaaatgcacatatcttgtaacaatcattgcaaattaccagtcctattatcgcaatcacatcaaaattgccagtaggataattttcgtcctaaccataaaagctaaagctggtgtccagtttccctttctgcataacccatcaagctacgaacacttatttgcgctgcagatgatacaaagaaggcccaagaacatagaaaccgtccttgtacaagtagcatttcagcattgcaatacataatgcctacgagctgagcagttatgacgatcactgcacaatccaattatacccaaaatacactagaattcgaaagagacgacacgattcattcacaaacaaaagacaataatgagccaattagcatctgattaagtggggatgctactcacaggccaaagatccggaaataatcgacggcggggtcgacgggctgcacgctgccgcaggacccgcatgagaggaacgcgccgctcgcgccgcagctccagcactcgcctccccctgcccggtccgagaggctccgggaggaggaggaggagccccgagcgaaggctgcgagatcgcgggtggtggtggtagaggcggaggaggaggaggaggaggagggcacggtggggacagggggaagcgggttcctcctcctggcgccgcggccagcggctccggccgccgccgcgaggtggaggcggagctgcccgggtcggcgccacatgtggggctttctgcggcgggggcgcctctgtgcggatgcgggtaagtccggcgagcggcggcggcggcggcggcgcggagagaagggggggatatgcggttgagttgagagccaagtattttgtgtgggtttcggtggttgacaggtggggcccctggtagctttctcccgtgaaaaactagtgcggaggtgtgttggttttaatggctttggtttagatcccatcatggcttatgtggacgttaagagcaagtccaataatataaccaattgttggttctaaatcatttatatctaatctaatactctagtcatcctatctttctataaagttatcccccactaacttcttaagcttgacatgcaaagatgccacatcatcatctactaacaagataccatatcattatccactaattaacaagatgacacatcatcatccactaacaatcatcatatttaaacatcatgcaaacatactatatctttatagtttttataatttaagagttttttaaatacaaacatattaaattatcatccaatataattcacataatgtttcaatgtatatctttattatgttttatgatatcctatatacttatatagttcatccttagtttgtgcttaaataattaatctatggtccaaattatttttctccttttttttctctaattaagtcatatcacatcaattatttttagcctttagataattaatctacggtccaaactatctccctactactagcttactttttacatttgaatcaccattctacatactat

SEQ ID NO: 5331 - DNA, 3985 bp, Oryza sativa
  unsure (1)..(3985): unsure at all n locations
nnnnnnnnnnnnnnnnnnnnnnnnnnnnnnnnnntattgtttctataaaaatatttattgaaaagtgatatatgtatacttttatgaaagtatttttcaagacaaatctattcatataatttttacattttcaaactcaataacttgagagttatttatgatttatattcccaaggtttgacttaaacattatccataaaggaatagaaacaataggtcaaagttgtgttttgaagaccgtgttgctgtccaaaacgacttcctttatgattactactccattaatactctgtcctacctctaatatacacataacgtcttagagtctgtgttacagccggctacaaatctgtagctcgcttttttctcactcttctcttttcttctcgatatgtggttatagttggtttatagcttgctattgtacctgctctatgcaagtactactagtactatctgctcggaacttggtagattctctctttttcaagtttctttttgtaagtttacatgtaattttgacaagtttattacgatactcgaaatctatgtaagagcagagattaataaatgatgcgctaccatagatcatggttgagatgataacaacatttttcgtatgaccataacaggataatgtttacaacaaaaaataatactgatattattaagcttgatatggccatacagcgaagcttgaaattgaaattaattaagcacaaggtggtacaatgatattagtgtgctaacccaagataatgtctattgataaaaaggaaaatagccaaaacaatgtagcttgcagatcaaaagcggacaaattggataagtctagtgtttgatcatgccatacgctagttgaattctagtggacactactaaattaccgacaagttgaaacgacgctgctactgatacggataatcaatatttatcatggatataaaataaaacgagagaacatgaactgagcataactttttttatagtcaaatctacacatttagattcaaattcttaaacagtacgggtgttcgtatttttttgctaattattattcatgtggaaggtcacaagaataaaatgtctagtgataaaataaccagtttctttagacataggagtgatttatgccagacattttgactagaccttaacataaacataattagaaatggaactttactacaatgccaaagcaccacgggctttgacgctgaggcccaacaccttaacaccgtggaatatactacgaaaacaataataggcacaaatgcgggggggctcctagttagcgcagacgcgccagataattttgtagcgcgcacttccgtaacttcctcctgtttcgtcgttttgtatatttttctgttccgcatcgcttcaggggaggttaagcgtgtgggtccactacagccacgcgtcattagcactaataacaacgctaaccatatggattaatctagttatagtttttattatcaaaataatacataaatagttaagttgaaagtttcgaaaatatgatgaaaattttcaaaatctgagttgaaagttttaaaaaaaaatcttgaaagtttcaatttcgagttgacagttttgaaatttgagttggaagctttcaaactcgagttggaagttatcaaatttaggttgaaagttttcaaatttgggttgaaagttttcaaatttgacttgaaagttttcaaattttgagttgaaagtcttcaaattcgggtcgaaagtcttcaaaactcgagatgaaagttttcgaaattgatttaaaagtttaaattttgagttaaaagtttttaaattttaaattgaaagtttaaattttgagttgttttaaattatggttgtgacttttaatttttcatctataaaaagttttaaatttcacgtatatattttaaatctttagttaaaaaatacaacctcatgaaaaaaaaggaaagattaattaaaaaacataattatcggaaactaattccgtcaactaatataatcttgattattttctccgaatctagcgcacttgagcacgcttcccggtgttccctcgcgcaaaaaacagaaatagaagtaggccgaagagaaatcacgtacgaggacatgggcctaaaacgcacgctagatggctagttagcgcgtctgcgctaattaggaaattcgcaaatgcaggttatagcatgcgtactgcagtgataaatggtgtctgtattatcttggagatcaatgtttgaatctttatcgctgcaatattgtttcctttttctttcgaagtgctgaagaaaaaagaaaacaagacggaacagattcctaagtggcaaaaaaacaacgataacgcagattctgaagtggcgaaaaaaaacaagatagtggaagtgggtttggacctagcaccttcacaccttatttagaaacaatgatagtgggcctcaacaccatgacccatgacgctgagatagaaatctatttttggtttataattttttagtttgtgtattactcgatgccaaaatatatgatgctaaggattcgtttggagagtttaaagattttaagaagctgctggttgatacccaacttctgataatatgcaaaaaattgagttcaacttctgacttctagcttatatgaatgaaaaacttaattattttgggagttttcgattcagggaaaaaatagagttttccaaagctttttcaaacaggctctaagcttctaatttcaacatcaagggtaggggtggatactgacatgactcggctcggtctactcgttaggataacgagccgaatcctaactcggctcgactggcaactctagctagcttgtttagctcgcgagccaatacatccgtgactcaatagaaatctctcacttcgagattctggctgccaacaattttttttgcaattgcttaagaaatcaaacaaccgacaaatcacaaagacttggcacaaatttttttttacacattgcatccataaaaacagatctgaaagtctcgtcatattggaaccaaacaaaacaccaagcaaacaccctagtgaatcctagaccaaccaaaattaacatgggagattgacttgccgaagtgccgaactgccgacggcgacgaggacggcaagattgaacttttgctccttgatttataacttgtagcgctgtcgatggagttgcatgctcttgcatcctgcagcaggggaccttcaccctgcttgttcgtcttcctcacgacgacgagactgagacaaggccacgcttgccacggagttggccgaccggctggagcggcgacgagaggaagcgcggcaccgtgagctcacaaaccacgctgttgctgccccctagaggctggtggtgacggccaggtcgtcgacgatgccggcgtgagggcttgggcgacactatggcgatgtgatactggacagaaacagcgtgcgctgtagattggggaatggggaaatcaatcgatctatttgatataactagggtttagtggaaatcagtggatctgatgggccttaggcctacaaataacaatgcgatccacctcagcactcctgggctgctttgtttttccatggctcatttagctcgcgagccagcttgagctcgctcgttatagcaaacgagctaaccctggcttagcccgttaataaatacaaacgagccgagtcgagttagtcacgagctatgagctttttggtatatttttgttatagtttttagggttaattggatccatgccactgtaaatgtggcaaattagaaaaataccactactatttgttttattggctaggtgccactacaaatttttaaaattgaaaccatgccactccgtcactatttctgtcgttctctctcacgtcgtcatcctctaatctcacgtaggcacggcgagggcaagaagacgaggcggccgccggcgaggacgtcgcgagcgcggggagcggctgcggccacgcccggc

SEQ ID NO: 5332 - DNA, 1222 bp, Oryza sativa
ttgtgcagtttggtgcaatcatttcgcataggccaaaccaactctaaatctctgtagtcgattaatttagtagcttcaatcaatgtagatcggcatgttgcgttgcatatggactcttagctatgttactatgtagtagctgttgtttattttgtccgttcttccgacgattgggggatgacggcgtaatcgatgctttcatacaaagtggcgattgtcggttcacgtgttgttagtgactgctggcaaacttacaaagtttcctgttgtttgtatacacagaagatgacattccggaagaagaagaagagggcaccggaaccgtggctaatgtaagctggctctgtaaatgcatattgtaaatttgcgtattccacgttgtacttgtcggataataacctactagttatcatggttagatgtttgctatgcttttttaagcactataagtttatatagaaattaaaacattgacttctattttaagccggtagaatttaacctctttcacttgaaatatatggtcgttattattcttgcaagatttattaattgatacttctttgaatggataataagataacatgtgtaaccatatgaagtcttcttaagttacacacttacatttttgtccagtgccagtgctacttattttaccttgataccctattgaatcttccatatgatcaagttcctaaacacatgttgctttatatgtggaatctgtccattgtcaatcctcagaattctgccaaagatggagatgacattcttagaaggtctgatagctatgacgttatggatcttgaagaactattgaaacagaggacattcacgaggcaagtacctgtttttgtataacattaataggctcatgtttagcaagtaatttgagcagtattagatttgttgctagcatttcagtaactggtaggcataggtaccgccgatatatcttttaattgcataataccccaaatacagcatacacctaaggaactgaacttgatctgcaatgatggggtacatccatgaagttcataacacagcatcacactattaccatgaaatgatttgtactaataataatttctatgtgaccaagaaaatataaaccatgaggctatagaaaacatgggtttccctaactggtttttctttttttaggagaaaaagaagtgtacttcagttctaaagctgggaactaagaaatggacagttg

SEQ ID NO: 5333 - DNA, 12895 bp, Oryza sativa
agttcaatcctcatttatcctttaatacttccatgcttctgtatgagttgaagtgcaatgccatgttttctttgctagatcctattgttgtgaatacctgttttgcctattgcattgtaacttgcaaatttgttttgctaatgtccaagtgtacagtagaaatgcgaaaacatatttctatcttacaaataattttctgtcttgcaggagtgaatttgaatatttgtctgagttgttgttatctagaacggttgggtccaaattattgattccaggagttggtaatatgaagaaaatgcattttcctgagaaggcaagtcgatctggagacttacctgttgatttctcctttagaacattcaacacttctgttaatacgcaagtcatgttgctcactaaatattcctgttcatatgatgaaattgatttcttttacaatcacccatactgtactgtacagaacataatttaaagtgttgaagcaacaatataatttcttatttttaagatactagaaaaaatgcccgtgcgttgcaatgggtaaatgctattttaattttattgttgttatatggtttagctagggtaaaattcactgtgggaattcgcttggatatttttttttgaaaatcataagctgcaagagtccgtatatcatctcaagttagcatgcgagtttttttaatgatatttcttatacgactccttctgtatttccaaaagcaaatgagcttaaaatccaactcaaacacggatctgtatttctaaaagtgaacgaacttaaaaaccgactcaaacccggatgacataccaaaataccggcaaaaacatcttcaatttttataatagtagagatatggcatattgttgagttaaaacccttgaccagcagaatagtttgttatttttttttcgaagttgaggaaagcatatcataggtcccccttattccctaaatttttgcaggtcacttgggtctctggatttgagtgggtacataaaattgtataagtgggtcaacaaagtcatcctacttttttttttggtatacttgtataagtggtctgtagttgcttattaggcatggtttaaacctgtacttatgcacatacacatgtttaggggcctatatgtgcaattttcgactttagaaacccaacttttagtagtccctggtacacatacttcttttttctattcctacatgagtttcacttgcgattctatctacatttgccacaaaatagcaaagctcgtaccatgaactattttatctcctgacacatttgttgtttataccattgatatgccatatgttccgtgactacaagggtaacataatctcatgctattcattcctgcaggatcaagttgcttcacctgcagaacttgcaaaggcatacatgggttcaagatcttctaagggatcaccattacgtcttagattgcatgacccctctgtactttccaaatcgatagaagctaatacaacacaaataacgaggcctcccaccctctctctgctcgcgagtgcaagaaatcatgctccaaccacctctgatcgtcttgggagcaactacacgacaccaaatagatcagcaatatacaaaatgtcatcatctccttattttaaggttctgttatttcctacttcatttaatgtctaattactttatgcccgcagtatttctgttatgtatttgcacaaagagcacaatagtacatcagatcttgcatatttgttaaatagaaaaattgaataggtagccacagactacttgagaaactcaaagagacaactaaaaatgtattacaccttaatcaatctgtttagtgcagcatggcaatcatcaagttaccttgattcaagtattatgttaccacgctgttgcagttgctctctctgaatttcattagtagaaaataaaccttccatacattattttcttatttggcctcttaaaatcacaatttaacatggaaaggtccaaggtgaccaagttgtcgtatgtatatctagtatatgagttaaatttaattagtgtgtgtgaacaatgccaaatgtgtcttttagcgaacaaatatcagtttatttgttttaagcaatattagaaattttataattgttctttttctatcgaaaacatgtgcaattagctagtgctctacatactgccttattttattctcattcttgagcacaataccctatctctgttactatgtggttacatctctaactcaagttcctcaatctgttcagagtgctgtttcttccagggatttgtttggtactgtatctccatatcaggctccaagcagccttcatacatttggaaggcaggtattaatcacgaaacataatcttattttgctgtaaatttgttttgggtttattaccggcttctggatttatgttgaactgctactgcatgacttttatcttggcttctttgtttgattagtgaatgatttatgacatgaaatgtttggaccttcaatattgatcactgattgactcaccacataattttgttgctttaaagtacacgatacaatgttaattgcagatttttttgatcggatgctgcctattttatgcgtaaaacacaagctattattttgaaatctaaagataaactagacgactctggaatatgttttcttgaaccctctttaatcatggtaaattggtaatagtagttggcaattagtggtgtacctagaagttttctagacttgggcaaaaacaacttcagctagcatctggcgtcatcaagcgctagtggtatgacatgccctccattttgctgtgtgatggtgaggcctggtgtccctacaagtgtcttcaggccctgcatccaccactgtttgcactgtttaccttaaacttcttcaggccctgcatttacactgtttgcactaccttaaggttttaccctactattgtagttaccgaatgcataaatatagcaaacactaatttccaggatgtgatttacagtttatatattgctagcagttagtgacacagtatttggacaatatatattttatgttaaatgaccaatagtgcataacattgtttaaatgcctaataattattttgaattggatacctgtgcaaattttcatggttacataatttacttgtgggctacagtccacttaatgttctttgctgctgtcctacctgcttagatttgatgctaccttgtatgtaacatttactgttaataatgaatcaacaggttctgaagaggaagagtgctgctctcaataacgagagtgcctctgttggtcccatacgcaaaatgcatcagaggtacaacagagtgtcaccactgttgcaaactcggtcaggccaccgtggatatagtggtagtcatgctagcaaacttgatgaaggtttggaacactcagtacaaagtcaaaaacgtaggtgtctggataaagttggtgatattactcgaagtggtgtacatgacagagcaaatgatagcagttttggtcaggcaccagcacagtcaattcaaatggctgcaaagatattgaagcagcttgatacgataattccttcacagaaggaaggcacattagcaacaaggcaaaagcatgtggacatcttagatgttgaggatcctatttctcagaaaactgaagtatcagcacagggcagtcttttgaaaccatcttcgtcacgagttaaggagtctttacctaataactccaactgcgctgctaaatttacctccgccgcaaaagacagcaatactgttgatgctacatctgacaaatcagctaaattgatgcccaaggtaatgtttggatggcacctttttcctcctagggtacataatattttatcaacatactgacattttctttattgtaggattggttggagatggataactgtaggggaagtacaaagttgtcactcaaccaaggaaatgataaaactgagagaaagcaatcaccaatcccagagaataatgatatgagttctggaataataaacaaggagaaacctccaacattgcctttgagaagtcatgctccttcaaatctagtattatccagtgaaattgaccgaaacaaaatcctagcatcatcaaatggcttttcattcccggttccggctgctctgactggccattctcaggcccctccaacacctactttggcatctccacctgtactatctgttgagaagcagcagctgtctgcatcatctagtgcaccagttacttcagtggaaagtattccaaggttagtttctgatcggttgtttgaactgatgtagttacagtcaaaagcatagttttaaatttgaagtacctttgcaatgaaaatgggcaatggttaccaagtaggttaacacataagtacttatgttatcattttatagtgttttttgacttgattgtcgttttatagttgagatatggtagtctgacacatgccaattatgcttcagtttccaatttatgaggatactcacttatttccagcacattaatctgacatgtctttttctccagggttttcaaaccagtttcagaagaagcctcagtttctaaccaacgtgatacaaagtcgaatacagataaaccaccaatttctcaaagctctgggcaaattgtttctttcactagtaatccagtatttaacgtcatctcctcaaaaccaacaaccttaagcaatggcctggcagatacaacaaaatctgcttctgctgctgtatttccttccaatggatcaaccaagtcagtttgttctacaaatgctggctcttcaacaccttcgttcccaaagttctcatttcagcctggattccgaacatcaacctcttcagtgcaatctagcggtattcaagagcctgctataacagctccattcagcactgtgagtagtttagctgggggcagttcatcgccatcctcaatgatatttgctggtgctacttctcaatctagttccatcaccaccagtggcagtgttcccttccaattctcttctcaatctagcagtgaaagttcattagctggccaagacaaatccaaggcagcaagcagcagtgccccttttagtttctctccacagtttggcagtacaagtccgtttgcaggccagggcaaatccaattcagtctcctctcagtctactttgctgtctggaagccaatttagcaattcactatctgcacagacttcaacaagcaattcaaacctattatcttcagaaaaagtaaatcctgggagctcgccaagctttgcatttggttcatcagcaccaggctcaagccctgtgttttcgttagcagttggttctggcactacttctgcaacacctgcttcagcatcttcaccaattttttgcaaccgtttaactagcacaaatgctccaccttttggctcccctgccacttcaccttttagctcaacctcgagccctgtattctcatttacctcagctacgcctacgataccaaatgcatcacctacaacaccactttttggtacaccgagcccgactgttggtttaagtacaggaactgatcagatgaatggaggtcagatggctggggacaagaacccgtttgctttttcagcagcttcaccctttggtcttccaagcagttcaccatccactccaactctgtttagtacgccagcaactcagtttgcttcagctacatccgcttcaccgggcatgttccaatttggccagcatagtcaatcatccccaggtggcttctcaataggcactactggtggcaacagtgaaaagtctgcaagaagaattctaaaagttaagcgaaagaaataagtcacttcgtcctctgtcaaggacaaggatcatgagaacttattacagcctgcattgcaaattgctctggtttttcagggctgaggcgatcggcaaacagaaattcacatttcttcattttataccaggagtgtttgcctgagctggcaaagatgccagtgttttcttttggctgatccgaattttggcacatgagctatggaggtacccaatggactgttttttgaactgaatttttgtatgatttatcctctcatgaaccattgcgaatttgttaaaatttgaatgtcatctgttcttacaaacctggcattgattctgtgtacctcttctactctattctcccatatcgatatatggtcgaacgggtacaatttcatttactctatgccactacatggtcgcatcatatagacgaaggattcctattcgtgttcagatggaaattggattgtagggacaagttatgaagatgaagcattctcgtgtaccatctcatgtatttaggttttaactttttgtttatttcctgtcattcagaattgattttggctcacggcacgagcacgatggcagaaacaccaggaaaaaattgttgaggtgggagtaattgtttccttttgaaagtacgcacatctcaagatatatacgtgtcaaaggtaggtacataggccagatagtggacagacgtacttctgatcgagtacatatacatccagttccatcctctaacaaatctcgtccttagactccgttagattctctaacaagatgaatattaagtgtagcaaaagtgaattttaattattaaaaacttgaaaaatagatttaattgattttttatagtaatttctatgtagaaagttttcgcacgatacaccgtttagcagtttgaaaaacgtgctaacggaaattgaggaaaaatctataccttgttggagtttagtactcaacaattaatcttctgagtaatatcacatatactgagatgagattttgaaccatggtcaaaatacatctaccacaggcataattcttgcttctacccaaatacaaagcatgaaacgtaagttcattaaatcagatgttttctgatccttagatctattcatccaacggctcatactaagagttggatctgccctgcaattagcgatctcccacgtcttagcagcggttagggatcgatcaaagcgaaaaagaaaacgaaaaaagtttcttcgctcgccagcccgccgccgaccgcctcctgccgaagccgctcgccgcctcctcgcgtagtcgcgcgccctacctcgccgcctccttgcacgcaccgggctccgccgccgactccgggcgcgcgcccgccggagccgctcgcgggttcactggcagaaaagcacgcacgcaatttgtaaccccgccgccgtcgcatgccatcctccgcacgtcgctgcgccccccgtccccctccaccgctgacttcgccccatggtgcggccgctacaagccgctgcagccccgtcgctcctcctctgttccctcgcacatcgttgcgcccggcgcccctgtcccctccgccaccgacttcgccccgcagcatggccgctccaatccgccatacctgccccgcgtcatttgtcgtccacgcttccaccagttcggccatatccgacctccagcctcgccagattggcgccgccgccgaccctaagctcgtcgtcgagcattcaccgtcgccccatctgccccgtgccgatccatccctagcgccgtcgccgattcaccgccaccaggtcacgtccatcgtcttcttgatttgctccttccgcttcttatttgtcctttcttttgtatttgatcagaaacggcaatgaattttattttaacacagagagagagagggggtgggacgggggaggggaattgattgaaaaactgaaaactggagtttgttctttagctaggcaccaaagatttctgagagtataattcaccttggccatgtacagggcatcacatttcacatttgtaatgttgatgggaaagctacagataggggcagagagtaactggagaaaatagaaatagaaatgagtagcgatgttactagtgtacatactttatgcaagtcaatgaggatcaagagaaggagaaggtggcggtatcctagctaactggtcgtctcgtggaggtaaaaaaaaattctttgattccagcgaacctatggctatgtttcgttgataacttctaaagatcttcctgttgttcatcctgctatatatggtgttcttttaagtctttcctccaatcgcctccttatgttctactccctccatttcacaatttaagtcattctagcatttcccacattcatattaatgctaataaatctaaatagatgtatatgtctatattctttaccatcaatatgaatgtgggaaatgctagaatgacttatggtgaaacggagggagtattataccagtggtgccgtacctatggctatgatgtgcagtccatatatagaatcaatcactgaaaaaaatgagtttagataagtcacagccattaggactatattaaattagtgatgaataatgtatttgcacattttgcagaatcatggcagtaattacatggtcaggttgtgacaaaaaaaatcagagatacctatgctcacgttttgatcaatgaaccagttgtagacattctcagattttggcaaaaatgcacaaatacactacaaactcaatacacattctttgaatttctgagtacagacagcgaacacattcagaatttcagattgcttcatcagtcatcacagagcacacaaattcagaaaagccctgttgtgagaaatgatgattatcgacacttcttgtgtcttaaggtagctctccagcctctagccacttgatggtatccaaaacaataagatttgcgggctaatcaagtagcaacaaatcagtaccctgaacaatcaatttaagaatgtaaatgcacacaaaaaacagaaaatttcaattcgatcactaggataaattcaaaaatccagacccaattcataaaatgatatagttggtacgaaaataatatatcttcaaacgatatagctagctcttgtcatgattctgatggtcatttaaaatatctatttgtcaagattttacaagtgaacaggatcaatggcttaggttgctttcctttgaatgtagatgcgcgtgctggcatgatatttagaaaataggttttcccttgaatgcacattttattagttaatttaaatgaacaaaatctttatgtattttttcattactttcgagagaagaggacactaacaaaggccaatatagaggtaactttctgatctttatatacaatggtgatcctggcggtggctatcctacccatgacgaggctacccaggtttttgcttgactccctgattgattcagattcttgttgccaaaccattctccttcggggtatcagggctactccagcgaggagcagcagccaccttactactaccttgctgtcgcacaatttctgttcatctgtttactggaagttatgctaattgactaaaactgtgatggtactacacactgacttgacaattgacatatgtattgcctacaatgatggtttattggtgatcatcttcctttttatcatgatcttgtttattatttttgtttatggagtaacaaatggattttgtcgttgtcaaggtagataagagggacatcatggcattgcagggtaagaaagcataggcaccaagcaaaatcagagtttagttacgtttgtcaatgaatgttaattcgtatttatatgccttgatgacctgcttctacagagatgggattaacccatgatgcatatgttctattgaataagaactgcatggtctattatgtttatttatgattaaatatgcttatttttcttcagagcaacatctaaccaactatgtataatctaagaaattgagacatatccctattgtttcaaatttcaaagagtgctatgttaatttccttttcttagattagtacattctaacctttatttgtctgcacataccaacaattcttcttgcattaatgtatagttcttaaattgacataagctttatattatgagtattacacattaaagaaagcatcttatatcagaccatactcaggcttttatgttaatttcttaaatgcaaattaatatggtgtttggttattcaaaagaaaatggaacaatgaaaacaaacgtggattttttcacaagaatttcttttttctatcgaagtgtcattgtcgtgctgttatgagaggaaatacttctctctgaatttattgatcatggcaaatggacatgtgaaattttcgtatgaatgaaacaacagaattatatttttattttacataccacctgtgatgctccacttgtgataatctagattttctatttattttatttttattctcacattgtcattgaaatgatattgtttttgatttacatatatgcacatgattcctcacttcacttccatgcccccaggtcgctacacccatcgccgccgttgccagtccggatgccccagtgaggctggtgccctcgaatgacaccacaagcaagtataatacttcatccattttcttaaacatgctctctatttgtaattcccactcatggaaaggctgctcaaggtcaagaaaatgtaacccgtgaagagactaatgcttctatagtcacacaaacctgtccaggaactaggataggtaccatgtttgtttccataaattgtggatataaactctgttaggtatcatgtttgttctgtagtaggtgctcgatggaatcccccagtgaggaaatttgttttttgttctgtaccagagaaaaggcagcgaggagatctgtgagtgaaaaaaaataacagttcaatgtccaggccactgttaacgatcaaatttggtaagccatgaactagattcggcatcgggatcgaagcggatttgatagggaattgtcttctggaaacagagtacgcatcggctacgagggcattggctgaagactgcatcggctaaatcagacagaagacagccgatgtagctgatctcgttaaggtggttatataatcgtctccgagattgatcaacgtgctgtgcaaggattaccatgattgagataagcacacggatagacaattgtatctattaattaggatattttaaaaagtttatttagacatatgcttcggcaagagtctatcgtgaagacttgttcgtatcttagagtttgttagagataagagtcgtgttcggcaaggaccagtcatgtatctcgggtataaatataacccgatcccatgtaaacatctaacgacagtttaataacactttcggcgcatcgccacctttttctattttcattgtttcgacgagttcttgcttttgggttgagctgcatcaatttcgatcttcaacaagaggtaaaacttgtcatgacgacttgtgttctcgggattagtgcttacatctttatgacactctaatcttggttatgtaaatcattgagttatcatatatgcttcataatatttattaatatcataatctaaccctaaaccggccaacatctatcattggaaggcagctgatagagttagatatcgttgttaatctagattatatagcatatctaccatctttcagaggttttcatcaacctgtttagatcttgtatttatttttatgcttaatgctgcatcggttgagtttgatctattaagtaatattcataattgcaatatctagcttgtcttatgatcatcaatagatatagtatcggggtttcagccgatcttacctgatttagttacctttaatgcttacatgttcacttgatatgctaaatctgtcctttatattaagatcttattgcattaaagtatattagacttgtcgtttgatatattttgtctgttttaatatcttaataaagagtgatatcagagtattagtcgatacatgttagatctatttgatcggctatgctatgaacgtatatataatcttcatcttaaagtacctttaagcataagtgatttatattgtctcgacttactgttcgatctatcccaatcacttggcttaaatatatctcgagaagaggattatatatcgttgatatctatagccaatcgagtagatttaactttatattgctttattcttcattgtcgatctaatgccagtaacatcggttcaatgattaacgatatgccatcggcccttagccgatcggttatcgtttatggatttaacctcgtctttcttgtttttccttcttgttgattgcaagatcaaatcaactggcacgcctttgaacccaagagcaagatttaggacatgcactggagttaagcagatctcccaggccagtgtgtgttttttcgcatcaacagccacccctttatatttacaagttgtaacttcctcttttgattgcattcagttgactctgcaaagtactgcatcactaacgtctgtataaacctaaagttgcattcaagtgtagtgtttttgaacttgttgtggtctatgagctttattctgaaggattatactgatgacgatatattggtgtgctttggatcaggaaggctgtctcatcctactggtcagtcaaggggaatctaattggtagtataaatatcagagaattaggtgatgatcaggttcaacatcacagattcagatattctcactttctgtgttctttaaccagtggcacaatgtgtgctatcaatgtaattaaaatatggatttctatatatgtattgctctttggattatttcagcatttcaacgagttcttaatagacctttttttttcatctgtgcatgcaagaggaggcaacctacttgggatggtggcacctctagccataggtttggaggagggcaacaagcagatgcaccaaagggagctcaaatatgaggaattatgtggcaaaaatgagcttgttggagaggaatctttgtagatatgacataagttcaga

SEQ ID NO: 5334 - DNA, 5363 bp, Oryza sativa
  unsure (1)..(5363): unsure at all n locations
nnnnnnnnnnnnnnnnnnnnnnnnnnnnnnnnnnnnnnnnnnnnnnnnnnnnnnnnnnnnnnnnttgggattccatagaaaggaaatgtatttaacttctcaagaatatattggcaaatataatggtgtttaacttctgttgtatgaattgtacatgcactaaaaagcatataaatctgctctcttatgtgtggcttcccaagtttgataaattgcccaatttgttctgtaactgcaagatgccatgatccagttttacatttatttttctatacgtatgctgatattttgtaggtaaatctagatcattttattgtgtttatttttcctaaaaacacgaggaatcgtgatgatcataaagacaatagcatcgtacaagcctaaagcaaatgttgatattgacattttcccttttgaaaaaaaaatcataagttatgtatatttgtgacattttcaagaactagaatgtgcataaggatttgctagaggcagcaacaagatacctttttttgaagtataggacactgaatttaacaaggtgaaagcccataaggatcaaatctgattttgttttccttgtgttgtttatgaaagaaatcttatataatctggtatgatcaaatgagagtataggacactgaatttgacaaggtgaaagcccataaggatcaaatctgatttcttttcccttgtgttgtttttgaaagaaatcctacatgcttttagttcacatatctagctagggatctcacatgtatccaatagtcatgaaacattaatttgttggttgcagattgctaaggtgacagcattgttttacaattacatttttttaatagaagggataagttattttgtaactatcacttaataattgatatgtttctatttgcaataatatatattacgataacgtgtctttgcacgtgcacgttcactagtttaataaaaaagataagagaacgcacgtactgtatatgtttagtgatgcacatgaagtgatttgaacgataacagacaaatgtgggaaatgtgtgaaatgccctcaaatccaaattccaatcctagaacgtgctcaatcaatgaggggttcatatatagattatagcataatcatagaagatacctgcactctatttcttcaccaataactaattcccgtggaaaattgtcttctgccttaaaggactaggatttggctggctcatattttggattgcagttttcggtccccgtatagaatattctttcggctaattaataaaatttttgaatttttttaaaaatttcaaggtggaattttttccatccgaatttgtcttgcccatctgcttacccatcttgaattttggattgcattttcggtccccgtatagaatattcttttggctaattaataaattttttgaattttttttaaaaatttcaaggtggaattttttccatccgaatttgtcttgcccatctgcttacccatcttgcctatatggacgtgactaggtagagtgcgggttcagatctcctggagttgtggacgaccccaccaggtggatttggccaaatatagaccctccttttcttctacggctgagatcatatctcttaataattattataaaaaaaatctaagttttgcttctactccctccgtcccaaaatagctcaatctaggataggatgtgacccatcctaggtaagttatttttgggacagagggagtacgtccttaggcgtgtagcctggcgcagcggccatggcttgtcagtggcacgcggtgccgacgatggccagtgcgtggcctcggggatataccatacggttctcctgatgaaatgtgttgaatgttgtcgctctgaattgctctaacaagtcatgttgtgtgtggagaaagagatgcatgtttgattagtttattgcactacgtattgatttgttctttgtggaaagaatgtgccttgtattctgtttagcgagagcgtgatcataattatggaggaacacctgaaaactttccctccaaatcgacactaataaatgcaggggaggggggggggggggggaggatgccagctgtagaagcaaacggagggttcagatttagccaaacctatctggtggagttggcctcaactccaggggatctgaactcgcatggtagtgctttagtcctaacagtagaccactccattccatatataattctccctttagtatatggtgcatgtctttttttaacatctttaataacttatatcttttaaattacatattatcttcaagatatatttatattattgtactctacataaaatatatgataaaacaagatccatgttgaatatatttaaacattttattaatttaaaagtaatttatttaaattgtaactctctatagattagaagcaactaagttatgactgagttgaaataagaaattatatgtagagtaaattcacgagaaaaatgtagagaagatttttaattaaatgcatttatgaaagtaaattcaataaagtcttaaagtaatttacataaatcataaaagcaacttaacattgtcgatgtttgatgtcgcgattccggtatttgcatagtatggggatcgttggtactaggatatatgctagattgtaagaaaagagatagggacgaggatttttatacaggttcggacccctgaattgtcaggtaataaccctactcctgttggctgaagccggtcgttgctcttattcaccataatcacaccagtacaatatttggggtagcctatctaactgttgtcgatctggcggtctaaagtgctgactcgtagtcggtagccttcctcctcgaatccacatccgacgagatcaaagacaacgctatgtctctcctgacagtatccgtagacaccgtaggggactagccatgcttatctctgaagtcgatatccagcgtcttgtcttggcgcatgttggcttgtatgttcattttgtgtcttgatctattgttcagtgtcccctctcttcctagggggccttgtatttatacccataggtgtcctcttgtccaaatagaactagagaaaccaatatggatacaatccgagtagtccttatcgtttccatgtagaactctattcatccttccttatgcggaactcctcctatatccgaaggttgtttccgtataagacatggtatgtggtgggtcctgccgagatttagttaactactattaggtatatggtatccataaccttgacaaacataaaatggaagtaagttattacaccattagaagtaaattcgttggaaggagaaaaatatggtctatctaaaaattaaatttaaagtccagaaattatagaattgactagaataaataataaaaataatcattttagagcattatgaatgtttaagaagtaacttagtcaaatctaaaagtaatatatatatatatatatatatatatatatatatatatatatatatatatatatatatatatatatatatatatatatgataaaagtaacttacatatatcataaaagtagttttacaaacataaatatttttgcatcgtaatatattcatgcatatttttcttggcagaatatattcatcgtaatatgcttaacatttttcacagaatattagagaactagcagtgctatgataagggcagccactcgagtaaagttgtgggttggagagaggtgggagcaaggtccactgcgacgactagcagaggagagatgacgtgatttcgttgccgtgactagccaagagtagaggagagaaatatggaatggggtcaaaaccataaggctttggtctgggctcgaagtttcgttgcttcagctccagcaataaaaaaaatgcattggtctattgtaacagccctccctccagaacagcgtagcccaccccaaccgacgagcgggcccacttacacacaccaccccacttacactttcgtcctcgtttcgtgtaaaagggttaacccgggagtgatgtggttggagggaagatgccttataagtcggttccactcgtgctaatctagtaaggtggtactaaacatacgcacacagctcacatgggccacacaggcatacaccccccctcaaaggacccgacgtccccgtcggtccaacttacccagccacacaggcaaatgtccaggaacacaccccctcttagcgcacatccgtacgtccagtgtcgatgccatatgccatgccttgtgcctcacacagtgcgcacatgcgccatgcgccatatgcccgcacactgacccgtacgcgcaaccgcgagggtcggctctgataccatttgtaacagccctccctccagatccgcgtagcccagcccaaccgatgagcgggcccacttacacacaccaccccacttacactttcgtccttgcttcgtgtaaaagggttaacccgggagtgatgtggttggagggaagaggcctcataagtcggttccactcgtgctaaactagcaaggtggtactaaacatgcggacacagctcacatgggctacacaggcctaatccttattgggccgggatgtcacatctattgcttagaccacaatctaaacgataggtttacggtctacagtcatctaaatgttgtttaattgtgtggtctagatggtctagttgaccgactagacggtcaaacggtctaattcacagtttaggtcctaaactagacgataacccgtcgtctagcgtctagacgcggtctagaccgtctagactatggtctaagtgaacattgccttgcctccgacgatccaactcataacgaactgggaaccattcggaaagctgctttcaaaggtaaaaatgaaaatcatggcagatatgctactgattattgttggagtttggcttcgtgcacaagagattgccaaaattctcaggatttctagctattgtttttctttcttcaaacattatcatgacaatttggattatacttgagatataaatttcagaaaacacccaagcgtagaaattcaggttagactaagaactgctagtggaacctagctttaatggtgaactcgtcatctctaacatccggcgttgctgctgcagtggtgggtgtcactagaacggataccctcatctcaatcgggtggtaagcccatctcaatcgggcatggcgtcactgatgtgaagagctatctcaatcgggcaaacggccgtcatggatgattctatctcaatcgggccctaagtaaagcccgtcaccgatagctttgacccagacgaccagtcaaactatagcccgtcacagatgacctatctcaatcgggccacaactagcgcccgtcacagatgacccttat

SEQ ID NO: 5335 - DNA, 1579 bp, Oryza sativa
agatgacttccttgtgacggcccactatttctaagcatattagagcccgtcacagatagaaggatctgtactagtgtgtaacacatacacacgaccatgcatgatttggaagacggtcatgtatgacattgacagttccaaacctttcacttagcccatctctagaagtgaaggatgctgcagaagtaattataaaggatcaaagcaacttgcacaaataatacaatgatttacgtggaaaaacatcctcgagatgaggagtaaaaaaccacgggacctactcggccctctccaaaaattccactatttgataatgacagttacacaattgtcaatggagttctctctggattacactgttggacacaccaccaaggccaacaccgtattaagctagtgaccacaggaagcacaacataacaagatgcacaatttgcgttttattctgtccagcaaagcagcccggtaagaagtgttgggttacgcgtaggctacgatagcataaatcaaaattttctatcgcgtaaaccaggaaccatgcaagtattagatcatagatcgttaccactcgacgcgctgcgcagcggaagaagacgctgagaagtcgaaggaactctcgcgaagtagcgcgcgtcgatgtagaggaagtagtcgatcgcatcagctcgaccttctgctcctcgtgcgttctcctcaccgtactcccacgccgatcagcaccacaaaccagcggcgcctctaccggtatccacacgtacaaggacggaacgccacgcgcagatgtgctagcacccgcgtgcggctaattttttgctcggggagggaagtgatggctagggtttctcacgtgatgcaatgcctccgccggtcacacccctcacgaatatataggatccatcactcgggcctacatggcccgtaggactcctattcggatccctatccgaattaagctcatattggatctccatccaatccccttattccggcccattaagtgtgcgaccctttaggttcatgtatactcggctgtaacccgaaaactccttttcggtccacgcgtcaacagtggcccgtagcagaacgtattgacctaccgggcatacataaagatcatatcggctgaacctctactgtatacttgtatgaacccctttgcctcacgatatcgattaagctcaaggctagatatgtgccatcctctaatagctcaatcattcacttgaacctgttgatagattatataacttgtgattgactactcaatcacctttggcatggtcatgcacttccataatctacaacatcgaggggcccagagatatctctctataggaggggcaaatcccatcttgattattcatatcccactacatgtttcatagcatacccaaaaactacttttataactacccaattacggagtagcgtttagctgtccctaagtaagctactacacatgttgggaaccatgataatatcaggtctatggattcaacaccaacactaaatgagatcactgatgacacaacacatatggctcttgcagtgtctcatgttgggtctattcaacaacatg

SEQ ID NO: 5336 - DNA, 1011 bp, Oryza sativa
acgtgataaggagtgggtccaggtggctgggtgggttggatccaggattgtaggattgcaggattgtggatgaactcatactttttatattagtagagatgtaccaaacattacataagtttgtttggtgcgcggtatctccacatgtgtacttatctgattgcaggctctatctgcacccacgtccacgtccatacatgcaataatcatgtggtttatgacaatcaaacggctcaccgacgtgttgttggttaacgccaaatcgtgcgcgcgcacactaatcaaattttgcgattatggaacggtaaacgttgcaaggcaggcataataattgtactagctgacaacagcaagtagttaccgaagccgtccggaaagacacggcacagaaaaatgaagttacggaagagatcgttttctttcgggtgagttttgcttcgggctcagtttagttctcgatgttttaaatcatccaaacaagtcctccaaattaatcatttgggttaatatagtctttggacctaaaaacaaatgctacgtgagtatgccaagtcatcctcgcatgcagcgttatgaatgaaattagcattctacccttatatatcatatcatatagaaaagaaagaaaagatacaaacagaaatcgtaagtgacaaaggaatttatacgatcagtgcttggctacagcaatcgcaagtgacaattctataacgatcatacatgtgtgaaacaactatcttctttttttctttcttttctattggtacataagggtagaatggtcatttcattcataccgttgcatgtgaggatgatttggcatgctcacgtgacactttttgtgggtccaagtactatattaacccaaatgattaatttggagaactagtttagacaatttaaaacctcaagtactaaactaagtccgaaacgaaacttcagagaccgtattagctattcacccttttcttttccccacaagctcttaatggcctctacgtacccttccat

SEQ ID NO: 5337 - DNA, 9475 bp, Oryza sativa
  unsure (1)..(9475): unsure at all n locations
nnnnnnnnnnnnnnnnnnnnnnnnnnnnnnnnnnnnnnnnnnnnnnnnnnnnnnnnnnnnnnnnatcatacatgtgtgaaacaactatcttctttttttctttcttttctattggtacataagggtagaatggtcatttcattcataccgttgcatgtgaggatgatttggcatgctcacgtgacactttttgtgggtccaagtactatattaacccaaatgattaatttggagaactagtttagacaatttaaaacctcaagtactaaactaagtccgaaacgaaacttcagagaccgtattagctattcacccttttcttttccccacaagctcttaatggcctctacgtacccttccatctgggaattgaactattgatgtataaaattcctttgaaaccataatgtgatattttgcatattccagatagggcgcaaattaattaggaacaaagctaaatttcggcggagtacgtaaacatatctgtgtgagctttattacatagtttaattgatgagataactatcagtaaaatattggtcctggtaaacgtattgactagaattggtccatcgatcgatcttgagataatatagagtaatttttctctaggtctgcatacgcatgttgttcattatcgtgcgtacgtgcatcttattacgtctgataatttgtgataatatataattcagggtaagaatatcctgctgtgtgctgaccattgacttctttaggttggattaatcataattattgtttcgcttatgttgatattataaaccttacaggcttataatatcatcattattgtttagcccaaaaaatggaaaagaggttaggaaattggtctggttgttctgtctctcatgcagggagagctgtacatatcaatgcctgtctctcatcgattccctcgtatgctatggggttctatcagctgtatgaggggattcatcagaaatttaattcaattcgaggtagatactgctgggctggtaacaaacaagggagaaaataccatatgatgaaatgggcagatttgatcttcccaaaagagtttgtagggttgggtcttactgaaactagaatgtttaacattgctttgttggctaaatggttggttaaggttgaatctcctgatggtagtctctgttttgagctattaagaaagaaatacttgtgttctgggggagtctttcagtgctctactgaaggtgcttctcagttttggtctgggattcttaatacaagaaaatgaatgatgcttggttctgaattgaatagaagattggtgatggttcccatatttggttctggctagatgtttggtatgggtcttgccctctgaaaacaagttttcatgagatttttgagatatgcaaccaacaatcaatcacaattctgagctgaaacagataggtataggtggtttatcttttaggagaacttttggccctctggaacttgaccaatggcagcaggttaggacaatcctagaagagctagagttgactgactctcctgatattttgaaatggggtttgacagctagtaagagatttactaccaactctttatacagagctatggcttttagatgggtgaaagatgagatgctacaactaatctggaaatctccctgtcccataaaaattaaacatttcctttggttggcaagtagagataggatccaatcttgtgaacaattgaaaaagaaaggttgggatggttcagaactttgtatgctatgcaatactattgaatctaccaatcacattcttttaactgtccaatggcaatttttgcttgctgcatttgtagagatgttgtgaactgggatactgtcccctgcagctttgaagagtttttcttgctaataaaacataatgcttgtagtaatagaagagctttggtttctttgcttgctgctatctgttgggttctttggaccacaagaaacaatatgatattcagatctcaattggtgtattcccccctaatgcttcctttttgtattgcttcttatttgctgcagtggaaggttttagggcatactgaagaagctagcacgatgatggttgtggcagagaagatgaagaccgctgctgccaactctgaaagtgataggctgggtattgggtgatagattagttaagaggttccctaagttgtggcactatcctctatctactgaagttgtgatgtttgaaatctgcttgtactggcagcccttttggttcttttagttgtgttgctgcttttagagctggtagtaagttttggagtctgtctgttttcctttaggagggctttgaccctccctacgctgtaaacctggtgtctagattttcccagcacaaaccttttggctttcaataggcttatgagcaataaaaaataattcttaatgataatatgtttcttagcaatttaaaagaaaatgttagaaaataaactacaacgaaagaaaacataagatcaactccaaactgatgtttaaaattcaaaatttgaatgtggcgtaattataagccgaagggtaatcagtgggtggctagctaggagcatgtcaccattgaaagcccgttaatggagagatattgaaagataacctattatcgtaccctgctgacaaccaaattaagctagttcaaattaatgaagtttggagccaacagttgatcacgcacaccgactgggcaactgacatgcatgcaatctctactatgggctccttcagaatttattccatcaattttccccttttgttgaatttgttggttggctggttatgattttttagggctatttttcgcaccattgactattgattagaaatacctggcaagctaagtaatcaatttgcatttgacgtactgtaaatctgtaatcagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccgaatttttgaattcaaatttcgatttgtaaatttgtcgcggttttgcgcggttaccgcggttaccgccgtaccgccgggtggcggtaaccgggcccccagcggtttttgaaaccctgactgtaatcgtatatctgttattgtaatggagatcaacatgaatgtatcggagttgacttgactcattgcatttagacttgcaatgcaaggagaatatatatcacatgcatcatggatatgattaattaaaatccttgtgctgcactgctggctaagctagttgctgggccattttacttaatttggtacgtacaaactgcatggagaaaattatttaatgacgttgtctcaggtgatttatatatgtgtgtgtttaactaaatcagaagctatatttgaccttacaagcacaagaggaataacggcacatagtttgaatgaactaatatattatgtcataccaccctccatctttgaagtcaatacagagatatgataaacgacgaatacggtgcatgttacctgcacgcaaaatccagtgatcgatacacacagatatatacaagtacatatattagcaagcttcagcatcagttgcctagctataaatagcgtcattgcctgaaattttccctatcacatctcacatcttaattcctcttctgaccaagatccaaagaaagttacaaagcccatatgatggtggcctcccctgtgaaggtggccgtcgtcgccgccgtgtgcgtcgtgctggtcgtgctgtcttcttccccggcgccggcggcggcgcagatgatctgcagcaagtgtgaccagtactgcaactcgtcgtgcgccggtgggatgggtggctgcagcggcgcctgcactgacccagcgtcctcctcatgcacgagctgcaagcaggcctactactacaagtgcatgaactactgcggctcctactgccgctccaactgcgtcaacagctgaaccaaatattatatgcgaattctccccctgaattagaagcttgttgctatggctccatgtagataaataagcgaatgctagctgcatgcgcgcttgtgcttgcatatggtggatgtatgcccctactatgtacaacttcatatatatatgtgaaagttgcatgtgtcttctgtcgaaaaatgttccgtcgtttcttgtacgtaactcggtcaatcagttatgaaagatcgaatgtaataaaatttaacagaatagattatgatctatgcgatatcactttacaaacatatgcacgtaatttctatctgcaagctgttttaaccgtaagtacaaatatatactccgttaagtagtatgcacatatcgatccgcaaccagtgggccgtgcctgcccagtctgtttgcatctccttcttgggccaacacctcatcttgtaggtcggcacgggtttggccttgccagcccatatactttttccatgtaattttctcaattttcccgatttccttcatatattcctcatatttatcctatctttccaacatattttctatatttcctaaatttttcccttttttccctcaaatttcagttttttgtggaccacggcaactggtgggtcggccgacagcccgttttttagggtttgcaattttgcccccacttttccaaaacaaacaagtcgtttgcccttacttttaacggctgttcgatagaccccacatttttgtgttacagaaaggcaaatgaaaaaatcaaaaaagtgtgcagtgaatagatagggattgagtcctctcctgcccaccgagtgtgcagtgaacaacaaaaccctagacctacacggcggcggcggcgagcgtgggacgacactccggcaagtctccggcagggcggcggccacggggcttcctacggcagccctcctaggcgtggagagtcagggcaacgtgacttcctgtggcaaccgctcccagacgctacacggcagggcaggctcgtcttcctgtggagagcggtggccaggcgcgacgagcgacggccagtcacggcggctagggcgtggggcttgctgcgcccttgcgcggcaaatggggtgatttcttatagatagaaaggagggaaagatacataagttagattgcaaatctcctaagtatttgaagatcttatgctagaaattctccaaaatgtagaggaatttctctatatatcctatgaaattcctttgacatctgtaaaaccaattctttcctttcctccaaaaaaaaatattacactagctatatcagccctaaatggagacatggactgtttatccatttttgaatatttatatgcaagcttacgtaaaacgacttatatttattaggaacaattttgttttgctcctactttaatgttcaattatggttttgctcgtgttttttttcgagttttgggttttttgcccatttttttcaaatgaaggaggtgtttactctttttttatggaagttagtggacccggcccggaaactggaattgttaagataacaaaataataagaataaagaggaataatcattttggaatttattgatttacctttctacccctgatatacgtaaaagaagaaaatgagagcagaaatctgtctcctcaatcggccctgacgctgtttcccctattcccgaaccatacggtccaggcgacgacagcgacctgcctaggtggcagtggccgggagacggcagcagcggtggcggcggcagccacccagccagcaaggtggccggagtagttggccgtggtagcgaaccctgtacatggcgggcggggagcaggtggcaacagcggcgactccgcaggcagcctcggcgatgaccaatgtgaccagcggcggggaggagaaggtcgcggcgatgactccgtaggcagagcgcggggagcaggcagcctaggtgaacgtgatcctgcagccgtcggctcgactcagcagtgaaggagcagcctgtcaaagtgctgtgactacttctgctagctgtgtaaaaagatgtaaaaattatgttttcttttactggaaaaattatgtttaatttctactatcaaatttgtgatagttctattgatattctgtcaaaattgttatatttgtcaaaggttgtcaaaaatcatttgattttaaacatctttaaaaaaaatcaagttcactagtacacaaatactcattggtgctggttagaaaccgtctataggtgccggtttcccaaccgacatatataatagcaaccggcacctattagaaatatacagccggcatcttaagctttgctcgagcaaaaaaaaaaaaaaaaaaaaaaaaaaaaaaaaaaaaaaaaaagagagagccggctcattcgagtcgaactcaccaacctcacatcccattcatcaccgcctcctggatcacatcatcaagaactcaacagcaaacctggatcacatcatcaagtactcaacagcaaaccaacagcgaaccaccggccaaacttaacaacaatcacattaattgaaatcctacatgcatcaagaactcaacaagttcacatacatttgggacatggatcaaggaggagaaaagagaggaagacctaaacaagaactcaaaaacagtgcgccaccgctgccgcatgaactaaacaagaataaaaaaaaaactaaacagtgcgttgccgcttccgcatgaacttgggccgccgctgctgcctccgccggaccgccgctcggttgccaccgcctgagagaagagagagagaggccacccgactgcctccgcctggccgccacccatggcctgccttctcccttcccgccggaccagggaggccgcccaccacccgccgtgcgccaccgtgggggctagaggtgccgccccaagcccgccccagatgcagatagctagaagggagagaagagaagaacatgggagagagaagagaagagcccgccgccaccctgcctccactgggcagccgctgcgagagagacgggtacagagacgcgagagagagagagggagagatatgcgagagataggaaaggcgagggagtagataaggacgcgcggtgggtgcagtgcgcatgcgtgcgcggatggtctcggctcgtcggcttggctcaaagttataggtgccggtttttaaaaacaacatataggtgtctgttctttaagtctttaattaaccgacacctataatatattatatgtgccggttcttttaaaaaactggcacctatagtatatgtgccggttctaacatggttaaaggtgccggttctatattttttcattgctcggaggtgggaaatgctctatagatgctggttttaaatgaaccggcacctatgagctagtccctatgagggttttttagtagtggttgcgagctgcatttacaatattagggggaaaaacacaactaatgcacaaataaagggacaattttgtaacagtaagtaaagacatatataccttttcacttcacaccgtcaacatatccctccaaaataaagataaaatttggctccgtttaaaagaactggggaaaaaatctttaaaaaaaacaggggcacatatccaagtaggggtaaaaataaaattaccgccactaccggagaaatgatctttgttgggtcactcaaaaatcacattagtcctggtttgaaaacacaccggtatttttttatctttagtcccggttagtaacaccaactgaaactaaatattaattttactctcgattcaaaaacatgtcaaagccctattttttagtcccggttggtgttatcaaccgggactaaaaatagatctttaatcccgattgtttataccatccgggagcaaattaagttaaaaaaaaaatagtgcaccaccgagccatgcgcgcctcatcatatttagtcccggttgtttataccaaccaggagcaaagttaaaaaaaaaccgagcaccacctagccgcatgcgcctcgtcctccccgcctcatccttatcccctccactccaactcttcttccagtctcatcctctcatctcccctccattttctctaactccttcatctcctccagccctccccctctcctccccttcctcccccttcccctctcctccccctcccccctccctcctctgacgtcgacgacggtgacagcgggcgccccgcagcgcacgaagcggcagcggcgcacggccggcggcctaccctccgccatatccggtgggagggaggccgggcagcggcggcctagcggaggcggccgggtggcggcggtcgaggggcggaggccgggaggcggcacacggccgggtggccggcggtggcgtgttttctgatttttttttgaatgatttgtaatttttgttgtagtttattttagatttgaggatgatttgttgtgcatgatttctgaatgacttgtggattgtggatgatttcgtggatgggctgagaattgtgcatgatttggggatgacttgttgtgcatgatttgggggtgatttgtgtgatttggggatgatttgtggggatttgagggtgataataaatgcaagaataaaaacaaaaaaaggaaaccggactaaaatggcgctagaatctttagtcccggggactaaagatccatttttactctgggttatttcatccgggactaaagatgggtatctttagtcccgaattggacgtctcggttcattacccgggagtaaagggggttgcgaaccggcagagatgcccatctctccagtagtgcgctagctatgtgtaatcataaaactatatctagttcccaagcttcactggcatggactatccaaaagtcagagcagatcagcagacatgttggcttaaatgaatcaaaagatctagcttaaactacatgcatggggtcatgaggaatgaatcgaaacacaattctgtgagattctttactcctaaaccaaagcctaccatccatgatgcatgttacttccacatgcaaattggtgatagaataagtagctagtagcaatatagtggcatcgaactctcgtttgctgcctataaatggagtcgtctgctcactggtggagaaaccatctttcgtcggtcggccgaattccacaatagtcccggttgcaataaaaaccggggctaaagatcactaaaaatgatctttagtcccggttaaaaagggtaacgggcatatttgatctttagtcccggt

SEQ ID NO: 5338 - DNA, 1689 bp, Oryza sativa
ctactataggcgaattcgagctcggtacccacattatatgagagattgtcctaatcagaagaaggtgttgatgactaaagaaggctttgtttctgaaaatatattaaaaaattcaaaagggggtccacttggtcatactcttactacgggctatcgagatattgatgattcatctatggatgatggtgctgaaaagaataatggtttatctatgcttgcatatgcagttcagcgagatggctctaatgttgatgcaaaggggcagcgctgtaatatttttcagtcagagtgcaaaattcaagagaaggtttgcaaattaataattgatggtggtagtttcactaatgctatcagtttagacttggtgtatgctttatccttgtctacacgaaggctttctccaccacgttatattcaatggatgaatcaagcgggcacacagaaaattactcataaagtgatagctatcttgataaagtggattgtgatgtggtgccaatgaatgcttgtcagttgttgttggggaggccatggcagtttgatcgtaatgctacccatgagggcagatccaactgttattcttgggtaaattggaaccatgccattataatttgcaaagtttaagatatgccattggtatctcaatgacatgtagaacccatatgagtcaatgacatgtgggtcaggatggcatatctcaaattttgcaaaattacaatggcatggttccaattttccgtattcttttatgcatcgtggtgttaatgaagtgttgaatccggaaccatgccattttaattttgcaaagtttaagatatgccatcggtatctcaatgacatgtagaacccacatgagtcaatgacatgtgggtcaggatggcgtaaaattataatgccatggttccaattttccgtattcttttatgcatcatggtgttaatctagtgttgaatcctatgcttgatattgacatcaaagcagagatatttcccaccgtcaagaagaagaaagaagtggctgaaattaatattaagccgaggatggctttgttacaagaggggaaggataatatgttctagactactcaagtaatatcagtcggtgatttgcatatttttataaagtctggagaaggccaaacaatatttcaagatccatgcagtgtaccagtgccaacagatggaattaaaatcgatgatatcaatcatcatggtgagggttaattagacctagataattagccaaggtcattaggcatcatggccacattattttaatatatgttggacctggtttgtaaaggcctatttagtcactatattaatttgtttattgagttgcagtcggtgttggtctgggcctgcgagcctgtgttgggtccagtactagtgcttgcatgcacgtatacatatatgttaggtattagcaacaggaggcagattggttttcctaaagttcatgtttagggtttggtccctgccgaactagctggtggcgatcccatcagcttctatctgaatattttgccgcctgataactgattggttggagaagaaacaagatcaggaagtcttacctggttttgttgcttggtacatgtgtgtgcctcctcttctattcgtgtgtgaaagcacgggtggattagattctgagtgctttggtatatcgtcatcatattttctgaattaa

SEQ ID NO: 5339 - DNA, 1518 bp, Oryza sativa
gcacttgtgaaaatccatgggaacaaacacgtgcggcagtggagccaagtggtacagggccctgttgatatttcttatgatcacagatagaatccgcaagcgcacggatataccgatgtaacatttcctctacggagtattccaagggtatcgaatccaagggaacgtgtgtgattaattcttcctccggttcatccaaggacaccaagcaaaggataggctaggatagagaggatttgtcctgaaacattgactacggatgaaggagcttcttttatgcctaaggaagtgaagacttttgctgaatcttatggtattaagttattgagttcttctccttactacgctcaggctaatggacaagccgagtctagtaataagacattgttaaagttagtcaaaaagaagattgaggaagacccaaataagtggcatgaagtgctttctgaagcattgtgggcacataggatatctaaacatggtaccactaaagtcactccttctgagctagtgtatggtcaagaagccgttttaccggttgaggtaaatcttggctctcttcgggatatcaagcaagatgatttgtcaagtgaagattagaagacattgacgggataaaatcttgatgaagtcatcgacaagcgtttgaaggctttggaagagatagagaaagagaagaagagggtggccaaagcatacaacaaaagagtgaaagcaaagttgtttcaagtgggagacttggttcggaagacaattttgcctttgggtactcgatccagggagttcggtaagtggtctcctagttgggagggtctttatcgagtatgcggaattgttcgagggaacgcgtattttttggaaacacattttggaaccatggttttgtgatatagtatgagatataggcgaacctttggtttctatcccgagatggacgtggaagagagcttgtagagggcaagaccaacccctatataagggacaaggtcggttcattgtgaaaagacaatcaataatcaatcaatcgaatcgtttttcatattgcttttattttttgcttagtttgtccatcattgtcgatttgcgccgtaaatcgtccgccgttactgcgagagtgcgacacctctttctaggtttatcctgaaaaccttccgttttatctacgagacaggtagttatctatagttctatctagatcggctctgctagccggtttagtttatcaaaacccatcttgatatagtgcttgctagattagggtggttggcgactctactatcactgcaaagctttaggtgttgcgatcgtgcttgtcgacttgtcaaaaaagttaccaacagtatgcattgctgcaaactgcccaacatcatttggtatggttagttgttctgtctaaataaggtgtatacaagtttcaaaactgataaataatccaaccttaccatttcacttttttttttacttcctactctggaatactgatacgtgttttcgtttagtgtgcaggcttcttggatc

SEQ ID NO: 5340 - DNA, 1462 bp, Oryza sativa
tcacgatatcgattaggctcaaggctagatatgtgccatcctctaatagctcaatcattcacttgaacctgttgatagattatataacttgtgattgactactcaatcacctttggcatggtcatgcacttccataatctacaacatcgaggggcccagagatatctctctataggaggggcaaatcccatcttgattattcatatcccactacatgtttcatagcatactcaaaaactacttttataactacccaattacggagtagcgtttagctgtccctaagtaagctactacacatgttgggaaccatgataatatcaggtctatggattcaacaccaacactaaatgagatcactgatgacacaacacatatggctcttgcagtgtctcatgttgggtctattcaacaacatgttcactaacatgtgtccacattattaatttggtatctctataccatgatccatgagacatgatcatcaattaatacatgtgttgatcatctaaacatatttgttccatatatgatatttgatcagggatcctttagaaatagcaacatataacataaagagtctcatgaaagaatcacatattcattaaccaataatgagtttatctatttcaaggaacaaagtcagataaatatgtaaacatagtgtgtgatacaatcatctctataatagcctctagggcatatcactaacagtctcccacttgcactagagtcaatcatgaacgtatcttatacccattgccctagtgtgtgcctcatgtttaggctgagggagtggctttgtcaatagatctgcaacattcaaatccgtatgtattttgcatatcttcacatctcctctacccactatctcgtgaatgaggtgataccgccgtaaaatgtgtttggacttttgatgcgatctatgctccttggcttgcacaatggcaccactattatcgcaatagaggttcatagggctagaagcactagtcatcacacctagttgagaaacaaatttctttatccaaacctttgctgcttcagaagcggcaatgtattcggcttctgttgtagaatcagacactgtatcttacttttccaactcacagcgcgtccattcaggcagaacacaaatccagactgcaatctaaaatcatctttgtcggtttgaaagcttgcgtcaatgtaaccatttaccacgagctcttcctgtcctccatagactaggaacatatccttagttcttctcaagtacttaaggatattctttacagctatccagtgactctcacctggatctgattggtatcggcttgttgcactaagtgcatatgaaacatctatacgtgtacatagcatagcatacataatggatccgattgcccaggcatatggaatcacactcatcttgtttcgctcatcagtcgtttgaggacactgattcttgccatgattaatg

SEQ ID NO: 5341 - DNA, 1037 bp, Oryza sativa
  unsure (1)..(1037): unsure at all n locations
nnnnnnnnnnnnnnnnnnnnnnnnnnnnnnnnnaagcactagtcatcacacctagttgagaaacaaatttctttatccaaacctttgctgcttcagaagcggcaatgtattcggcttctgttgtagaatcagacactgtatcttacttttccaactcacagcgcgtccattcaggcagaacacaaatccagactgcaatctaaaatcatctttgtcggtttgaaagcttgcgtcaatgtaaccatttaccacgagctcttcctgtcctccatagactaggaacatatccttagttcttctcaagtacttaaggatattctttacagctatccagtgactctcacctggatctgattggtatcggcttgttgcactaagtgcatatgaaacatctatacgtgtacatagcatagcatacataatggatccgattgcccaggcatatggaatcacactcatcttgtttcgctcatcagtcgtttgaggacactgattcttgccatgattaatgccatgtgacatcggtaagaagcctttcttagaatcttgcatgttgaacctcttcaacaccttgtcaatgtatgtactctggcttaatccaattagcctctttgatctatctctatagatccttatgcccataatatatgctgcttctcctaagtccttcattgaaaaactatttttcaacgatgtcttaacggattcaagcataggaatatcgttcccaatcaataatatgtcatctacatataggattagaaacaccagtgcgctcccactaatcttcttgtatacacaaggctcttcttcatttttgacaaagcccaacgccttgactacttcgtcaaaacgaatattccaactccgagatgcttgcttcaacccataaatggatttctgcaatttgcatatctttttagctgattgtggatcaacaaatcccttgggttatgtcatgtacacatcctcatcgagatttccgctgaggaaagctgttttgacatccatttgccatatctcatagtcgaaatagg

SEQ ID NO: 5342 - DNA, 544 bp, Oryza sativa
cggcgccggaggtgaagaagatgaaggccgatctccccgttccccgtgtctccggctgaggttcttgaggcttcttgaagaggacgtcgaggcgacgacggtggcgccatggcttgctccggcgtgctccggtttgacggcgacaaagacgatgtcccggtgatggcgtctagtcccggcagcccccacggcggcacggaccatagagttaggaaattaacgggggaacgacggaaaaggcgacgggatggcatggattcaatttcccaaaattccagcggcacctagccaatatcgtaaatagtagtggtatttttctaatttgatacatttacaatagcatggatccaattaaccctagtttttatcataggtcatttatataacaagttttgtggaagattcaaaatatcatttttttggcaatttatgtcccaaatatactaccaagcataaaaaaaataaaataccaattctatttctgccgtgaattattatggaagtaaagagaaaccgttcaaatgataaggaaggcaaaccttgc

SEQ ID NO: 5343 - DNA, 1671 bp, Oryza sativa
  unsure (1)..(1671): unsure at all n locations
nnnnnnnnnnnnnnnnnnnnnnnnnnnnnnnnnnnnnnntgtccagtgccagtgctacttattttaccttgataccctattgaatcttccatatgatcaagttcctaaacacatgttgctttatatgtggaatctgtccattgtcaatcctcagaattctgccaaagatggagatgacattcttagaaggtctgatagctatgacgttatggatcttgaagaactattgaaacagaggacattcacgaggcaagtacctgtttttgtataacattaataggctcatgtttagcaagtaatttgagcagtattagatttgttgctagcatttcagtaactggtaggcataggtaccgccgatatatcttttaattgcataataccccaaatacagcatacacctaaggaactgaacttgatctgcaatgatggggtacatccatgaagttcataacacagcatcacactattaccatgaaatgatttgtactaataataatttctatgtgaccaagaaaatataaaccatgaggctatagaaaacatgggtttccctaactggtttttctttttttaggagaaaaagaagtgtacttcagttctaaagctgggaactaagaaatggacagttgtatggcatttactttggtattagttagttgtagaaaataccattgacatttctggaaggttctgttaccttagataatttttcttacccgtgtcttctttttctcatacgtttgtttatgctaccacattctctcctgtaccttctcccttctttttttctcacttaccgagaccaattttctgtggtgaagttatacttcattgttaatgtcatgaaccgaggccatgatggcataaccaccactgggagggtagccgggcggcgccggctattggagaagggatgtatatttagactagggataagaagatattaaggaaagaaattatactaatctgattcattgcttaatgataatagacacaatcccatccttatatagattatataacttgatccttaagtaaggactcaatctaatctttgactgataatcttatctctatatgggctgcttatggccctcagccttttggctcaatgctcatcacaattaacttactttattgtagttccatttaggctggtatacattggagaacactaagaaaattgatacatcctgcatagaaaaagaagttcgcattttctttgtagcagttaatgcatcagcctgcagttgtatatgatttgcgtacatgatttgtatggagtagcaatgcagttgggggaacacatcttcttgatagttcaatcctcatttatcctttaatacttccatgcttctgtatgagttgaagtgcaatgccatgttttctttgctagatcctattgttgtgaatacctgttttgcctattgcattgtaacttgcaaatttgttttgctaatgtccaagtgtacagtagaaatgcgaaaacatatttctatcttacaaataattttctgtcttgcaggagtgaatttgaatatttgtctgagttgttgttatctagaacggttgggtccaaattattgattccaggagttggtaatnnnnnnnnnnnnnnnnnnnnnnnnnnnnnnnnnnnnnnnnnnnnnnnnnnnnnnnnnnnnnnnn

SEQ ID NO: 5344 - DNA, 512 bp, Oryza sativa
tatgttgtgcttcctgtggtcactagcttaatacggtgttggccttggtggtgtgtccaacagtgtaatccagagagaactccattgacaattgtgtaactgtcattatcaaatagtggaatttttggagagggccgagtagcgtcccgtggttttttactcctcatctcgaggatgtttttccacgtaaatcattgtattatttgtgcaagttgctttgatcctttataattacttctgcagcatccttcacttctagagatgggctaagtgaaaggtttggaactgtcaatgtcatacatgaccgtcttccaaatcatgcatggtcgtgtgtatgtgttacacactagtacagatccttctatctgtgacgggctctaatatgcttagaaatagtgggccgtcacaaggaagtcatctcaatcgggctgaaaagtgcccgattgagatatggtcgcatagacatgttagatgggtataaaacttaagcccgtcatggatgacacctatca

SEQ ID NO: 5345 - DNA, 729 bp, Oryza sativa
actacggatcaattgatatgaggtgcaccaatcgaaaaggcgaaagtgaaatacatgtacgaactcgataaaccgcttatcaagcctgagcagctgcagttcctacccactcaaatgtacaagttccatcaactgtacatggagatgagcgccaccggtagagagatgatcagagcgaggatcagggacacggacttcttgcaaggagatgacattctctggatcaatttcaagggtatctacgaactataccagctggacgccctcgacgtttctattatgagttgctgcattttgtaagtatcgttcagttagatttcttattacgtttcctttaaataattaggtccttgtatataagtagactatatataatatatacttccttttatcgttgtagaatggagattcaaagggcccgacggtggggggttttcgatactggattcatcgaccctcggaaagtaaacgtcacagtgctcgaccggtatctgcaagacacagaggacaatctcgtccatctcctgaaggcgcagcattacaagacgttcatactgttgccgtacaacacagagttagtttaattttactgtcttcctataccaaatttcattcccgtacaaacatgctaagtgtttcatatataatgcatcccacgcacattgcagattccactgggtgcttttactcttcgacctggaggcctgcaccgtcaacgtatatgactca

SEQ ID NO: 5346 - DNA, 240 bp, Oryza sativa
ttcattctcaaaaaatgtggcatctatggactcagtaattgtaccaacacgcatgtcgggtactccagaattttctattaagaacctatatcacacactgtggatagcataaccaaggaacacacaatctacggttttttgttcaagtttacgctttttgactatatgtacatttaccttgggcaaacaaccccatgtgcgcaggtgagagagatttaatttcttcctttcccattcctc

SEQ ID NO: 5347 - DNA, 1036 bp, Oryza sativa
gacccggagagaggagggggctcgggcggctggctaggccgtggccttcggccggcccagcggggaggggaagagaagagggaatgggccggcggcccattcgaaagagaaaagagaaaaagagaaaaagaaaaagaaaacgaaggaaatgaattttccagggattaaatattgcttgtgctaaattttaattggttaaaattatttctagagctctgaaaattccactaaaaatcttgttagcgtatttcgacacgtagaactcaagaaaaattccacatgccaattccgattattatttgcattgatttattagggtttactcttgttttacaccggtattttcttgagaccatttctaaattcaatttaggcttgggagaagaacttcaggatgtgacatgagttcatctgtgacgggctctagtttcggcctgattgaggacagtagtcatctgtgacgggctctagtttaggcccgattgaggtcagtagtcatctgtgacgggctctattttaggcccgattgaggtcatcagtcatctgtgatgggctatagtttacgcccgattgagatgagtatcatctgtgacgggctctagtttaggcccgataaaggttagtagtcatctgtgatgggcgctagttgtggcccgatagagataggtcatctgtgacgggctatagtttgactggtcgtctgggttaaagctatcggtgacgggctttacttagggcccaattgagatatattcattcgtgacggccgtttgcccgattgagataactcttcacatcagtgacttctagcctgtgacggatgctgtgtccgattgagatggggcttaccgtccgattgagatgagggtatccgttctagtgatatatgaagaaactggaatgataccattgtgaagatggtggactacgaaggaaaggggggaggggaggctcctacttaagcttgtggaggctagctgatggcaacggtggcatcctagcacatggcgaagtacgtggaggctctcacctttga

SEQ ID NO: 5348 - DNA, 2895 bp, Oryza sativa
  unsure (1)..(2895): unsure at all n locations
nnnnnnnnnnnnnnnnnnnnnnnnnnnnnnnnnnnnnnnnnnnnnnnnnnnnnnnnnnnnnnnttttgcgttatccacttaatgattgcggatgcctcgacaagcatctctactaccatgcgaacattgtacccagcccacaaaaggtcaatattctaactgcattacgtgcccaatgctactgactatatgctacctgatctgggctctgctttgctctacctccaccatgactgcgagaaatgcattgtgcatggagacatcaagcctgcaaatgtaatgcttgatgtgtcacacaatgctaagcttggtgacttcgggttagcaaggcttgttgagcatgggggagagccacaaacaacacaagttgtcgcagggacccctggatacattgacccagaattcatcaacaaccgctggcctcgcaccgaattggatgtgtacagcttcggtattgtcctcttagagatagcttgtggcaagcggccggcatcgaggcagctgccaaatggagcttcatcactgctagcctgggtgcgtgatttgtatgaccagggcaagattcttgacgcagcagatcagagactgaacggcgagttcaatcagcagcaaatggagcgtgtgatcgtcatgggtctctgctgttcacatcaagacccgatccagcgaccgtctatcgtgcaagctatggatgttctgtgatctgcagacgcagagttgccggtacctcccgcagcacatgatacaggacacatccggtccatgcaagaacaggcttatgccgacctgccagttgaggatcattctgtgcatactgtcacccgaagtacgtattttacttccaaggattcagtttatctacttgctgaaggataacgaattctctcttttgaatagcaatattagttatgtttacatgcgcctgtttagattgttttgtcaacaagattgctgataggcacacatctattttgttcatagttttgtgctatctatctatctattatccatctacacatgtagtataaatgatagtttcatatgaaccagctctattgttagcattaatcctgacttacatattttaaatatctgcagtagttagtcgtgtatgtgtgtcatgcacgtagtggagtattgcatatatgatgcatgcatataggagattagatctgtcacagccatgtacttggtgattagttgaccgagtaattagcttgtgtagttagttgagtgcggcaagttagcagatagttagttgcatgcatggttagttggacgagtgggtctcgtaatgcatggagttagtggctcatgtattcaggtagtgcgtgcgtgcgcatgaagaccggcaacagttcgtgcatgtaaggctatttaagccgtgctctgatccattttcagttaagtgtgtgagtcacagataaacagagaaaagggcatttgttgccgcaaagcttgcttgtgttccctgtgttcatctgagccatcgcgtgtgttgtgtgctcgcgtgagtttacgccgaaggtagttcgttgctccccggcagtttgatccctgggcgaaagtcaacatctattgttgcagcattttttttctcataaatttaagacgacgtgattcaagtaattttactttacaatttttaacaatctgtgctctagaataacgcagcctagcccatccaatcggcacgtccacttataaatatcacctcacatacatccttagtatacaagaaaaaaaatactccatccatcccaatataagcattcttagaatagtggcaaatcaaacttttaaattttgactattaatagcaaacgaacaaaaacagatcaatcatgtaaatttgatgttactagatttgttattaagcaaattatcataatgtgtaactttttttatttaaaacatcttacttttatagatattgttgatcaatgtagcatctcgaagacattgtcgaagtccaacaatgcttatattttgggacggagagagtattacttaaaattttaaattagagaaaatccataaaatgccatcgtacaagtctttttcttccagaaatgccatcgccatcaacgcaccattgattccacaccattacaaccataaatttgaccaaattaccctccgttcaaaattcctcctcatcgtcggcgaagcagatcttgactcccagcctgatgcagtaatcctgaaaatcggcactgatgaactgggagccgttgtccgttatgatacggtggggcaatccgaatctgcagaatatccctttgatgaatttgatggcgttgtcggccttgatttccctcgtgggtgtcgcttcaatccacttagtgaatttgtcgatcgccacgaataggaacctgcagccgccctatcctcgtgggaatagcccgagaatatctagcccccagcacgagaacggccaagtgagagggatagtctgaagtgcttgcgctggtagccttgtgtgtttactgtagaattgataggcttcacaccgctgaatcatgtcgcaggcgtctttaagggcggttggccagaagaacccttgtcgaaaagcttttccgactaatgtccgaccggcggcatgtgatccacggattccttcatgtatgtcaaggaggaggtgtctgtcgtcgtcggacgagacgcattttagaagtaccccgtttggtgccttcttgtatagatcgttgccgatcatacagtagacttttgctttacgggatattttcttggcttctgtgtcgtcctcgggcaactcttcactgcctatgaatttaatgagtggggtgtgccagtcatctgtgctctcgatatcggcaacggcgcgctctgcctctgtagcccccgagctgatgttaggggtgaccgggctat

SEQ ID NO: 5349 - DNA, 1323 bp, Oryza sativa
caatttggttgtctgacctgttatcaggcatagtccaatcggctacgaagtcggcaagtacctgggacttgatggctgttcgtggcacaaagcggatgtcaaattggcttagctcgactacccatttcacaatgcggccgagaacgtctttgtttctcactacttcaccgagagggcaggaggatacaactgtaaccctgtgggcttggaagtagtggcgtagctttcttgatgtcatgattaccgcgtagagcaatttttggatctgtggatatcttgtctttgtgtcgtggagagcgtcgctaacgtagtagactggttgttgcaccttctctctctcgacaacaatgacagtgctaacggaatatggcgtggcggcaatatagagaaataattcttcattaggttggggggcaacaagtatagggggatttgataggtagcgcttgagtgcaatgaatgcctctttggcttcctgtgtccatacaaatttgtcttgcttctttagcagagcgaagaaaggttgtcctcgctctcccatcctagcgacgaacctgcttaatgccgccatatatccggttaacttctgtacttccttgagtcttgtaggcgacttcatgttcttgattgccttgatcttctcgggatttgcttatattcctctgccagagacgaggaaaccgagtagcttgcccgatggtactccaaacatgcacttctctgaattgagcatgaggcgatatcgtcggaggctgtcgaacgtttcatgtaatttgagagaaacattcctttgatcttctactcttgagtatggagttagcaaaacaaagaaagatcaaaacaattgagtatggagttaccaaaacaaagaaagatcaaaacaatttagaagtttagttgcactaccgtcgtagccgccgacataattcacggctaagctgaatgccttgtagtaatgatggccttgtcaattctagttggatctgacaaggtagtgccccattacctagtggcgattgcttcattagtgtttgatactagttgaaaaccaaaatgctgaatgagggaggttgtctgaataggtggaaacattgatgacatatgagaaagcatgtggtacattttttttactacagtttaggtcttatcaaatctaattggatatgacaagggagtcgctgctcaccattacctagtgtccgtttctaattgttgaaagtcaaaatgctggaagagggtggttttttggaataggtgcaaacagtggtgacatatgagaagcatgctttttttttaaccaacagtagagcttaatccagtttc

SEQ ID NO: 5350 - DNA, 616 bp, Oryza sativa
ccttctccttctcttgatcctcattgacttgcataaagtatgtacactagtaacatcgctactcatttctatttctattttctccagttactctctgcccctatctgtagctttcccatcaacattacaaatgtgaaatgtgatgccctgtacatggccaaggtgaattatactctcagaaatctttggtgcctagctaaagaacaaactccagttttcagtttttcaatcaattcccctcccccgtcccaccccctctctctctctgtgttaaaataaaattcattgccgtttctgatcaaatacaaaagaaaggacaaataagaagcggaaggagcaaatcaagaagacgatggacgtgacctggtggcggtgaatcggcgacggcgctagggatggatcggcacggggcagatggggcgacggtgaatgctcgacgacgagcttagggtcggcggcggcgccaatctggcgaggctggaggtcggatatggccgaactggtggaagcgtggacgacaaatgacgcggggcaggtatggcggattggagcggccatgctgcggggcgaagtccgtggcggaggggacaggggcgccgggcgcaaccatgtgcga

SEQ ID NO: 5351 - DNA, 510 bp, Oryza sativa
tacggtactgtcaaatccatcagagagtatagcatttgtttgacttcttatcttactttccaaagtagtactagtagtactacttttctccatcaaatcatcacagttctacttttctcttgaatggagcaagctcgtggctgagtttccaatagcaagctcgagaaaaggctcgaggctcgaacgaaccgagcccaagcttaattccaagctcgatgtcaaattaggctcgagtctgttccgagctcaagcctacatagggaagttcgctcaagcttggctcgttgacagccctatacatgcggactgaacacccaatttagttacttcaattaggttatttgatatttcctttgaaaaccaccatcttacagcattctacttgcaagctacttgcacatatactaattaggtgagattgagaagataagtatatctcagctttgctgccaataaatatcgtcggctgcatgccccattacactggacaccactccggctagtcaatta

SEQ ID NO: 5352 - DNA, 754 bp, Oryza sativa
  unsure (1)..(754): unsure at all n locations
aaaaagttaaaacctaaatacatgagatggtacacgagaatgcttcatcttcataacttgtccctacaatccaatttccatctgaacacgaataggaatccttcgtctatatgatgcgaccatgtagtggcatagagtaaatgaaattgtacccgttcgaccatatatcgatatgggagaatagagtagaagaggtacacagaatcaatgccaggtttgtaagaacagatgacattcaaattttaacaaattcgcaatggttcatgagaggataaatcatacaaaaattcagttcaaaaaacagtccattgggtacctccatagctcatgtgccaaaattcggatcagccaaaagaaaacactggcatctttgccagctcaggcaaacactcctggtataaaatgaagaaatgtgaatttctgtttgccgatcgcctcagccctgaaaaaccagagcaatttgcaatgcaggctgtaataagttctcatgatccttgtccttgacagaggacgaagtgacttatttctttcgcttaacttttagaattcttcttgcagacttttcactgttgccaccagtagtgcctattgagaagccacctggggatgattgactatgctggccaaattggaacatgcccggtgaagcggatgtagctgaagcaaactgagttgctggcgtactaaacagagttggnnnnnnnnnnnnnnnnnnnnnnnnnnnnnnnnnnnnnnnnnnnnnnnnnnnnnnnnn

SEQ ID NO: 5353 - DNA, 776 bp, Oryza sativa
  unsure (1)..(776): unsure at all n locations
nnnnnnnnnnnnnnnnnnnnnnnnnnnnnnnnnnnnnnnnnnnnnnnnnnnnnnnnnnnnnnnnnnnnnnactctcaataaacccgaagcaaaggggagaggaaggggaggaaaggtgcaggcctcgcttctagctccaaggaagctagatctgggcaagggccaggaagagactaagggcaaagaggtcaagaagaaatacgttgctccacaggagttcaaactaggcatgccattggttggagatgacgtgcttgccacaatgggcaccgcttggaaggaccttcacttatactacatggagaaatctaacgccaggaagccgagtaaagctaccgatatccttggagagcacgatggaaagccattccttggtccaacaaattatgtcgtggtcgacttcaaggatcttttcgacctctacaggctccgaacggtggacacaagcctccttaagtgctactccttgtaagtattgtcgcccaactcattctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcctgccgagacaaggagtacattatgtgcgcctataataatagtaagtgtgttaactaaatatacacaacaaaatgacacacattccttgggtacttaatta

SEQ ID NO: 5354 - DNA, 275 bp, Oryza sativa
gccgccgaggcgcgtcgccgcggatgcgggggcggggcgcgcgtagggcgaggcggcggcggcgcgggacggggggcgcctccggatcttgcctccggcgccggagccgccgtcgtaggctccccgggaggccatgtgacggcgccgatgtggaggggaaggcggggttagggtttcggggatcgcgcgctcgcggagggctagggttttgggagaggcgaacgaataaccgggggaagaagagccccgtgggggacggagggggggtggggtgg

SEQ ID NO: 5355 - DNA, 460 bp, Oryza sativa
  unsure (1)..(460): unsure at all n locations
nnnnnnnnnnnnnnnnnnnnnnnnnnnnnnnnnnnnnnnnnnnnnnnnnnnnnnnnnnnnnttgctattcttcaattttttctggatagcacactagaattatgaggagtaagagctaccttgcagtcactataaccaaagcgactcaggaccttgtccacataatgagattgcacaagtgtaatcccaccctcatctcctctcagtagtttaatgttaagaataacatcagtcactcccaaatccttcatttcaaagcttttggacagaaagtccttgacctcctcaatcacaatgaggctggtcccaaagatcaatatgacatcgacatataaacacaagatcactccctctcccccaccatagcgatagtacacacatttgccaacttcattcacaacaaagccagcggatataagtgtatcgtcaaacttctcagggtaccgagctcgaattcgcc

SEQ ID NO: 5356 - DNA, 672 bp, Oryza sativa
tgcaaactacaaataatgatttgaacctcaattactaatttcataatttgcgtggttaatcttccctttattagaactaacagtgtattaacagtgtatgttcatgaggcggagcctgggcaatggcccaggctggccgggccttggctccgccattgctctaatggtttagaagttgtgaactatcctagatatcgacaatccttgaaataaaataagaatttatcaaccatcatatgtgaataaaataaacgggagaaaaagtactggctgcgtttcatcatctctatatgatctgtcgttactgtatgcaccgttgccatcatggaccaaccacttcctcataaccggatctggagaagaagcagtgtatgagaaaaggcaaaaaccataatggaggaggacggacatatacactagtacagatccttccatctgtgacggcccataacaagactggaatttgcgggccgtcacaaggaagtaatcttaattgggccgaagtttcccccgattgagatatggtcgcacagtcatggtatataggcataaaactaaagcccgtcacggatgacacttatctatgacgggctatacttgaggcccgattgagataagtttggtgcccgtcacagatgacactcttcctttaggccttttataaagactcga

SEQ ID NO: 5357 - DNA, 59011 bp, Oryza sativa
  unsure (1)..(59011): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatccacaacacagctgggtaaaagaaactgtgctaggtttgatatttctgatgaccgtggtttcactcacaaccgtagtagctgacagattgataggtcttgaggtcagatgcaattcaagaagttccacgtcaggcctattatcaggcttgctcaattacaataccatacttttatatttcaattagtaaggtgctaattctttgtttcgattctactgcaggatacatatgatcctatgttaagggaaatactttctgacagtccaacctctaggctattgtgtgttttcctatactgtgtgattgctccattgtcagaagaaaccatttaccgtggattcctcctaacagccctgtcatcctcaatgaaatggaaggatgccgtaattgtcagttcactcatgttcagcatagcacacttctccataaataattcattccagttgtttgtcatcggatgtatcacagggttagcttattctcgaactggtacattggcagcgccgctcaccatccattcattatataatgctgcaatattgcatatgactttgatgtcttaactttcttagggtttcaggtacatgctaattgtttccccactttactgctgcttcttcacacgtaggagttttttattcacaatccaaattgtttaaaatcagtgtgctatatgtggttaataagatgatgtaatcttagaattattgttccctttaggcctaagtacataccaataatgtcaactatcttttttcagtgacaccaaacgaccgtgcggtgattgatgacatatctttctacccttctttcagttaggctatgagaagtgctattattctgagttccacacatgtattttctagttttcggctgaatatggataatcttcatgatatgtcctggacattctttttatgccaatacaccataaccatctgagaaaaagggtactcttaaaaaattcaaaagcaaggctgaataactaaagattaggaaaatgatgcaaatgtttgtagcctttttaaatatcaaaagaagaatcagaaaatctacgaatgcatgtggatggctaaggaaagagtaataattcagaagttctaagagtgaattgtatgtaaggataggcatatttaccaaagtttcattttgggctacccctaaccaataattttcacttatggctaggtattggtaccaatgtattgcactttgaaccagtgagccatgtgtcggcaggactaagagataaaatatgacactagctagatggggaggagtcggaggtgtggtcctcttctccgttctcccacaccaatgagctcctttactctcaggcaacttttctttcttgtgcagtttcccactgccccctgcgctttagccacaaatccctgcgccttagtcaattaatcttgtgtaacaaacatccttacacacgcacaatgttaaaaaaaactgcaaattttagtacaaattgagtgtgacttttaaatttctttgtttttcatttactacattaatctagatttatttttatgcttatctaggctatattttcttttaccaaaaatgttataatttttttattagcatgatctacaataaagtaccaattcttcagaaaagtaacttgagttgtttcaacccaaaaaaaaaatcgacatgtaagatgttgaatgttgatatacaagttaaaaaatgaggttgataggtaaggaaaaaaaacaattactaacaaacagatgcccccttatccagtacaaatgatatccgccacaccagaaatgtttttgaacatttcatcttgcttttctctatagtctaaatattgagtcaactggagttataaatgactgtttttaggctggtggtctaattgtctagtgctagtctagctgaactaaattgtggtcctgaacttttaaaagtttaactgtggtcagaccacaaggagggtcttcaagttaactcaggcttggtagtttgattttttttcttttttgatttttgtaaccgttctctccctttggttattgaacaaatatatgcaagaaagattaattggaacatccatttaaatgaaatgaagtctttggaccaaatcattgccaaacctcaagccctttaatttgatactgctgaaagaaattacaggagcaaagctatatatggaagtgaaaaatagatgtaacaattgagatcacagcagcagtatgtgcatcagttagcaaaaaaaaaatatttattcttcatcacaagggtgcatatcgcctatcaatctgcagcttgggacaattagggatcgtgtcaacagaaatcataatggcattcactgcagcttcagcctcctcagcggtcaagccataacagttaatataggcatacaccttggtgaggcagtagagatgctgaatcccaaaatcaaagctgccatcccaagacttcacttgaaatgcactgatcaggatatgaaggtactcgagctttgccatagatcctgcctcaaaaaccaatcccatatgatagcagtgaatcttaaagaatgttagagattggaatccttggctactgatggtgagcttctctttaggggcctcatcggagaataggtatagagtgaggagagaaggtatgcttccaagcatcctcagatcttcttggttaattcttttgacatatatatgcaagtactgaaggtttgcaagggattcagtccagtttggtatcctggaaatgggatgccatcgaccaatgtataatttccggagtctacaaggagcaagggtccacaaatgtagtgagaaatcgtcttcctcgtcatgtccatggatatcaagagaaagagactcaaggtagcatgtgcctagcttggtgagagaaatggccagattttccctgtaagtttctgcatttccttgaaagtcgacgtagttccaaactaccctcaacacccttagactggagatctttcctatctcttgcagaaatgttgaaggatacatgaaaacagagaaacctgttagctcttccaatgcttgcatatttccaattccatcaggtagtttaacatggcaatcaacaagcagatgcgccaaccgttgaagctgaacaattgctgaaggcaattctttcacatgagttgatctgatgtctaatgtctccagatattgaagttcccgtatctgacatggcagatcacttatatctgtccctttgatgttcagatacctcaactgaattagtcttcctatacttttaagatcatggtttttcaatccactacaattttcaaggtccaacacacgcagaccataaaaacccagaagaggaggcacctgtccagcgtgcaaaaatgtcgtcaatgaccggacatgggatctgagcaggtatgttggcattgtgacacttccttcactgtttttatggaatgataggcgacgaatcttgccagttggagtagatgtgagatctgaagcaccaaccatagtaacaaaattttcttcatttgatctggacacgacgaaatcaaggatggtatcgtgcactcggcaagcatgcacctgaccatcatcctctatgtctactggctggagcaagctcctattgatgagctcattgaaataattctctcctatctcatataggctttccccttgttttgcatgaatgaatccttcagcaatccatctacctattagacgctctttctttatcacataatcttctggaaatatactcaaatacattaaacatgtctttagatgatgaggaagatcaaagtagctgagagataaaacccatgccattgtttcaatatctggactgttttcttgtgtataattaattcgacttttcaccttatcccactggtctaatgattttggtttggtagccagcaaacttgatatagaaataatagccaatggtaagccaccgcactttctcaatatgttattggcagcttccctcaattgaggagggcacctttcatcagaattgaaaattcttctgaaaaacaatcttttggagtcagtagcacaaagagctttcatttcatatacttgatcaccataagagcagcagcaagatttagctatttcatttatacgtgttgtggtgactattctgctaccttgactgttcttgaccaatgcacactcaattattctccaagtttgtgcatcccatatatcatcaatgacaagaaaatatctgtttcacatgacttttaattatcaaccaaggatgtattgatacagaaaagtttgttccaaaaagcaatagaaagggaacatcatttgagcctgtattgtttctacaacttatcttctaaggatgctaattgtatcgtttctacatttcggtacctcaatacttaaaaggcaccaaaattaatagtaaaagaaattgattaatttatgctccttttgtcgtaagaaaacattggttctagaatccaaaactgaaacccaacataccttttatcctggaggtattctcttagcttgttgattaagtgatgttcatcagccaatgcaccaccaatggccccggaaacatcagagaggaattttgccagaacatgcttcacgtcaggattttgcgacacggtcacaaaagcgctgcaatcaaactgatttttaacttcaaggtaaacttggtttgcaagtgtggtcttgcccaaacctccacacccaacgatcgccattgttctgagccgttgtgagatgcctccttgcgtatccattagccatttgatgatcttatcctttggtccatcgattccaacaagtctctccgcctccgtgtagagagcggacaatcgaggatcaactgatctagttctagaaccggaggcatctctgtgcagatgtgcttcagagctcatgctggagatgttcatcgtgtcgtaccttctgtaccgatcgctctcgtccatgacacgagccttcagctcttgtatccgcccgctgatccgatgcgacaactgtagccccttgattctccatgccatcttcttgatgaccccggctttcccggtgagggagccgaggtgatgcacgaagaggtcgatgcaatcctcgatgtcgtaggccatctcccgcaccctgtccctctactcctttgtctgggcatcgatttcctccatgtctgcgagcctctcaagcatcgagttcatgctgcgaagctcgctctcgaggaacctgatctccccccttaaccctttgagagatttgtgttcgcttccgagcaggtcattgagcttgaagagaagagagttcagtgcccccgtcagagcgcttaccatggctccctccatatcgctgctgagctgagatattctgcaggtaggcacaatgttagagttgtcctagcaagtgttactatatgattactagaagagactatgcaagtctctcttcttgagatgcacaccatttgcaagtctctcttttgcaaacacgttattgctaacgtttctttagttgttgttgactttggacaagtacatatttggtacccaaaaacttagcttaatacgcctctagattggtgcatgattaacttaacaattttcttttttctgttacacgcatacagtacaagataaaattaacagatatactttagggaaagtggaggatctcctttagagtggactcaaggaataactagtgcaagatgttaaatgttaggagttgttttttctttccattattagaaaaaaaatgttgtcttcttgtacctctgcctgcctgagtacttagcatttactgaagccctaaatggtcagagaaagagagagaaccatggctttaaaaggtcacaaaaggcatgcatactactacacattattaagatgctaccagttgcaagcatagttaaaataaccggaccagcagtcaaatcagtagtgctttcattggttcattggtctgaccggtgggtcaaagctcaaccgcggaacaatgttttaatatatgtacttatatttaccacaactaacaatcagtagctcatggggtcctactgagagatcacccgcactcccctccccctatgccgattccttcctcttctccccctttctcctccccatcttttcttcctattacagtacaccataatttttttttaaaaaaacaaaagttagaaaaaattatggatagaaataggatgaatagctaatttagtccttcaagtttcatcgaaggctcaatttggtccttcacgtttcattttgtccacataactcctctaaatatttgttttggcttgaaatcatccttgggcccacttaatatgccatatggctatttgtagtcaatatttctattagaaaatgtcccttttgcccttaatttgtatttagctatatactagatagaaaagagaaaaccaagatgaataaataacattgcagatgtttttcctattatttcaacatgtgcacatgaaacttaagcaattactatcgtatacatttgctagtacataatttattttcgttttacataatttactatgcattttctataaaaaaaaatcaagcatgcaattttctgttatatatgtgaatgatgggggtataagtgtcatttatcaagagagttgttggttcaaggataagtttgaactaagatgaaaacttgaatgactaatatggatagattgaaacatcaaggactaaactgagctttcgatgaaacttggaggaccactttggctattcacccatagaaatactatatataaaaattcaaattcaaattcaaattcaaatttgaatcgggtatgtaaacttttgacttataaactttggatctataaactttaggtgtataaattttagatgtatagaaatactatatatagaaaatttttgaattcaaattcaaatttgaatcagatataattcaaattcaaatttgaaacgggtatataaacttttgacttataaactttaggtctataaactttaggtgtataaattttagatgtatagaaatactatatataaaaaaatatttgaattcaaattcaaatttgaatcggatatataaacttttgacttataaacttttggtctctaaactttagatgtgtaaacttgaggtgtataaactttaggtgcataaatttactaaaatagaaaagtaatgcggtgccaaaaaaaggaaaccaggtggagggagggaggggggaatggggcgattgctagccaatagccagggcgattgatcgctcattagagtttccgttgctcatgtggtcactgtaggaagtttgcaatctatcctccacaacctatttttgcaccgatgctcaaaatatggcctttcaactctagtttggggatttgggtcctctacattagagaagctaatgcagagggtggcattagctccaatccagtccatccatctgtatcctctggattagataaggcaaaaatgaaatgggccttaggggaagagcagtaggcccaggttgattttagatgccaaaacctttgcaggactcctttttcctccaatttctacggacttgcttcctatgagtcttttcattttctctctctcatgccatacctcttccaatttctctcaacactgaagtggatctatgaagataaatgaacaggagatggagagaagtacgatcaaccaaactttagagaggcaagtgaagattgctgcttgcatctatttttttttatggttttcttggcttccagtaacaaattttgaggcatatttctatctatcatgtgttctacttatctcccaatttctcttagcgccaaagatgcttccacaaatatgagccaacaggagatggaggaaagtaggatcaaccaaaatgcagagaagtgaaggtttgttgcttgcatctattcttattatttcattggttttcaatagcagtttttggggcatcttccaatcaaacatatgtcacagatggttttcttatttatttgtagaatggatagcacaccatgttggatgcctaggactggaatgaagtttagctgtgtagacgaggcttggaaattttgggttagctatggtggtaagattggctttgatgttaggaagcagtataataacaaaagtgcagcagatgggcccaagtagatggtttgtttgctcaagtgctggttatcgaggaaaacataaaagagattatctaaccaaaaatcctctagtagagacaagaactggctgcaatgttcatatgggaataacattaaacagagttgaaggaaattatgagctatatatatgatttggtgactgaacacaaccacatccttcggttgccagaaacacaccatctaatgccatcacaacattcgaagagtcgtgagataggggagcaccctctttggcggcgacgcggcaagtgccggttcctccatgcacgcgcgagagagtggagccttatccggcagtgacaaaatgggcagcaacaatgttctcggcgctttctctggtgatgggatacctgagtcttgcaatggtaagtggatgttgaggtatgtcaggacacactccgcgctaggatcaccctaggccaaataccaatatttacatcctttaacctactatgtggaatggagaaaagcttggaatagtattgcgcctcttactttttagcccggccagctagggtatcatgcgggtaaagctgggtagacgctgcaaatacgtattgtattcgaatatgacatgttcccggttaatggagatgtgtctgtgggtgactctagagtaagggtgcaagttaaactagttggctattaattaatatggttgaaatgattatcagataaaatggttaataatatcactaaaggtaactagatttgtttaagttagttactaatgatgtttatattaaacgtttaataatgatgtttaatcaaatggttattaagatggtcattccaaaataatgcattatatttgttattacaagcatgcttgctgagtaccttctgtactcataaatgggtttagatcacgatgatatgctgtagatgttggtgatttctatgatttgtttgaaggacctatggttacggtttctaggtcactctatgctcaggctgttcctatggttaagtttactagttaaactgtttgtgagaataagacttatagtttatattcccattgtgttgtgacctctgtggtttgaataatgtataattgaagtttgtgcttttatatcgtttcatgcgtaaatggacttccttggaagttacgtatacgtggggcactttgaccttcttggggtgtccccacaagtattcacatgttgtttttttaaagtacttgtcattctcatattgtaaagcacttttgcttaaaatctccctcttctatccctcatcaatatattcacccctctcattataatccacgtatttagcaaggagttaacaataataaataaaggttagctcggtgatttgccacaacttcatatttcgtctgagctagaatatcttgtcaatcagaaaattcatcgactcaaggaaatcatacggagactaaaaaaatttgtcgattttcaactagaaaattgtcctgccatgaatcaaacagagaaaccagcaaacaagaatcatcggtgcgtgtatcttgatcaaccagagactaccgttcatctcgaggctctcgcataataagggctgacaaccataactctcctagtatctagtatctatccctgttggaagtgcacatgctatgttcatcccagtttactcgagactgatgaattctcaacacctcccattcttaaattcctatggataagtaggtgccatcattggcaattggcaggatatcacagaaattgcagcgaatttgacaaaagcaattggctagcacgaacaagaacataacaaaaagggagcaagaacaaagtctgcaaaagaaaaatggggcaattccttacatacccctaaaagtttgctccatcccttgcatgcccttgaattttgtcacatcccttgtatacctctgagatttcgtcttgatcccgtttatacccataccgttagttcaccgttatcttttttccaaaatggccatgttgccctttttatagtcatgtgatcacttcaaaaggcgctaaataaagcttaatgtgaactttttaaattttgtatagatagttgagcctaaatttcaaaaccaatatttattttttgaaatatttttaatagattttcaagcaagctttaacaaaattaatgaaactcatatagaagtttcaccgaacatttagaaattaaaactatatttaacttgaatttaaatataaataagaatgttttatgaaatttgatctaaatttttaaaattttaaatttaacttttcaaactttgaggtcaaataaacacattctttttgttgtttactaataaaatatttttcaactcgaaaattatgttggtgaaaaagctagcgcataggtactctaagtaggggtaatatagtcattttgaaaataacttaatggtcaactgatggtcaactaacggtatgggcttggaggagatcaaaatgaaaactcgggtgcatataagagatacgtcaaaactcaagggcacagaagggatggagcgaaatttcaggggcatacaaggaattttctcaagaaaaattggggtaattttgtggggttttctcttcctcgaatcaattacataagtaaacattctacatatagaatgaaaagaccaactaaacgaccggaattgtcgttccatcccatgatctgccaaacgcgatctcactacgcacgcaccacgcatcatgcacgcacagaggagtgtcacactcaccataaccactacactttcactatgcgctcaccatggcctgcctcctaaacacgtgctccaatttatcgcttcctgccacaattcgaagcgttgctagggctgcaccacgacttagctccatcaaccaacctcaacatcatatattttttagataatggattttaattagggggctgctatatcaagttatcatgtttggacgagatgatactaggtaggtactagctctagtaccctgtaggtactagctaatacccatcgatactaactgatacccatcgacaccagctgataccctgttgacaccaggctgatactcctttggtatcaggcatgataccgatcgattttggtctaatactgcacctctgacaaatagaagttgctcctgcagcagacaatgggcaacgtctgagtggtgtcgcattcaatggctgtacaacttacggtcgatggtggcagtcaatggatgatgagccaaaggggcttggcgatggccttagccggtggtccgggcatggggccgacgaaggtgtgggtgccggagggagtaggtggtcgagctggagcggcgccttgaacaacaggtcaaagtcatgtggatggagatcggcattgttggcgttgggaaaaagtcacatggagactagagtttaaagctggttcgtgctgcaccgaggacactactttggcttatcatcacgctacactcactattcctctagctcgtgcttttcatcggcagtgaaggtagggtggcggcactgggtggacataagggaggcaactgcaatggtagggatgaatataaggagtgtggcgaggacaggacgagggccgcggagtattatatttttttaaaagaaacaattgtgcgaggcacaacagttaaataacttatttcatctagttataattctatatatatgtcggctcccaaaactaacgatttagaaaccgacatgtttaactgtatcaaaccctggatcagtagattgatacaggttcaacaagctagatcttcatcgcatacatttggtcaagactccaaaggagatatctttatataaaataataggatatttacaagtttgtggttaactattacagcagaagctatatgatgatccaactttgctgttttactatagaattaaaccatctaattatactagacttgaagattaggtttaaagggaactaacttatgtgattgaactcccagcttcggcaacaactccaaatagactctgaaaaagaggggttgaagcaagggtgagtacaacgtactcagtaagctattatattattcaacaatgaatgcatgagaggtaatatctgtgtagaggtagatttacttgcagaaagctgagaataaaaaggtggaaatcctgaaatgtttcatatatgcaacagtatttaagaaaatcttgaattatatttctaaccaaagtaccatatgagtcccaatgctcagatccgtgagcacggctattcgaatagattcaaggatattcattctgcagtagatgtatgctttacctgtagtccataacatgccaataatcattagcttattcatggcccagtattaggttattaacaattgtggtacctgttccatgaactctagtccccatgcgctctgaacgtaatgttatcagcaacgagaggagttctggcgttcccggggtttttagagagaattggatgagagaccccacgtcatctcaaccaggttttcataaattcacacacacatcgcgcgataatcaagatatttacctgcgcctcggtaaatatcacatttgcccttctcggcataagtttgtctcctttgcgaggacttacataagaaccactgtacggaggtaccacattgttaattaacataatatctaggtctgtccccattctagaagctgcggtcgtactcgtttgtttgacataagtacttggtaaacttatatcgactgagacagtactagccacccggaaatcaaccaaatcttgcgtactgtcccaatctaagttcattatattttatgcaatttaactaggcagggctaagcaaaagctagcatataactggtttgctatatgttcagattatgcattcaaaatcatgaatggcaaatgcatagaatagaatgtagaatataggataattatggtcaaaggggaggaataataacttgccttgctccaacgcaaataaatccaagataggcaacctgattatccaattcttgaaataccataggttgccatccaaaagacaatagactctactaagaaagaggaagaaccaatttcaataaaaaccataaaataataagaaaacgataaacggtaaagagggcttgggtttaatgtataacctatctcttttatagggtatagggattatggggctagtatttgctagcggtaggtttaggtagtataatacctagggtttagttgtatgggagtcatttgtggagtaggatagcatatcggctaggctctatattttatgtggaggctctcgtggtttggatgataggaaatatacaagatagttgatatggttaaataggtatgtggctaatatgggtcaaggttagctttgatagaatagtggctaggatttagttgtttaggccgatatcgaggtaggataaatatcggctagggttttaggtgtttgctagtcgttgctagagttggacagcataacgactaggtttggtatcatttctagacgtgtcgatagacagcatatcggctagaagaataggaggtgggcgcaggtttagtggggcggaagtgttactccgacaaccgtgagtagcggcggagcggctaggatcacacagagcccgagagctaactgtgcggcgtgcaataaaggtcgaggggatagtgaagctccgaccgctgtacgcatcaaggcgtggggttccaggagcagcacttcgaccttgggtttggtttaggccgggctttacaaccaacggtccgacgttgaggtccgtagaccgcgaacgtccccatggaaggcgtaaagttccaaccggcggctttttagtggctaaagggtattttggaaataaaagaaaatatttggaaagcaaatataagtttaaattgtaaattcaattataagattaaatcaaatatttattcggatggtatttgaataaattaaggaaattcaaataaaatcttaaaatagcaaatttgatattaaaatgaagagtttgaatttagatgaattgaggtccaaatttgactggaatcggatctacggtttaggacatatgggcttctaaagaataggatttgaattaaatctagaaaatgagaaaagtcactgtgcaggggcccacctgtcagtctttttctttttcttctccttcttcctcccgttcctttcttcttctctgttccagagagagccgagagaagagagaggagaaggcaatcggggcggcggcgctccggtggctggagggcggtgacgtcggcgtccacgcgtgttcccgagcacgacgcacccggggaggtcggtgtctggtggagagagaaagggagatggccggaacggcgacgacaagagctcaactctggcgagtaaaagaagtggtgatggtggcttataggatggctaaaggagaggggaaactagaaaaatgggttcgtcggagggaggcaagtatggtggcgcgaggatttggttagtgttgctccggtaaaggagattgggcatggcaagatggtggccggcatgggagagagagaagagagagagagttcggcttgtgtgtagagaagggccggctatttataggggtgagaggcggtggtgagaggcggtttggaggaggagatcgagaaggacacggcgacggtagcgtgagaattcgaacgacggcggccggcttcgtttccttagcggcgacggaagaggagttggcggcggcgtgagccgtgcacggcacgcgcacgggaggaggagacggctcggctgggatgtgggctggtttgggccggctcggcttagctgggccggcagcccaagaaggaggaggaaaaatagaaaagaaaagggattgggccaaaaggaagaaagaatggagtttcggcccgatgacaaaaagaaaggaagtctaatttgaatacttgatttggataactagattttgcgaagaatttgaattcggagagaattcataaaagagatttcttaatttatttgagtgcaatatttagaggtggagtttgagggaatttatttggaagcactcaaataggaagggaaattaataatattcctcaaatatttttgggaatatagaagggaattagttgaagacaataaataggatttgagctctaaaattggtgttatgtatatttatggctaaaaggggaagttgagtgaagaatataaattggaattttcttagcacaagagcaattgttcacaatatttgtaataatacaattcttgtgccgaagaggaaattaagccacagagattaaattggtggctagatcaaaaggaggaatttggatatttggatcgagaatcaaaggatgggtttaagatcaaaggatggaattaacaattaattctaatgagattggaattactttggtctaggttcaagggcaaaattggaggttttcttggaccataattcattatagtaaaaatggttttcaaactaaattttgaataaaagagttttagtcgaaagaaggtttaatattcaaaaatagaattccaacaagaaatatcaaatatgtttttaaatgaaaaacacaaaagagattaaataccagagaggttttatgcaagttagttttaggaggtcctactaattatattttcctaggtttagaaggttattaagaacataagaataagaatcagcatgatgcaagattagaaaatgacacattttcaggatattacaatataaaacaaagtataatgattatatgttctcattttcacaacaaaaataagcgcaatgcaacacatcacaacaaacacaaagtagtattaaaagtaaaactaaatgatttaggacaggcgaaattttttttgatattgtggataccactattttcgaaaataatttgtagcaatagcagtattcaaagttcaatcgagctttagtattctcaacgccggtatgaaccgaacattgcccaaattactatgtcaggccaggcttgcaggtagctctttggcatgcattttcatcaggggcatggcatgctcttctggcctctgcagccaattaggactttagaggcaagcaaaagcgcagtcttgaggagaaaggaggtaggcagtagactacacgtgtgattgccttgtaatagcccgtggggagttctgctttcgcttcccagtttggccaagatctactatgattcctttgccacgaatcatttcatttcccaatacctcccaatccatataatcaaactaaccaagtaacaaaaatcacacggacttctctgttctcactaaaacgttgtcaccttgcaagcgctagcaatggatcgactccctcttatggtgccttatggtgcctgtagatcgaatcataagaactaagccaaccagaggagggggtgaatggttgatacacccaaaaaccgaaaacttttagcggaaataaaagttatcctcgaaatcgacggaagtcggtctgaccgagattgatctgccggtctgaccgagtggatgctgccggtctgaccggtgttgaatctccggtctgatcgccgaagtcgcctgccgcacctgtcgccgccgccggtctgaccgccgcaatgccgccggtctgaccaccgatgagttgctggttagaccgccgaaacccggtgaaacacaaatcgaagaactcttaaagtggatgacgactttattatttctccctgtgtttacaaagtgcaacaacagcactccttacaaaaattttgactaaactcgaaaccctaaaccaaaactcaactctattgctctctaaagcgatataggaagcctcacgctccctctctatttataccaaaaaaacccctactcaaagtatgtgtataactcctatacacaataggactccatctttcagtttccatacgttttacaatttccaaacgtgcagcaaacaaccgaccgcaccagaaatccaaaacggattcgctcccaagctgacgtccacgcgtgaccgtctccgactcgctgccaactgggcccttacttctcctgggccgacttggcatgccgccaacagccaccgaagcccactgagccgctctcctgctgctcggccaaccagtcatgcacacatacatgcttcaccatgcatgtatcgatcacacatacatgtacagcaccgtacatgcatgcatacctgcacgctacagtacctcgtgtactgtagcaccatatactactccaactttacaattctcttcgcgaacaccggcacttgcacgcacacctcgtgaagcccgttgcgaagatctctcccacacgatgtccatccactgtatgctatcttgtatccaacttcgtcaccggtatccttgaccgtctggaactcaactcctccctgagtctagtcccgatccccaccgttgaccgaagttgacctccaagaatccagactctagtcaccttctcacatggtatcccgaccgcaatagacctatgctcctccctgagcatagtcccggtcctcaccattgaccaaggctggactcaagtcacctgcacacaattagacaaaacaaccgtttctgggcacagatatcacaacctgacccacattagtcacacgcactcacaccaacattcacacaaactctcaaaccaattctttgattaaatcatttgcatagccaattgttcgtcacaaatattaattatgacaatgatttcacattgccatatgaagaggttttgtttgttgcaatgtagaggtacacatagccaactacagaaggagttcaggtttcttcatttgagatactcccatgagaagatacaatatgaggagttgaggatcacatttacatccatacatatatatacatctttaaaaagaatgtagtgatggtgacagtgtagttatcactacacctactcccattgtaaatttgcaagttaacccctgaacttattaatattaaaaagattaaatctaaatggatagccacataaaaaactagagtaagatgaatattccctatagcaaaaaagatgagtaacacattaatacgttttcttttatccgtagcaaagcacgggcatttagctagtatgcacaaatggtcggtagtccttttgttttgtgcaagaattgtttagtctgagaaatcaaaacgatatattctcatggaagatctttatagaaaggcagggggcaccattttacatacatagtgggaacaaaaatcctgacctctgcatcatgagatgcagtcatgcagctacagtaatttatattcaaccttgttaagcaagtatgataatttcataaaccttaatttcgtgatttgtacaacttcatatggatgtagggatgaagcaatccacaataattctgatctctagagctagtttgctataccagtcaatgacctttctaatgtggacaacataaaatccgaagaattcacatacacaaactcttcaaaacaattagaattaatgaggtgtgtattgttatttttatcaaatagatactccctccggttctataataattgacgttttgggcaagtttgaggtcaaacttttataactttgaccattaataacttcaaaatatttagtttaaagaaactagaacaacatatatagatttgcctttcaaaacactataataaaagtaaacatgtatttattcattgtgtatattataatagaaaaataaggtcaaaggtatattttgtagactatgtcattgtccaaaacgtcaattaaaatgaaactggagggagtaatttggtgtctcctacattataccatactgtgtgagtgaggcttcaaaatagtaaatactaaaatatcatatgccattatattccaaattacatatcttactgattatctgaatttagttaccaagatatatagtaaaaaaacgtcctatctttggagatataaagtagagtaagggtaatgtcaccaaatctggtaacattactgtaggattgcacaacaagaactaagccaactagaaaggaggtgaatgcaccctaaaaccaaaactttcagtggaattaaaagttaccatcgaatcgacggagattggtctgactttagtagatggccaatcaatttcatggcagacatggcgttgctcggttaatccgatctgctatccaattggcaacaaatttttttttttgcaaagcttatgaagcagtgagaaaacacaattgtttgtgattggcaatggtgcaaaagccttcaagcagcataagaaactgtgatggtgatcatagttgttgtaattatttgttattttttctttttacacagctttaattggatttgctaaagttgattttgttttttctcctaattatttccaggcaggattgtccatagcaattcttcgtgttatgtaccgtgcaacgctggggtattattagaaattattggtccataaccagtacatcggtattaaaacaagactgccgtgatgggagagagcagtagtttcttcaagtggattgctaaaagagacatgttgcaagtttttggggcaaaaaacttttgaatgtaactacgatataattttgagttcgatcacgtatgtagatactggaaatgatttttttctcaaaatgtccagaatgtgatcgagatgtgcaaaaaagaaaaagaaaaatggtttgttgagttaaatggcatttattttcagtctgccagtcgatctgccacttattgcctaattatcgtccacatggggcgttattttttctcacttagcccaacgatacaagctgtctatatatagttcatatagatttgccccactttgcaaaaacctgcttcagtcctgagttcacagcttgtatgctaaaaacgataacttggcttcaaaatcctctttataaacttaaaattccggccgatgatactcataatggccctgatctatatgtcatgtggaattaatgctctctctcattttggagagaaaaaaaatagggcaaccttttacaaactttgagctatcctttagccaatagattggactttgaattagttacttatcgaaccaaagatttcccctttttaatcacaggtattgttagtacatgtcaagctaccatccgagcccgaagtaactgaattcccaagaactccaattcctagcatcacaaacgaaataagatggaaaatgcttcgcgtcggccatccgacgctccagcgaaatattggacgtaacattatctcatcacgtgcatgcctctatccactgtcttgcctccatgcaaagcactttactactcccttgctctatgtagagcactttaccaaatcatgcaccgatgcacgtatacatttttatatttaaatgatctttttttcttaaattacttctccaatttacaatccgattacactattaaacttgttgcaattaaatcttacaacaagatcacacatggctatattccgatgaaaaaatattttttattcttttaaatctgtcaactagtactagtatgctatgtttcactaatacatctgtaaatgttgcacatattgttttttcaatgttccaatttgtattttataatgtttcagatgtaataacttaatgttttatacattacatgaaaatattttaataatatttcatatttgcaaatatattatatctttcatatgggtttttatgtcattcgttttttttatttttatgtctcactcgttgagactcaatgtttcatacagtgattattggtgttacaattagtatttcttaaatgttgcatttctctaaaacattttatagactgagttagaacatttgaccaagtttttttttgtctcactcattgagactcaatgtatcataaaatgattattggtgttgcagttagtattttctaaatgttgcatttctcagaaacatttttatagactaggttggaacatttgaccaagatttttatgtctcactcatggagactcaatgtttcatacattcattatcggtgttgcatttagtatttcttgaatgttgcatttgtctgaaatattttatagactgagttggaacatttgaccaagtggtgaaacaattttttacaagtggtgaaacaacatttattttttctcatcaaaatataaccgtctgagatcttgttgtaaagatttaattgcaagcagtttaatggtgaaatcaaatcataaatcggataattaatttaaaaggaaatttaatttaaagaaataaaaagtaggttgaggcaagtaccgcaactatgcagtcatgcatgcacaagcatataggcttcttacacgtgctactcaactagagtagaaacaacagtcatgcatgcacaagcatataggctttttatacgtgctaatcaactagagtngaaataatagaacataggtttacatgcatgtatagatgcgcggtagtgcagggtcgggcgtccgatatttgcaaaatatcggacatccgacgcgtagaatcctccaaataagatcaataatttttttgccacctgatgtgtagggagtttggccacatcctaataacaggcaatgaagcaatatgagcctaggcaccttggcaaatatagtgtcacattcaggccaaatgaggccttgcctaaacctgcgcagttttgggctgtgacaatatgctcttgcctttggctccctttaaccctcttcctcttctcttgttctccctgtgaatcttttatagtgtactgtccctttattttgtatttactgaaactattcatgttgtcatgagcctgttattctcgtcttacttcgaatattcccagtaaaacttaaaatataattatattatttatgaagatttgattttaaaataaagtaattctcacaaaaaaaaacgacagagacattttatttctaccatatataggttcccttgtctcacagagttttagcaccgagtaggtgttcaatttacagaatccagcgaggaaaaaatatgcactatttcccttgtttttctactccataggactatagtaccatgtaactcctactagagagtaatccaaaagggatcgcaacaattctagaaaagtagagacccaaaatataatataggggtgagacactctttcattaaatctcttcttattcaatagtatacaatagcttattctcttctttatctgtaggcatacataggtagtttcatatttagtgatggacccaattagtgagtaaccgggctaggttttcatgggtcgccggtttcctaacacttcttcttgggctctcattgcgtgatgcctatctttcataaaaactctataaaaacctagtaggaaatatttggagaaaaaagtacatagtatacgcttgcaattaaaaaccttgataagaaactacatgtaaaatttatcaaaggaaaaaagagtacaattcacccaatttttggttcaatttttctacattgattttgggcgcttgattttctatatcaaatattttagaatgagtcagcgaaattctcccatgaatttggcgtttatctaagtctcattattctgattcctcggatatatttattcaagagaagatatcaataataatttagtggataaatctacaagatttccacgtaatctcacaccaactgcacctactagttttctgacagtatcgataccaattccaaaaaataataaaaaaatatattattttcaactgtaaattttagtttctctaatttctttcaattgcatcgtggattcaataataatttggtaattagatgtgatttagtgcagcaacatgcaaattaatgaagcattgcaatgcaataatttgatgttaggtgcaatttagttaaaaactttcgagctaatcaatccggtgcatgaactaatttcactacaaaataatagtggatttctaactagaaaatatcccaccgtcaattgaccggagaaactaacaaatgagaatcatcgactataatgataaggagagaaggcaatacgacaagataaaagaggaggatgagctatggtatgcttcattaatttggctagggatcagcattttatttctgtactagtgtaggacatgatgtgttctccatgatttgcttatcttacattattcttgtttaatttgggtggtagcactgtaacaaggtacgtctgtaccacaaaatgtaaaaccaacagattcaggcaaaagggtaaaagaagatttgtgtagctattttttaacgttattatatttttcagaaaataattatgtagttaattgtttaaccaaccatgaaagttcaatcatgtatgaactttctcctgggagtcaaccaaacgctagcgatcacaatgcctaagagcaagtttaatagtatagccaactactagcttcaattaatctatagccaatctaatagctcattcatacaatagttacatactacactattaatacctggtcccacctgtcatacacacactgtgtcttggagtccgtgctacagctggctaaaaatatgtagcccgctactcttctctctccttatttatctccttaaaatatgtttgtagctggtttatagcatgctattgtacctgctctaactaggcaaagagaaatcattaaaaagttcaggtcctttctcgggcatacatttttatttgtatattttgatgagccaaaaaggagctacgcctgatatattaaggagtaaattaaaagagtaaaccagaaaagcaggttaatgagtataacagtccagatgaaatagaaacgaccagtgaaaaaagaaagagtacgtcagggtggttcaaatatatgctagagtgcgttggccgttggtctatgtccttaatcacaataagatttgcatcccagagatcgttgtagtgatcttgttggaagatacttctatttctttcaagccaaatattccaccatgaagaaaatagctctccgatggcatatattttcatccggaagggctctttcctgcgcatgcattttattcaggcaccctcttctggtcatctcctaaacagagcattgcaggcttgcaaacctgcagcattgcacagaagtgaggtaggcagtggactctacaaggtgtcctagtgattgtccagtaattttgattttgctttccagatcttcctcatagcctacacaaaatctagatctagtagcctcctcaattcccgacacctccgaatccatatgaacaagaaccaaccatgatgagtaacctatagattgatttatacataaaccttgttgtcaccttgcgtgtgctagagatggaccgtgtggtttcatatttgaagggtttggaaagttgcgacgcaggctatattaatagaactcccgaaggagtgcatctcaccaattacaacactcccatcatatcatacaatgaggattacattcgcatctctctcttactgattgtccagattaacttgccaagacagtgaaatgatgtcctatgatctaattatatatttctttcaatgatacagagcagagctaacgttgccagttgtcacaattgtggggcattaataggggtgggaaaaaagctggggcttggctcgagcttggctggcttggctcggcttgtaagtcaatagagccaaacccaagctataggtatttcaacaggaaggcttgcaagccaggaaacgagctgagccgatcttaagttttagcttctttctctaactgagccgggctaagctaagtctaatttgttgcgggccactgcaagctgagccgagcaggctttggcctagctcgtttccacccccaggcatgaacatccaaatgacactctttcaagataatagatcactaataaatttgtacgatttgaatatggttggacaagatccaaatagagtatcggaaaaatatgaacttgataagtattcttgtatttttttcacgaacgcgcaaaaagattgcatgtcaatatattaaaagaaaaagagtttttgttacacgacacaatcagccagactggcttatgccaagggaagtgagaaaaaaaaacaaaagctgaagctaggaaaaaacttctacggcggctaaacgcaactccaaacagcaggaaggggcagagccacggtacactcccaataaactccaaaagcagcaacggtagctaaagaccacaaatggctctctgagaggatggactctataactactaagaccgaagagagcacagagtcgaaaacccatactagtggtagatttttcttctgtaagcagcattacatgtgcaactgatggcctcggcgtatgctgatctacccaggaacgtggcaatcttcctagcgccacccattctcagttgatcaaagtttctttccatctatggacagaatctaagaggatgatataacaccgacaggttaactcattgatgcctagtaattagcatagatacataagaggtgttgacacatgacagggctctctggaggagatgaaggccaaccaaagacatggcctgcttgagcgtagtaataattagcatagatatatatactgttctgtttgagcgttaggcatggcaaattaatgctctaggacgaggtcagaaccaaatactacaagagtaaatgatggagatcgaccatgtgattttcacaaacatatatacgacacacatgaaaagcaatgcatggtaatatacagtggcatacctacattcactacaacataaatggtaataggtgctggttgggaacctcacatgggtattggatttcctaaccggtacctcgtaggtggtacttatgaggaggaattaaaggtaccaatttaggaaccgataacctttgatgttctaagaattcaaaaaaggccagctcgattcatcggttcatcaagccgctactcatcacacccagaccgtcatcgacccaataacattcccatagccggatctgtaggagttgccactgtcgaggtgtggaggggaggcggatggagaggagaaggaggaggcggatggagaggtagaggaggcaaggttcatgtcgacctacagagacagagagagatggataagggtaaggtggatcgagtggatggggagagggttggataagatcgacgctggctcggcttggttctttttgaaaactgacacatatagtataggtgtcggtttttcctctagaaccgacacttgtagttgttgaaaggtgggaaaaggttcattaagtgccagttttaaataaattgacacctatgagctgaagcccattaggagtttgtagcagtggttcatcttcctggggttaaagcacccaccggttttaaattcactcgctgtcaccgtcgtcgtggcctaccatgcttcccgtcgttgtcatccttcaacggagaagccaccggatcacggcgccgccatgcttcccaccaacccaaggagaaaaccacacaccaactgtaacacaacacacagagagagagagagaggggggaggcatgggaaatggaggggaggcggatggagaggtggacgaggcaaggagcatgtcgaatgacggagacagagggagatatggataaggataaggtagatagatagatagatagatatatagatagtttttatatttgttgtcagtataaaaaaaatcttttcagtacatatttctcgaaatgatatatacgtaatgatcatttactactttgtatcaaaatacaacctagggacattgacaaaaaatatatcacaatttgaacctttatatatgttatgaactaagtaatatttcagaaaattggatgtagtacaagataaaattggtgaatttcaaacatccaaataacttcctataaaatacataaacaccaataaacaaatattccatgctaaagaacaccaaaacttaattagtactattattttcaaaatcatctgtacaagtagtctacagtttggatatgatcaacgaaactcgtaatgaccttctatatagcttgtgttgaactatccccaagcccatactagtgagtagaaaacagtggcactattgagcccttacggacgttcatcgagacaatgggagggatattgcatagttgtggtaggccagaccaaacaaactctgctgtcttgttagatgtagacaagcctatgatgccagcgttactagctgaattcccaacaactcctatgcctagctagaaccacaaaagaaacgaaatcaacaaaacttttgccatctaacaggttagtgtggctacatcctaacaggttatacagtttctcatccggctttgtcactaactaaaacctgagccactttgggctgcaatgatatatatgcacttgctctttatcccatttaaataaatagcaaatttggctattgcctatcagatgactgctgcgtcaaattaacttggatgtcatttgctgaaacacaatacaaaattaacaatttcactaacgggctactgcaaaatctatcacaacgttttttttatatattatcttcctcttcttttctctctcttggatcattcattatgcggcctctctttatttctccccgaaattgttcatgtcgtcatgagctaaccccacatgccatactacaactaaaaccaatttgagaagcagtaatacaggcttaattcgaaaattatcgaccaaacttatttacaattaacaaatgacgttttttccctcaacatattgtgttcccttgtctcattgagtgtttatgctccatacacgggtgatgagggaagtcgtcatatagtggtaggaggatcatcatgctgacatgccaaatgaatccaagaagtgatcaataacaatgttcctgataggactagggatgacaatggggcccataaccctgatacccggtggaaaaaaaaatccttttaaggtctataagtactaaatcagtctccacggggctcttgatgggcaaaaaaagtcccctcatcgtgtgggggcaggattagggatgttcacatggtctttgtccccgtatcctcatgaggccctgagtacaccatcatatgtctgcatccccattatctcacagccgaaacagaaaataaagcccaacgaaggcacatttagtgtgctcatatgtacacaaaacaaaccccaagtcccattcccacatcctagtcccagatctagatagaatctacaaccgctgcaaactcccagtcacggctatagctcggcacctcggcctccatcctgcgtcgcacgctcccgtcgtccacgacgtgctgccgcatcagcagggccgtcccgtcaaattcgggggccccgtgcaaagttgaaggataaaaacttaattgatgatataatatgaaaataatttatactccataatatatttcatagcaatctagaatggcctaaaatgataatccaaaatagggattaccggattagaaattaccagaaaaaattaggttagggacgcgacaggtgtcaggcggcacgaccgcacgagagaaagaggtgaggcatcgtttactcctctcgttcgttgcgattggcgattggtgaggtccacagtaggaggcgattcaagattgcgaaccggcgcaactatgcgaactggcaaagacgtaatcgaagccaaaacacaagaaaaataacaaattttcgggactagttaggctaccaatttacttattgagttgtatatctagtgttgaagttttgggcctacggtgcccctgaaaattagaggcctatgcggacgcgctggttgcacgcccatagggacggccctgcgcatcagcatgaactcggggcttcggcctccttccccgagaatgctaatcagcgcagacacgctaattagatatctcgcgtgcgtttccggcctagtcattcgcgtgtgattccgaccggcccaccagcgaaaaagaactcctacttttccacgcaaaaaaaaaaccgttgggaggcacatgccgacgtcggtattggagcaaaaatcgtacttcctataataaccgtattaattaaccttttctttttttattgggaatttgaaaattacgtgaaattttaaacttttaacgcagatctgaaaactttcaactcgaaatttaaattttttgaagtcaaaatttgaaaacttttaacttttcatctaaaatttgaaaacttttcaactcaaattgaaaaatttcgatccagatttgaaaactttcaacttcaatttgaaaactttcaactcaaaatttgaattttttgaaatcaaattttgaaaactttcaacttttcatctcaaatttgaaaaactttcaattcaaatttaaaactttcaacccatatttgaaaactttcaattcaaaatttgaaaactttcaatccagatttgaacactttcaacctagatttgaaaactttcaattcaaaatttgagaacttttaagtcaaatttcaaaactttcaagtcaaaattaaaaactttcaattcaatatttataaagaggtatgcgaaagattaaaaaaatagaagaaaaaaacacatcgtaaaaaattaaaaaaaagaaaaaaaaagcgcacggggcccagctaacgcgcgcgccagttaaattgctggcacttacgcgagcgctaggagcccccctccttcccacggtgcctgagctgtgtccagcggggacaggttcacgccgctctcgccgtcttcagtagagacaactccatgctactgttgctgtctccaacagggataacacgcctccattgcccttcatcctaacatctcttagtttttcttgctctgccacaactactgaacgtccagtgttatttgattcccaacacctccaagccctatactatctaattttctaacatattggcaccaattttctcccatgatttctagcgaagcccttgctagctaggtccagctatatgtgttctcaaaaataaataaaagaaagtagctatcctatcttcgctacactagaaaagggactctctttaagaccatactagtcttatatttgtgcgttgcaacgaaattacgaggaaagcatagatatgattttatgacatactatctggtttttctggtacgttgattttcatgtgcaaactctatttttttttggatgcggtgtcttttaagtgcagttttctgtatgggaactacgatagtggggaaccagaggattaggacgacttcgcttttaaagtagtagagacatgtaaggctatgggtatgttataactcataaaaaaacagaattaatatgtattcatttaactttttttagacaatagaaatggtttgcgtaacctcttatgttaattaggcacctaaccaattttgcaattagtacaacatttctaggagatacaaactaaggaagactatagttatatataagccccaggtgtcaacatatctgaaattctagcttactacacaaaataatctgaagtctgaattttttcacagaaaacctattttatttacgaacatccaaacatccacaacaagaagtaaataatgataactatccacacatcatgcatagatatgctaccataaaaaacttctacaaaataaaccaaataactaatctactaccacacatgatatgtaccattttattgctacgaaaataagtttagttcaaatttgtcataaatgtgaaggtcaaagggtgctacttgtccacgcatgcatgccgtagatacattgtaactaaaaaaaaccaaataaaaaacataagtgtgagtttaaaatactccgcaaatacaatatgaaactagaaaaatatatatacatagtaatttgcagtaaagaacaaatataaactttttcattttctttgtgttcaaaagaaaagacatttatcttttttgaaagttaatgaaacagagccatcttttcaaattgttgagctatgcttcaacaagtaggataactgcatagttattgtgagccacacacccaaaaaaaaaacctagctagaatcacttctgaattttatttggagcaagtcttattagttctaaaaaagtatatcatcctagcccgaagtagctgaattacaaagagctgctactcctagcaccgcaaacgaaacaaaaacaacaaaagttttgccacctgttatatggagtgtggccacatcataacaagcaatatgagcctccttgctggcccttgtatattgtgtctcattcagcccaacgcaaaacctgcctagctttaggctgtcactcctagctttaaatcaatggaaaaaatggcaattgcatataaattctcctcctctcctcttttaatttctccttttgaatctttcattatacgacctgccatttatttctccccaaaattattcatctcaccatgagcctaacattgtctgcttactgccaattttctaagataataattttattacaaatattgaattttataatggagtaacccttttagaaaattggcagacagcatttactaccaaatactccctccgtccctaaatatttgacgccgttaatttttttaaacatgtttaaccgttcattttattcaaaaaatttaagtaattattaattatgttcctatcatttgattcattgttaaatatacttttacgtatacatatagttttatatatttcacaaaattttttgaataagacggacggtcaaacatatttaaaaaattcaacggcgtcaaaaatttagggacaaagggagtatcaatcaggctcctttgtctcgcagagttatagcaccacattgggcttgaattttcaggagccccggaagtaatatgcactctagcatccttgattttttgctacatacatgggtgaggacaacctcaacaggttccaaaatcaatttcagtaagtcgtgcatgattcctctcaatgtacagccagagagaaagttgagcatctgtctaaaatgtttggatgcatggtaggagacttgccttttacatatctaggcataccaatgggtatctctacacccaaggtaatagatttcagtcctctggtggatagagttgaaagaaggttgtctgctacttctgctctcctttcttatggggatagactgactctggtcaattcagtgctttcttttttgcccacatattatatatgtactctttcattgccaaaatatatcattctatctattgatagggtaagaagacattgtttgtggagaggatctgatatcaattctagcaagaaatctttggttctttgggatagagtctgtcagcctaaatctaaaggggggttaggagttattgatctcaggctacagaacaatgccttactaattaaaaacctgcataaattttataatagacatcctatcccttgggtcaccttgaggtcctcttactatgttgataaggtcccacatgctttataccttaaaggttctttttggtggagagatgttcttcaatttgttgatatctttaggggtctctctcaatgcacagttggtgatggcaaaacctgcttgttttgggttgatctctggaacaactagataagacagaccagttatcctagagctttctcttttgcaaagaatcaaaaggattcagttcatatgacctccctaaaggacttaccttgtcagaacaggcatatcaggaatatctttctttaatctttgatgacccttttcaacagctatctaatgaacctgatatttggtcttatatttggggtaatgataagtattcatcaagaaaggtttatgctacaaattttctgcatgtgcagcctcctgcttacctaaaatggatcaggaagagtaagtgtactatgaaagttaaggtttttggttggctccttatgattgacaggttaaacacacaggatatgcttgatagaaaattatgtgcgcttgctggaagtgatttaaattgtgtcctgtgcacctctggccaaatagaaactctttttcaccacttcttcagttgttcttttagtactgagtgttaggcacagtttggaatagtttgggatatttatttgtcttttgaaaatatgctaaatcaaacaaggacctcctatcgatcttcgcatttcctggagaaggttttatatgcatcctggaatatttggaaacagcgaaatgattacatctttgataatattataccttttgttccttcttggatgacattcttttaggaatgatctatcccttcttgctcatcgtttaagtttagatgagagatcaagttttataaactggttgaaccagctgtaattacttttctttaataaagttttaaacaactgtgggggcttcccctaccgtgcttccccctcccccgccccccccccccccccaaaaaaaaggtcctcttgtgcaatatactatatctgttttttaatatatgatgtcattaactttttgagatatgtttgaccatttgttatcatttattttattacgacttgttttattactaaatgttctttaagaatgaattaaatatttttatatttacaaaattttttgaataagacgaatgctcaaacgttgataaaaagaaaagtaaacgacgatatatattgaaatatggaggtagtacgagtggatcaatagataggagccaccgccaatatatgaaacagtgcaatttcctagttttctagctctagcacaactaccgaacgatcaatttctttcatgatggcaatttgactcccgacacatccaatccctatcatccaatcaaacactctccaatgatatccaggcattgccctcgccgcttggtaccacagcagctatatttatagatggccttactaaaaggagaagtaacaccatctatcgtgttcactgcccttaaaaaaaaggcttttgactatgtctttgcaaaacttcaaaaggcacctagtacaccactatttactatttttagacaatggaaatggtgtgcatctctagcctcttgtgttaggcacccaaccaatgtctccaattaacacaatgtggtgggcgacacaaaccaagaactatatatgttcacatcgatgtgtgaatccaaactatgaggactcagtttgtgttcttttctttaaattcagaaaagaggactgtttaatgtgcatgaacaaaattatatagtatgccataaaaagtaatcgtctttcgtgggtagtactaaactatatatgtcccactgaggcatgggatcgccatatattacacaccgcaataaccacgaactaagcttaaacgtagtgtttggcaagaccaactcctttacaaaggccaaggccaatctaaagtagtgaaattactaaagtttctccaatcctgattgtgccaggtcatcaattaaacacagaccgttggatacatataaggaaatcaatagctgccatcagatgcaaagtaaagttgagttgaaaaataaaatctggtcaatggtagaatcctccagattgtggcaaacggcctatgggccatggagccgaagcgtcgtgtacgtatataaagataaagagaaccacggagcaggtaagaggatacaaaaaagaaaaaaaatagcgcagaacccatctcctcccgaaacccatcgccgccgcctccccattgccgttgcctcctctgcctcctcctccaccgcgcccactcgcccccttcatatccacgtcgcttgcgcaaccccaccggctcagatcctccctctaccatccggcgaagttcctcatctgcctttccatccaccccgactcccatgatgtcgccttctcctttccgcccccggcgtcgtttcccctccccctctctgcaaccggcatttcttcctcgcacagtccaccggctcctcccctcacccattgccgccacttcctcgcctccacgcaccctccactcactttctcatccccatccccatccccatcccatgatcccaatcccaatcgcagctccaaaacagcatcggatcacaactaaatattttggtaagtcacaaactcagataatcccatcacctcctatctttgctttctcacactgtagccgggaactacatataaggtcaaaaaaatatcagtaataggatggattgacaaagagcaatgctataaaaatatattaaaaaacacatgtacaattatgtttctgttaaaaaaaaaggattgttgttgtgttttgttcagcaagggaatattaatcttaaaggcggatagccaactcaaatgattcttttttcttggacgatggttttttttagcatcatcagcaatgatataaaggtttggtttgacattaatgtgccttcgatgacagtaaaagacacttggtttcttgccctgcgtcagtctgttgtgcaaatatgcgaatcaaggacatcgatgtattagaagtttaggacacaattaaatgctaagcagatagaatatctattattacctgttcactttaatatttttgccttctgagttttgaagctaaaaaccaagcaaacagctcatggtcactatgttattggttctctggtgtgttcatgaggcctgatggcaccttaaccttaacctgttaattaacaacaaacatcgatggcacctttttagttgtacaccaatcacctgaatagtgtaatttctgactttgcatttagcctatgtaattagtaaatgtcaatcatatctactttctcaggcctacagggaagagttgagaaatcctccttagctttgggctgaagggtttttggttggcaacaatgcacaaacagacaaactacactaattgtgatgactctggattttttattacacttcataacaaaattgtgcatttttattttgggatgtttattatgttattttcttgagatactcagaggtcaaatgatctttgagcaatttgtgttggtttcaaatcatggactagattgccgtttattttgctaatgtgtattgcgttaggtttgactattttatgccttatgcatcatatttttgagtaaacattctcatcttttgatggtatacgggaagaggttgatcctggacatattatttgaaccttcagttcaaatatagcttgagttgaatctatagttctaactaatagtttatcaagttgtatgattctgtaaaagaaaaaaaaatcaaaattaagtatgattgtacattacgggcacccaaagtcgtgcaacgcacgactaagtggctagtttaattgagtacacaatccactttcaacacaattagccaattaaatcactttttcaatatcgcaactacttttttgcttaggtttagtcttgttttgtctatctttgttgatttgtgtctaaatcgtctgccttcactgtgagaatgcgaaatctctatgaaggtttatcccgtaaaccttccgcttactcatgagacttgtgtttatccttgtttcatctaaattgactccgttagctgatttaatcttacgaaacccatcttgatttagctgtctagatcaaggtggtagtgaatacatatcatcgcaagacgtttaggtgtgatttaattatgacataggcgcaaacaaaattttgtgcataccactataatatttttttgtccaaaataagtttgtagtacaagcaatcatgaaagcttaatcatgcatgttttcattttctctacggcaaacaccaccatgtcaaacatgccaagctggcagcgagacagttaaaaattatcaaaactaaagagcaggtagctctcaggcatatactttcagcagaaaaaatttgaatatatatatatatatatatatttaataagttgcgtttatatacatgagtggggagaattagtgaaaatatatctctctggcgcattgggcacgcgggagcgcgagaaaagcgcagcgtgggggcgcggaagtggctgcggattaggtggggcggaacaggggagtgggaccggcttggtcctgcaaaccgggagagtggcaccgggtcggtcccacgccataagtgcggcagtggggtacagcatgggaccgaacatgcaccaacacaatcccgcagaaccgaggcgcgggaccagcatggtcccgccggctaaacgcgcggtaccgagcaggtcttgtgaagcaggcgctgcgtgttcctccgttcccgtgattcagagccacgggaccgacacggtcccgcgctccaccacgttcctgctcgcccactcctcaccaccgaacgggtgccgcccgttcagcacgcggtaccgacactgtgccgcgcacccacccagcgtgaccgacatggcctccaatcccgcacacccacgccgcgcttaaggtgcaatcccacattaccatcgtgcgggagaggtatatttgtgtgaaactttttcatgcaagtatataaacgcaaattattaaaaaaagtatttttccaatttttttctactttcagaaagcagcaagcagtctcatagatcatatgaccaaactggcccatagcgtggcaaccgaaatcataaccatcagcagaagggaggttgccagtgggctctacacgtcggcgtacagtaaattaaatgtggatcaaggaatcactacaagtctgcaatcgccgacatctcccaatccatatgatcaaactaactgatcaacaaaacacaaacagactatataatttcccgttctcagtagcactggcgcctaccatccatacttgaagtgttttgttggttgaaatgtagataatactcatatccagctacactcaaccaactacagaaggagtgcgtgcctccatatatatgcacaaatggcagggtagcccttttgttttggacaagcattgtttagtatgaaaaaaaaaacctacatatggtctggagaactcatacatcattaattacagaggcagaaagtacatttttatgtattggaaagataaaatataattctaacctgactattcgtatcaaccttaatttggtaatttgtagaacttcatatggtttgtaccgccccacaattctgatctctagttagatataccaggcaatgtgaattaaaaaaagatatactctctctatcccataatataaggcgtgcacatatttcaagatttaactttgaaaacatttgaccaacaattattacaatataaattaaattttatttgttaaaattagtatcatttgattgatatttaaatttactttaagatggttataattttgttgcaataaaccttataatatatgagaaattgtaagttaaagattagttttaaagactgtgccaaatttaaccatgccttatattatgagatgtagggagtaacaggcaatggccttaattaaattagcatgcttgaactctatacaagatgagatttcacatgcagaaaaactcctcgaatcaatgagaatggcatgccattttttcaaaaacaaaacaaatggcgggttctatactatggctagttgagttggagcatcccagcagatactccatccagtcctctatccataaaatagaggttgggagaagaaaaatgagcttcagcagatactccatcccagcatccaaatttagctatcctccatccagggagagagaaacgtcaccatcatccacatcctgtaaccgccagcatccccctcccccatctagagtccggattgacctcccctccgccacgacctcccccgatttcgtcgtcgtcgctggtcggatgtgcatttttcactatggactgagggtggagagggagagacatagcagatctggaagctgcaaccgacgccggccgtcgcgcctctgtgcccgtcggccgcggcgcctccgcacccgtcatgccgccacgccgcagcccccgtcggccgccgcgcctgttgtgccgctaggcccgtcgcgccaccgcggccgccagcctccgcctccacgctgggcggagagaagaagaagaagaggaatagaagaggagagaagaagaggaatggggaagaggagagaaaaggagtagagagaagaggagaaaaaaaatatccggaccattaaaaatatatccaattaaataaacttatttagatttcggaataaataacactgttaaaatttagttgtttaaaatatagttcttaaaaaataatacatacaatgtatggttagttgaaaaatattagtaaaatataggagggtgtgatatggaagatgcaatatagattatctgttggactgagaaggaatatggataaggaatctttttagatggccatccatataagcatatggaggatcaaatttaaatgagctgctgggatgctcttaggcttcatatatggaagatactaaaacatcacgtgacaacgataattccaatggacatatcctaccgattatccaaattaacttaccaagacagtgaagtgatgatctatgatctaattatttttaaatgtatatgtatctaggggcactagagatattttttttctgtaaggtgcaggagatctgagtattactccctctgtttctaaatatttgacgccgttaattttttttaaaatatgtttgaccgttcatcttattaaaaaatttaaatttaagtaattattaattatttttttatcatttgattcattgttaaatatacttttatgtatacgtatagttttacatattttataaaagttttttaataagataaacggttaaacataatatttagaaacgaagggagtattatattaagaagaagaaagatgggatagaaccacaggtacaaaaccaaacacgcacattgaattctaggaaccatgcgtatccgcaaacgcaatcccaaacacactaaagaaaaaaaaatgaccacggcacaaaccacccagctcttgtgcaataaaaaagaaatagtccacgagcctcggctaaacaccacaactcagcatgcaaaagagcacgtgccaagttaggagcaggtccataaaaaacataacagttttgaggtatttcatctcttatgcacacaatatataagccattgagacccaactcaatggaagttcaattcataatcccccaatctcttatctcaaaattacaattatatatttctttgcatgatatagagaagagctaagagtgttgccactatcgggacattgatgcaactcatttgcactatggccgtgtttagattcaaaagtttttcttcaaattttcaacttttccatcacatcaaatatttagacacatacatggagcattaaatatggacgaaaaaaaacaattacacattttgcatgtaaatagcgagacgaatcttttgagtctaattacgtcatgatttgacaatgtggtgctacagtaaacatttgctaatgatgtattaattaggtttaatagattcgtttcgcagtttacagacggaatctataatttcttttattattagtctacatttaatacttcaaatacgtgtccgtatacttaaaagaattttgacacacgaactaaacactgcctatacctcctttctcttgatggtccaagttcttgtgccgagtgggcaactgtggaagtgccggcatccttctctcacatctgctttttctctcccacgtcagattgaaacaatgtgtagtggctaatctcgcttgcttgtaagccttgctcttagtgcaaacgctatgcgagaagacacttcaattctcaacacctcccaagtcatatggcctaacttgatagatacaaaatttgctcattgttcttatggtcccatgctattagaagctgttttttattatctcataagtcacatggtctaacggagagagttttttcttatccctttagataattaaaattgagaagatagttaggccaatttgcacatgtatcttaggactcaccagaactgccttccctcactcctttatgttttttaatgggatggaaggagagctgggtgttggtgatatgccctagagacaattatagagcaaggcaccgctatatataaaactatatgtatacatataagtatatttaataatgaatcaaatgatagaaaaagaattaataattacttaaattttttaaataagacgaacggtcaaacatatttaaaaaagtcaacggcgttaaatatttagaaacgaagggataattttcttttgatctaccgggctccttgtttcagtagttgtctcttgtctctgctctttctgctcctccatacatccctgtggacaggagatcagagatccatatctgtggcatgatcgatcgatatgctgcccaactaaatcgatagaggaagcgatgaagccatccacacataagtgtctacagactacagaaggactctgggggccaaggaaagcgagtcgccattacgcattagtccagtgctctagtcaccactctcgatcgatgctcacaatacttcatcttctagcactgaaacaaattctgagcacttacttagcctcatggaggcaattcgactcccaacacctccaatccctatcatctgcaactctcaagtagaaatttggcacatatttgctccactgatgacgaggcaatgcccttgctataggtaccagcagctatatatagatgctctgcaagacttcaaaaaaaaagagaaaaaacagcagctatatcctcactgcagtagaataggcttttgagtatgtcataactaaacttcaaaaggtagagtatttctacatttaatttttttatacaaaggaaatggtttgtatctccatattcttctattaggcacgcaaccattgtctccatttttaaaaaatatattgataggacatacaaattaagagtgtgtttagttcacgctaaaattaaaagtttggttgaaattagaacgatgtgatgaaaaagttgaaagtttatgtgtgtaggaaaattttgatgtgatgaaaaagttgaaagtttgaagaaatagtttggaactaaacttggcctaaagatgactatattcctgtgaagttatgagtccaagctatatgaaatatcagcggagggattcttttcgatccacatgtagtacatgagaaatgtgtagtttggtagttatgagtccaaggttgtgttctttagcctaaacttctcaacttatgtccctcgttttccatgtatatgttttccaaactgtgcctaaacagtgtatttttttcaaaaatttagaaactcatattaatccacttttcaagttttatactacctccgtttcacaatgtaagactttctagcattgcccatattcatttagatgttaatgaatttagacatatgtatatgtttagattcattaacatctatatgtatgtgggcaatgctagaaagtcttatattgtgaaacggaggaagtaactaatatttaattaatcatgcattaattcatcgttctgttttgcgtgtggaggggagtagggctgtcaatgagccgagctcgtctgtctaggctcgagctcgatacaagctcgagccgagagattttataggctcggcccgagctcgatcaagctcgagctcaactaccgagcttgatttctaagcaaaacaatatatatttctaagataatctttaaaaaaaataattaatttatagttcatcatattaatagaagaggaaaaaagaataaaataaatatatgatgtcacaaaataaatatatgatgtcaatataagacacacaaatatcatatttgatctcctaatttattaaataacaacaaaaattatatattactaggctcgttagaagctcgagctcggctcgacaaagctcgcgagcttagggagaggctcgggctcggctcgtctggagctcgagccgagctcgaatcgagcctaggacgagccgagctcaagcagctcgcgagcctcaagctttttttgacagccctagagggaaggtttcctgcaaaagaacatggctaaaaagaggtgggtaaaacttataatgttcttaaatctccttcataacattgaaagaaatcttatcaaacattgcacttttgcaaatgaagaagattttgtgccgctgaacatggctgaaatctacccttgactaacaatagagaatgaaaagtgcgaacctaaaataacacaaaagtggtctctcatatcccttcatatattagaagtctttgcaagtgacacaataacaccaaccagactttggctaaacagatatgcatgatattgcaatgtaaaatagtggaccaatattcattttgcactcacattcaactagtgccatgtaagaactttttaggagctaacagcccctagaagttaatcgattttgctataaatctggcgacaaagatttttgaaccgttcgataaacctcgggattcatgcttatgtttctttcgacgtccgcaggccacaggcacgattcattcatgcgtagtagatgacagacgaagggcaggcataaagtggcacagggcatagccgaacatgtcctcgtttgatgtttcatggcatgcatgaatgatggccaagcactgtatgctggtagatgacggcaagcattagttcgatggcatgccgcatgcacaagttcagccaaacaaacgttgcgagttcatgattcctcttttgcgtgagcggtgtccaagcggaagttttctaaagttatatcttacttacatgcaagttacattgtagttacattgtaattatatgtaagttacagcgtaattatattgtagttacagtgtagagttacactacaattatatttgacaaatttttagaagaaaatttatcgacaaatgtatagatttgggcttatgcccctaccaatctcaagtgggcccaacttgtccggatggacgggcccatccatccaagttgaccgcgaccatgggcctcctctcgacggcggcggtgcttttctcccttgccgtcgctgtcgcgccgcccctcgtgcggctccaccagtggtacgccgctgagttccgcggcctcaactgggctggagctcctcctccactggccgctctccgtcgccaccctctacgtgggctggcgccacctccctcgtcgccggggtctccgtcgtcaccacaatggtgagtagtcgtgatcccccgcgcggatgcttggatgtcctcagattcaacattcaagtacatgttcattagggtcttcagcttagtaggtatgcgtatttgttgtaatttggtattgcaagaagctgagatcaaatactcaaattcatgattttctcctttgctcctttgtcaattatctgagaatttagggcaaaatgaggaatttgaagaggaagaagggtacgtgtcatgcccggaatttctatccaaaactccaaacgcttacatgtgtgtaaaaccctcgtccaggaatcagccgagagacacaataacaaattgataatagagtgcaattattaatctaattaataggcgaatataaagtcattacagaggtagatagttcctctcaaacattaaatatctaagcagcggaaaataagagaaacaacgcaggcgactccaacccacaagcagcttgaccaaggctacgcctaatcctccacaccttcagcatcactgtagaactcctcctctgatgaatgattgcaaggtgagtatatgacatactcaacaagccatgcagcaaatatgcaaatgcaagggataacaaaggatggcataatatagtctcatttgcataaatggcatttaataaatacttcagaaattaataaaacagtaaagtatttaattaaacaatattaatccaacgctatacaatatacccgttgcataggcccaaccattctgaacaaccaatcccggctgcacagttctatctccaaaccaggaatataccattccaaaccaggagctaaacaaattattatcatcataatttattatggtgagagatatgagactaatcacgaaagacattgttagacccgccaataaccacgggcacggctattcgaatagttttactctggccagaggtgtaccactgtacccacaagacacaacctcaacatcatgtcaaccatgcgtcgcgatacttaacaagtacccgaatagagattgtgacaatactctctgcataacacaattcaaagtagtgcacctttctgttgacagaaaacacgaggcctgggagatctgcttaactccagtgcaggtccaaaactcgccttcggatgtatgagcgtgctagttgatttgatcctgtaatcaacaagaaacaaagacaaagaaaccgtggttaaatctataaatgatagccgatcggctaggtgccgatgacatatcatttattttagaccgatgtcatatgtgcattgattggcaagtattagtaagcaaatcagaactaaatctactcgatcggctgtagatattaatgacatataatccttacatcgatatatacttaaatcaagtgattgggatagatcgatcaccttgccgagacagtataaatcacttagatcgaaatatatattaatagtgagattatatatattcatagcatagccgatcagatagatctagcatgtatcggctagtactccgataccactctatattaagatattaaagcaaacagaatataccaaacagaagcttaatatacttaaatgcaacaagatcttaatataaaggacagatttaacctatcaatcaagcatataggataaaaaatagttaaatcaggtaagatcggctgaaactccgatactaatctaatcggcaaccagaaggcaggctagatattatggttctaagcacgacttaatagatcaaactcaactgatgcagcattaagtatgaaaagaagaacaatatctagacaatcaagccgctggatgtttcatagagtggtagatatatcacataatctaagtcaacgacgttatttaacctaatcggctgccttctattgacagatgctagccgattataagttagataacgatattatcaaagattatgttagatatatgataactcgacgaattacgtaaacaagattagagtatcataaagatggaagcactaatcttgagaacacaagccgtcataacaagttttacctcttgttgaagatcaaaaccgatgcagctcaacccgaaagcaggaactcgtcgaaacaaaacgaaagtaaaagggtggcgatgcgccgaaattgtattgaacatgtgttaataattacatagggctcggggtctatttatacccgagaattacaagatatgtccatatcagacacgactcttatctctaacaaactctaagataccataagtctttgcggcagacttttgcccacatttatctctaaggaatttacataaaatatcctaatttaatagatacaattgtcttcccaggactctatccatgcgtggcaatcatcttgaagcacaccaactcgaacccgacgtcgtacacaggtcgtattgtcgaaatcggccatatcacttaacccagtctgactcggacttagccgatcccattcgtagccgatccggactccagccgattcttactctgtttccgcgacaacccttatccccgattccgcttcgatctaatcttcatctccgattccgatattaccaaatttggtcgttaacactttcctggatcataatcaccccctcataaacaatgcatggactccccagcgacccccgtgggcttagctctgccacttctcagtctggtgctccacaatgaaccatactacacaaaaggtaaagccgttgcccacgctggcttgtggttggcacggttaatgtttcacaaccgaaaatcgtgaaccggtccttaattgatatgagcacgaccatcaaaaccatgcgctcacaactcaccattatcaagttttagttggcatcttaattaatcattagttatcccattcatatgagctaatgtctctaagcatggctaagcatcctaatcactttagctaaaaccatatattgttctagctaatccaattattaaccaagtgacaaagtataggtaatcaataacaaaggctatgacaaaggcaataggtattcccacccagtgacattcaaaaataaatgcaatagttgaatagaaacaatagttttaaacgggatcaacatgttcaaagggttgtttgggatctatgtgacttgccttgctggccttggaactcttcaaagtcttctcctgcaaaatcggactctccgggaacatcggaatctaagcataaaagagcaaaatcaccaaaacagtacataaacaatcataaacagcacatgtgaatatttttatcatgtagatctcaattttagaaaaatttagagacttgaaccaactaaatccgagctaagatgaattagttatgattttttaaatattaaaccggattaaatcagttatttggattttaattggattatgacgcaataaagaattattttttaaaaggaaaaaggatttattgcgtcagcggctcgggttcacggtggaccgggtacacggaagcggtctacgaaacgaacggccgatatctaatctaatcaaaacggacggccgagatctaaccgatctatcgcgggtctacggctgtgttaacaaccaaatttggtaacatcggcgttgggaaagaggattaaatcgaagcaaagtcggaagcggagattgagtttgaaaacagagcaggaatcgattggagtccagatcggctatgatgagatcggctgagtctgagtcgggctaggtaagccagtgtagccgattccgacaatatgacttgtatacgacattgggttcaggatgatgtgcttcaagatgattgccacgcacggatagagtcctgggaagacaattgtatctattaattaggacattttatgtaaattccttatagataagtgtgggcaaaagtctgccgtaaagacttgtgatatcttagagtttgttagagataacagtcgtgtccggtatgggcatatcttgtaattctcgggtataaatagaccccgagacctatgtaatttagaacacacacgttcaatacaatttcggcgcatcgccatcttttgctttagttttattttgacgagttcttactttcgggttgagctgcatcggtttcgatcttcaacaagaggtaaaacttgttgtgatgacttgcgttctcgggattagtgcttccatctttacgatactctaatcttgtttatgtgatttgtcgagttatcatatatcttacataatctctggcaatatcgtcatctaacctataatcggccaacatctattaaggaaggcagccgattaggttagacgccaatgttgatttagattatataaggtgtctaacaccttatgaaacatccagcggtttgattgtctagatattgttctttttttcatacttaatgctgcatcagttgagtttgatctattaagtcgtgcttaaaagtataatctctagcctgctttttggttgctgattagggtagtatcggagtttcagccgatcttatctgatttaactatatttgttttatatgcttaattgacatgttaagtctgccctttatatcaagatcttgttgcatctaaatacgttaagcttctacttgagtattatacttgctttaatatcttaatataaagtggtatcggagtattagctgatacatgctagatctatttgatcggctacgctatacatatatataatcttgttgttaatgtatatttcgatctaagtaatttatactgtctcggcgtggtgaccgatctatcccaatcacttgatttaagtatacatcgatataaagattatatattgttaatatctacagccgatcgagtagatttggtttcttgctacttattgatgatcgccgatcgattcacatatgacatcggctcagagataaatgatatgtcatcggcatctagccgatcggctatcatttatagatttaaccacggtttctttgtcttcgtttcttgtttattgcaggatcaaatcaactggcacgctcatacatccgaaggcgagctttggacctgcactggagttaagcagatctcccaggcctcgtgtttttgtcaacacgcttttggcatgcccagtgggacgcttaagaagtcagatgacagttcttcctcatggccgaaaaatagccaccaccgccatctagcccaggttccattaaaggcaaggtgttgaagcagggattgactgacattattgatgacaacgtcatgctgattgatccagagaaattcacgcctgagcagaaggcggagtttgaagcaactctgcagcaggcacgggatcagttcctgaattcattcatgcagacccgtaaggggacacttgttcaaaagtataaaataaaagtggttgctgataattctgggactagttcttctaaagatggagaggggaaacaagctccagatggctcgactcagccaagcatcaaaggtgctaccgacggctctttaggaaatcaaggtgacaaccctcaaggagtccatggagtacaaggtgatggagtgcatggagctcaaggtgatggtgctcaggggtcgcaaggaggaaatcttaatcagaatagtgaagtggcacaagactttttcaacaatttccaagatcgggtcgactatgctgttcacaatgctctgatcaatcagtccggggtgttggttaacactttgtcaaatatgatgaagtcgatagccgatggttcaatagctgagcatcaggctgcaggcccagtgtatttacaaggaggcgtcttcccaaattatcgtcctttgatcaccgacgctcagccatctattcaggcagttcctcccatcccatcaccagctcagccgacggcaccagcgtcggctcccacgcttgctgtgcaactttcagctccaggccaattgattaatccccaactgttggtgagagagcaaccacaccatgctggaccaaatgtgacccagctaacgcaggatcaggttgcatctatgtttttacctcctcggaacacggttgatccaactcagcagcagccgattcaacaaacgccacccaggcgacaagttgtgcaacctgttcaacaaacacccccaatccaacaggtcgcgcaaccgatccagcaaacaccaccaagtcggccggttgtacagccgattcagcagacgccgttgagacagcaggtcgttcagtcgactcggcagcagggcttaatggatgtatcagctggattcgcatcgcacgctggtcagtgtgctccaaatcaggttgtcccagagcacttgatccatcacgtgcagccagatgacacagtagtaccctaagtgatccctgagcatttggtgcgtggtatccaaccgaaccttcacaattaccagggaggcaatttgaattatcaatatcagcctacatcaccgcaagtccagtaccagcaggccgaatcggctcagccccagttggttcctcagtacaatcagttcgggcctacacctcaacaacctcaggggacacctcagcaacggccatgggccgatgtgatagccaatgtgatgagggagcaatttgggctcaaaccaaaggaaactggaaacttgtaccgacaaccttatcatgagtggtttgaaagagtttctctacctcatcggtttaaagtgccagatttttcaaagttttccggacaagatactacatcaacctatgagcacataagccgatttttagctcagtgtggtgaggcatcggctgtagatgctctgagggttagattgctccggttgtcattagctggatcggcttttacgtggttttcctctttgccgcatgggtcaattaacagttgggccgacttagaaaaacagtttcataattatttctatagtggggtccatgagatgaagttgtccaatctcacgtcgatcaagcaaaagcatgatgagccggtgcatgagtatattcaaaggttcagggagatgaggaataaatgttacagcttgagcttgaccgatgcccagttggccgacttggcttttcagggaatgattgctccgattagggagaagttctcattggaatattttgaaagcttgtcgcaccttatatagaaggtatctttgcatgaacaaaggtttgcggaagctaggaagaactctaggaagattaatcatgtttatccttatatgtatgcgtcggatgatgaggatgatgattctgaaatagctgcagccgagtgggttaggagcaaaaaggttataccatgtcagtgggtaaaaagttctgaaaaagaggagaagtatgattttgatattactaaagctgataagatctttgatctgctactccgagagaagcaaattcaacttcctgctggtcatacgatcccatcggctgaggaattgggcaagaagaggtattgcaaatggcacaatttctcattctactaatgattgtaaagtttttagacagcagattcaggtggctattgaagggggcaagattaagttcgatgactccaagaagccgatgaaggtcgatggcaatccttttcctattaatatggtgcatacagctagccagacagtcgacaggatccgtgcaaagggttttcaggtgaattcggctagggttatcaacaaatatcagaggaaatatgacaagcagaaggacaagcattatgaagaacacgatgatggctttgatcctcattggggttgtgagttttttagattctgctggaatgaagggatgaggttgccatctattgaaaattgccctgggtgcagtgatattgtcgagagttcaagccgatcatataacaggggtaatcggctgaggcaggcaagagtttctgttcatcaaagattgggtcctgtgaatcaagatcgtggccaagaggatgaggtaaccaggaagaatcaatggtgtccttctggtattttcacgaagaatcaaaaaaggagggttcaaagattgaggagaagggagcgcctccagaaggttgaacaagaaattaaccatcggctgaggaaagcaagaccatgacatgagtgccgtgttaagaatcaggttcatgcagccgatgacgttgcagctgatgaggcgaagaagttggcaaaagggaagagtgttgtaacagcaccaattaacatggttttactttgccagctgagttcggaatcgatcaagccgatgtcgaagaagtggaacaggaatcggctaagttggttctgtcaccagaacaggcagtgttcgagaaacctgaggggacagacaatcggcatcttaaaccgttgtatgtaaattgttacgtcaatgggaagctgatgtcaaagatgatggtcgatggtggagctgcggtaaatttgatgccttatgctacgttcaggaagttgggtagaaacaccgaggacctcatcaagacaaatatggtacttaaggactttggtggcaatccatcggaaaccaagggtgttctaaatgtggagctgacagtcggcagtaagactattcctactacgttttttgtcatcgatgggaagggttcttacagtttgttgctcggaagggattggattcacgccaattgttgtattccttcgactatgcaccaatgcttaattcagtggcaaggcgacaaaatagagatcgtgccagccgacaggtcagttaatgttgccagtgccgatttagctctttgggagatggatggccttgattgtttatctggaaaggtttgggatggagattttctaaaagtatccgattctgatatacagccactcaaagatggagaaccgaagctattactttgagggcgtcgtggagggttcaaacgtctacaccgaggacacggtagatgatctcgatgacaagcaaggtcaaggttttatgtcggccgatgatttggaagaaatagatataggtccaggcgatcggccaaggccgacatttattagcaagaatttatccccagagtttagaaccaagcttatagagctcttgaaagagtttagagattgcttcgctttggagtattacgagatgccagggctcagtcggtcaatcattgaacatcggctacctattaaaccgggggttagaccacaccagcaaccgtcgagaagatgcaaagccgatatgctcgaacctgttaaggctgagattcaatgcttatacgatgctggttttattcgtccttgtcgatatgctgaatggatttctagtatagttcctgttatcaagaaaaatggtaaggttagggtgtgtattgattttagaaatttgaataaagctaacccaaaggacaaatatccaatgccagtggccgatcagttggttgacgctgcttcgggacataagatattaagttttatggatggaaatgcgggatataatcaaatcttcatggcagaggaagacattcataagatagcttttagatatcctggtgcaatcggcttgtttgagtgggtcgtgatgacttttggattaaaaagtgatggagccacatatcaaagggcgatgaattatatttatcatgatctgatcggctggttggttgaggtctacattgatgatgtggttgttaattctaaggagatacaagaccacatagccgatttaagaaaagtttttaagaggaccaggaaatatggcttgaagatgaatccgacaaagtgtgcttttggtgtatcggctggccagttcttgggttttcttgtccatgagaggggaattgagataactcaaaggagtattaatgcgattaagaagatcaaggccccggagaacaagacagagttgcaggagatgattggcaagattaattttgttcgacggtttatttctaatttatctggaaggttagagccttttacgccgttgttaagattgaaggccgatcagcagtttacctggggggcagagcaacagaaggctttggataacattaagaattatcttagttctcctccagtgttgattcctccacgaaaggggataccttttcggttatatctgtcggccggtgagaagtcaatcggctcggttttgattcaagagctcgaagggaaagaaagagttgtgttttatctaagccatcggcttttggatgcagagactaggtattctcctgtggaaaagttatgcttgtgtttatatttttcatgcacaaggttaaggcattgtttattatccaataaatgcaccgttatatgcaaggccgatgttatcaagtatatgttgtcggctcctattttgaaaggacgggttggaaagttgatattttccttaactgagtttgatcttcggtacgagtcaccgaaggtgattaaaggccaagctgtcgccgattttattgttgatcatcgtgatgattcaatcggctcggtcgagattgtgccgtgcacatgctctaagtctgtttgcgtagttatggtcagccacacaaaagaaacatgaatctcttctcaaatatatttggagcgtgtcttgtgagctgcaggaaagtctaccgtcccagcccgaagtagatgaattcccaacaactcctattcctagcaccacaaatgaaatgaaatcaacaacatttctgctacctcatgcggggagtgtgtccataacctaacaaacaatatgagcctagccttatatatatagtgtgtcaggctgtcagctcatattagctatgttcccaaacttgggcaactttgggctgaatcattgtgcgcttgcctttgttccctttaaattaatgcaaaaattaactattgcctatcatatgacagatataaggatgtcattttgctgaaatatattgcagaatcaacaacttctccaattaatacttgcagcgaaaaggcatgtaatatagtggttgaagtgacctgagtagcaatccaaggttctgagtttaaatatccatacaatcgaatttcatattgggttatttgaggagctaagttttcgatttaaaaggctgcatatatcctattaaatatagaggccgggtaaaaaaatacatttctctttggataatgccatttataaattttcaggagctaatggtccattaaaaattcattactccatcagtctcaaattatggggtgccctcttttcgaggaaaattaaattcggtagcttttaactaataatcatactaattatataagtatatactaaatattatgcatgttatatcactagattcatattttgaaatactttcatgtgatgctaatttcatatttgttgggatcataaaataaatactaggcaaagtatattattgaagaccgtgtaaaaaaatatagccttataatttacgcgagagagagagagtagggcctgtttgggggagcttctagcagctgcagcttctcttagaatctccagttgtcagaagctccctaaacagtccagctttttacctagattctgagaatctgtagttgtagaatctgtaaaatgaactagggcctgtttgggggagttttagattctgagaaacagctggttggtagccagcctccaagaatctggaaaagctgggttttccagcttctggcttctagttcattttctggattttacaactgcagcttctcagaatctggaccaaaaggctggactgtttgggggagcttctgattctaggagaagctacagcagctagaagctcccccaaacaggcccctagaagcctccagattcttagcggctagcttctcagcagttgcttctcagaagcttaaactccccaaacaggccctgtatttcccgatttactactcaaataaaaaaaatctatgaatggacttgtaggtttgggatggattgggcttaggcccgccctactaatttcaagtgggcccaacacgtccagatgaaggggcccacccacccaaagttgaccgcgatgttacgatgggcctcctctcgacggcggcggacgcggcggtggtgctcttctccctcgccgtcgccgccgcggcgcccctgatcgacgcgcaggccgtcctcccgcgccgcctcttcccggcgcccctcgttgggctccaccggtggtacgccacggagttcggcgactacctggcggccgagccgccgggcttcttccgcggcctcgtctggctggagctcctcctccactggccgctctccgtcgccaccctctacggggtgctcgcccgccgcccgtgggccggcgccaccgccctcgccgccggggtctccgtcgtcaccgccatggtgagtagagtcgtcgcgaccaattctctcagattcaagtccatgttcgtcagtgcctttggtttagggggtatacgtatttatatttggtattgcaagaagctgaggtcaaatactcaaattcatgcttttagcatttgctaattatctgaggatttaggccaacatggggaatttgaagaggaagaagggtacaaatatgaactgggtgattggtgaattcgttttgttaactcggtttatcttcgtcattgcgacgttggggtttacgtaatggaagttccattgtcaggactcgcaaggttatgcttgatttgcttgtcactagacttagctcaatttttatctataattacttaacatacgagttcattttttttctttgggaaatatcctgataagttctaatgttctacacactgatgggatgggcgtctttttaacagttgatggttgcctgtcatgatgtgccccagcgatctgatagtaatgttgacattcatcgatgctattgatgtcgtccagtgctcttttaatacgcacaaatagattgaaatagtttgagcagtaatttgtctcgaagttaaagtaacatttttcctattctaacttaataggaactttccaaattttttgttcgattttgtcttcatttagaagtagaacttcaatatgtgaagaactctccataatcctagatatctttcaaaactataagttagcttgcttcagaaatctaataaaatagcaatgggagaatttgattgacaaaagggtataagaagaacagttactacttactataacattaccttttctaagttagaatcatgcattcgcacgttgattgatttgtctttttttaacgatctgttttgaatcttaccttgtcattaatcttgactttaatcgtttcagtctgcagtactcggtgagtttttggtctcagggcgagcaacacataagctgcttcagatgtatgtcccttttgctgttcttgcagtcattgcagctctgcgcggactggtcgtgtggtcttcgcagggtactggtttagcacctgcaccttcttctcagaagaagaggccctaaggattaattttatttcttgatcttgcggtaaatttgttttttggttatagtcaatcatgtatttcttgctcgcgtgtattatttacagcaacgtaaagatcctcgtgaatgtttttgaacaatcagtgtcgtctccaaaaaggcaatgttcctacttatcttagttctttgagaatttacaccttttcagcaagcggatccagcatacctgttaggttgagaacatttctgtgattataggcttatatataagactcttccttttattttatccactttttaagctctatcgtttcacttattcttatgtctataagctaaaatttaaattttgcaacttaattttggagttgattttggtgtttttcatcatagtttattttacacaatttgttttggtatcactaagaacacaaataaaaaaagtattacccattaattattttttgattgctaataagttatgcggataagcgtaaacataagcaaagcgatgaggttgtttgtgagaatctacaactcgtacctctttgcgtagtttcatttaataaaagagcttcaggactttgagtacaatatttactcttactatattaatttttatgagaaaaggttaatctggtttacatagtaattctctcttttaataagagcaatgagggataaaaacggtgcagaaacggatggaaaccacgttatcgttttcgttttcatattttttttggaattggaatcggaatcggaaaccccggatacgaaaacggaattaaatattattgaaaccgaaaacggagtgaaaatgaaccagcgcggatacgataacgaaaatttatcgaaatacaaaaaaccttcaaagcgagcttcaaacttcgatggacaaaaacttcaaatagacggcaggggacgagacgacatgagatctagatgtgtcgcttcgccgcccggctctagaatcttcgatgtcgaagccgcccggctctagaatcttcgatgtctttctcagtccctcactctctactctctaagtctctaggttacgtgaggtattatagactatgggaggtatcatactgaataggctggcctggggaggtattatggattatttgtattttatgcgcctgtaactttgaaaattccgaaaaagtttttggaaagttttcgaccgattctga

SEQ ID NO: 5358 - DNA, 1640 bp, Oryza sativa
aattgagtctggtcgaaatttatctatttcgtttttaactaattgactgtgtaatcagagcagtttgcaatggtttgacagccccacggtcaatggatacagttggcatctcaactaatgaatttaaatgcaatagtttgacagccctacggtcaatgatacagttggcatctcaactaacgaatttaagaaacgttgaatgaaactattaaaaaaaatcaagaaacataagctgtgcacatctacctatcaaaccatacagggaagcaccattcgtgtcgttagagttgtgagtgtacgactccattattacggtttaaatcctaattaatgttcagagactatggttgtgcataccattagttggtgtagaaattgcaagttatactttgtaaaaaaaaaacatcaaaccatatgcacagcttccgagtcttaactcctttgcctcaacctcaaagcaatagcagatttgattctagtgcattctatttttttttcttggagaggtagtgtagtgcatttgtttattgttttgtacatcaaaacatgtcctttttgaaacaagagttaaacttttaaaacttgaacattagtatcttctgaaacatttaagattagactagatacgcgctgcaaatctcctaatcctgctccatatccgctaatcacgctccaaatccccaatctcgctttccaaaaaccacgctttctttctcctctgaaatgtatctctatatatacacgaatcgagttggtgtgcaactgtacatactcgagcaggcagagcaaccaggccatcagatatctccacggtatgcaagattattcagacatgttatctcagtcttgctttatctttctcattagtatttggaatatagtgttatccagtttttgtgatatatatatatatatatatatatatatatatatatatatatatatatatatatatatatatatatatatatatatatatatatatatatatatatatatatatatatatatatattgtgccaagatcattggcatattggattgtgcggctgtctcggttggatgactatgctctctttctaaaataagagttgaaacttatcggatgcgtgtttatattcttgatgagggaatgaacaggggtgataacatttaggtcttaatcaaactattcagtaaaatatttattaaaattatggcagtcattgttcttgctacttctgaaattgtcttcgcatagaaatggccccaacgaatctaaaccgaaagagaacgtatgcacagtttgggcgccgtgcaagacctgttgcgcatgcaagacctgttgtgcatatgtaagttagttgatgaattggttagacttagtaaggaatttatattgttgtgttattgactgcttgtttgtttcagaaggttcaagtacttcgacgatgttgagtttgatgattgcagggtaaactgaacatttagtgttattgtcatggtagaatggtagatgcctagttccttgccgaggttgatggtgacagacaacccttcatattgatggatgctactgtaagtttcattatttcaatatgaaaaaatataaacaaaattaaattaaatatgattggtacaattgtagggcttgaaatatg

SEQ ID NO: 5359 - DNA, 32669 bp, Oryza sativa
aaaattgtcagccagcatatcaacattttcagcattataagctctattcctaaaaacttaccacaaatatcttattgatgttatgacaagtcactgaattttgtgacttaaatatcgtgtaccacccacacgatattaagatcagctgtggcctgtggatggtactcaaccaccacatatatgttcctgtatggacaccatctgcacaagtaaaattcagaccaaacggtcgagatttattattggacttgtttcctcgtggctatggggtattcttttgttaggagcatagatggttgcaattagttcttcaaaaggaaattgaacaggagaaaacacaccgacccatagagtctggcgggcagccgggcagaattatcctccatctccattctccacggagacccgcttaactagcattgggggtccaaatttgatgtacatttgcgtgtttgaagtctagctgggctatgattactagatgaatgacaatcttttgttcctatcatgtgaattagtgattatatgccgatatattgatatgtgttatattacatttatgatatgagatgtacatgcatttttaagcgggtacgaggagtgataaataattcccccagagggcagggatgggaatcatgtttcctcagtttggggatggggaattttccaaccaataggggtgggctgggatggggatgtatcccccggctggcaattctgcatgaaactgtctcattgttccttgttgtggaactcatgagtcatgaagtctaatgtagtagcatatacgtgtgagattctatataacaatatcatcgtatgtagtgggtgacatagcttgtaacataagaatattgtactcgttgttacgctcatgaaacacctaacaaagtaacatatacatatgagatattatataactaacactaaaaggagttctcgggatttatttatgtttaagaaataattgaaccttaaatgcatgtttgtctatctggtcatctccaatataaatagggagaaacttaaatgactttagaagatatttcgttgcttttccattgtcccaattgattatgagtcaagctctaaatcttagtacaaaagcgatgagaaacatgtttggaaatgaattagaagttataacttaaatagtacaaattaagtcttcatgccaactttctatgagtcactacaagacaaaaaaatattttaatataccataactactccttcaaccaacttccaaacttaaattgttgcaattaacagaagcattatttgcggtaatgattagattgttatcctcaaatgtttctccctcgagttttccaatagtcttgtctacaaactttaaagtctattttgtagtaaagactttcatattatgcattcatatcaaattacacatgttgttgtttgtatatattaaaattttgaaccttacctagctactcataggcgcaaactcgttctttggccagaggagattggattttcactctataaatggaaatttaaaaagttgatgatatcaaaagtcaagcataaagtaacattatagtacaaacttaatagcaatattatttcgtgctacatgttcaacaaaaatattatttcatgctactaccatagaaaattatgataaaaaactagtggactttgctaatgattatttcacctttttacaagcccgttaagaggggacttgtgcccccatgttaagtaaaaggggcatgtaccctttttttctagctaattacattttttttaatatcaacttaattaactaataaatatattcagattacctctcgtaccttcagtctttcaacatcaaataaccaccaatgaataaagtaaagtcccgataactacatcatatcattgatttcctcccactcatagacccaacaaaaattagtgtagaactggtatccttaaagcataactaacataatgttacattgttgaactgcaataaatattaatttcgtatttaacaataggatgcttagagagttcagatcattctactttcaagttcaatccaattcatcctgcaatgcttgctttgctaagtagttccaacaatatgtaaattactcattcagaaaataacccaagatatctatattgaattgtaatgcataattgcgacaacgtgtgataacaagatatttggatcttgcatttgtccaaggatatattgacaacagatcggcatacctcgcaaccgtgctctgaagggtattagtgtgatggctagaagagctcctggttattagcatagttgtgctaggacttcttagctgatgctatagtttgtgcttttgagtggttgttgcttagactaagagtcgatgactttgtggtttgtcatgtcatgtacatattatgttgctttgattattgaattttcaatgactatgattctggactttaatgtattgcttcaatgtttgtaggaattggcttagattttctggaactttgatgtttaacacgtaatgttactgatcaagctttttcaaattcactgggaccttgtagatgactaatcattgcaccattctccatttatagcattcaagtagctaataatgtggttctgtcatttgtagttttgtacaatgaagattgaagcttgtggagcagctgaaatttaatttatcaaacaatgcttctgtccaagcttgtgacgaccaaggtgctattatagttatctgcacagtgaggactgaatcggattttattaaccattcttgtgcttgcattgcttcaccataactcaccttcttttgcatgatcataatgttactcatgtctctgtatgccgtgagttaattttgtgtttaactaagtcaaatattggtattagcattagagcggtattattttattttttactatgatgttctattcaattattttgtttgttcttgttatttaataaggagcactataaagatgtgatgtaattattgtgtattaaggttttcgatacaacaaacaaacactcgatgcctatttaaaatcattttccttagtgtttttgaattcataaatatatttttttctctcgttgtaggacacccaattagtagaggaagaaaaaaagggtaatctagtccaaaaaataatttcagcgtattaaagtggtaagtagtgacacgtttcaaatacctatcaaattataatggcatgatgattttaaatacctatcaaattataatggcatgatgatttcaaatgggtgaattataaaaaccatcaaattaaatttataatgggatgatccaattaatcctttcccttattaaatttgctcgaattttggacatctgtaagttagtacctcctcctttgacggacgcgtcgaccatttctcctcgtcgagatctctctatctctctctctgctctgctccaccgggcgtcgcggcaatgggggtggtctcggcggcggcggacgcggcggtggtgctcttctcgctcacggtggcggtggcggcgccgctgatcgacgcgcagtccgtgctcccgcgccaccttttcccggcgccgctcgtctccctcaagcggtggtacgcccgcgagttcggcgactacctcgtggcccgccccccgggcttcctccgggggctcgtctggctcgagctcgccttcctctggccgctcgccctcgccaccctctacggcatcctcgcccgccgccgctgggccgccaccacctccctcatcgccggcgtctccaccctcacctccatggtaactcacgccccccttcgctccctcccccgctgtctctctgcttcagcgttcgagttcatgttggttgggagtaaatgggttgcttctgcatcggatctgcaacgcgcagagggttgattttatttttcatttttatgggaacacacagacctaatctcagattgataattttattttagaacaaagtaattgtcgtcctcatggattgcctaagctcacttgtttagagggttcgatgaaattgctctatattgtttgttgatctgggtggaccaatgaaatttcttaagtccaactcaatgccgcgcgaattgctttttgatcccattttagttggtactattgtttgtgtttgtaaatgctcatagtgcgctccaaacaagaatgtagatattcttctgttttattaatgccctgctctgaagcattgagtcattcagagtggaaatgattaaaagctcgactgatttgagccttaatctttccatccaaggatacaatttctttgtttgttcttttgggagttgggcatggttctaatatagtagtcatgacaccttgttattgggcatagttttgacttttgacaaagcaatatccaaatccccatcataaaatcttaactgcagtcggcacttgctgaatccctacagtgatgagccataatgttggaagaaataattaagagaactacaacgttcatttattgcattgttacatatattttgataacgctggaaaacagacgatttgtcattgtttttataatttaaatgttccttttgcttgtaaggtaatattttgattagatttagcgcatctctaatgtaagaaaacatataaaaggtgtttgagtttttctttttaaaaaaattctgatgataaaagaacttaccatgccaatgtggggcacgcaatctatctagaagcatgccatggcatggtagcttaagcagaacacaaagttctctcttgtttttatcccatcccaagataccggagagtctggcctataaaatagagaagcatgtagcccagcacttatcaccatccacctagcagctctgcccagatccactttgtgttaagccagtttattaccatcccaactatccactcaatatatttcatgtactatggatgtattatctgaaacataattacttttttctgttgcgttaattaattgttttatttactggcttccatggtgtgttcactttacatgtcaatttcactttctgcactcatagttgaggatttacagtctgtttgattaaatacccaacaggccaacacattttctttggtcagtttttccctttcaaatatacatacaatttgtgacttcttattacaaatttgtcttagtttcaagtttacataactggtcatagattcacagtgcagaaggaaagaagattaggaacagaacagttaatgcttgcccgaacatttatgtacaatcaattcactttacattttttagcccaccgagcttctatatccttgtttatcgttaaggagcaaactgtagaaacgccagaagacatttgttacatgaacgttcaatcgccatgcatgctaagtaacctcagtcaatgtcattccagaattcagtctgagtgccctgaatgctcattgatgcctcttcttcaatgcaaactgcaaatggatacaaaaaacaggacaatattggttacataggtcatgcagtaatcaagcatatcctataaaaaattattagaaaatcaattctgttttggaagaaacaaaaagatattttaatgaataggcattcttctaattttcagctttcattatctaaaaaatttctccacatgtagaatgaattatataatttatatttgattctttttaacatggttctttgttctgtaaattttattttttattttttattctttattatgggtttttttttcattactatttatgtcctattttgaattgggtgcatgtgagtgcatcctagtgggaagcatcagatatttttctagctcgtaatgaatgatgtaatgtcatctacttgtactagatcattgttttgacatgtttcataatgtttgtttataatcatttcagtcagcaatacttggagagattgtgggctcgaagaaagcgacactaaaattgcttcagatgtatgttccttttgccgttttcgctgtcatcgcaattttgcgtggactttgctcgtctgctccgcgtggtactgctggttcatcactcggaccttctgctcggaagaagagagcctaagatgctgttcctgtttaccttacgtcaacaagtgccttgagaaccactcatttttttcatctgatcatctcaccgaatgcttactttttatgaagaaggtatcgctgatgatgttggtcgtctcacaattttcccctcggagctaaagcttgtaacatcttgtgcagatggcttcgaattactagtttgttttttttttctttataaaggattgctgtactgtgggcgtgtcaccaatgtaagactacgcgatgttatgtattccgtccatagatgtaaacttcccgggagaagttactatttgggaatgaaaatttaggagagtggtatttgagcactagtagtattttggtagagtggcaaatactagtaaattctccctcatacggcatgcatgtatccatctattttgtaccaaaggtagtaactttccttcatctattttttaccaacggtggtaactgactaaccgcacggcctgataattattactgagaataaaagaattgttctgtagcaaactagcattccaagcttggatattttttttaaccataatccatccacaaataatctgttcagcagagaatcatgttggaggaagtagaggcgtgctgcttagtttgtgaaagaaaactttggatccttatatgcttatccaaattcgtagccagagatagcaaagaatattttattattttggaatagaggagtagatatcatgttagtctagatcaaggttttctttgaaacctatcatctctctttttttgaagtactagataaaatgcccgtgcatggcaacgggtgaagtttattttaatcttattattgttatatggtttagttaatgtgaaattcactgtgggagttcgcttagatatatgtttttctagaaaatcataagctggagtgaggagtccgatcgtctcaagttagcatgcgagttttttgaagtttattttaatcttattattgttatatggtttagttaatatgaaattcactgtgggagttcgcttagatatatattttttagaaaatcataagctagagttaggagtccgatcgtctcaagttagcatgcgagtttttttaacagatttcttatatgattccttatgtattaccaaaagtgaacgatcttaaaaaccgactcaaatacgaatatttatttctaaaaacaaacgaatttaaaaactgactcatacacagatgacgtaccaaaataccagcaaaaacatcttcaatttttataatagtagagatatgacatggttgattttttaatagtttgtttgactatcatagaaaatcatcgtagacatacttaaaagatttttttatgacagatctagtgatttcttttattttacttaactaagtaattgaataaatagtattggtcaaattttttgaagaaaaaagaataaaatatcaactgcgaactgtaaaattcttctttccaaataaaattaggttctttgttcaaggggtgaaaatggtcatgaaaattcctgaccaagcgagcgtcattttcgtataagggattggcaatgtataaattttgtttttctatttctttctgtatcgtattaatatcgacactgagtagtttaaatgataattatcgatcgatcgagcgtcgtttccgaagagatgctaccgattccgaccattttcacccctagggctgcaactatatagccacaaaaaaaacttttttcttgaatttatttttgaaatttgttctttctccactctctttctctctgttcgtttattatttattgtaaaccagactctcaataaacttggacatttaactatttgctactcatatgtaacatatgatttcatggtttctcattttctattacatgtgggttcatatagttaactgtcaaatctaatagtggcaatcaggtaaatatctccaataaaccagccgagagccctgaaaactcatctactcgcatcggccccgcgccgccaccggagcgacagcttccgtcgtcgcttcgccttcgattatccccatcccatgcaaaggctgtagcagcgctcaaagttgcccatctcaaattttagaagttttacaatatgatatttcggaatttttgaccaaaatttagaagttttcgtccaggggtattttggtcactaggacaaatttgtagacggaggctaactggacggagatggtatattatagaagttaagcaaaatgcgatggcatattagaacttgacaaatccagtgacatgttataaaatagggacaaaatcagtggcacaatggattctctcttttacggttgttcacttaactacttatctactatggtgcaacattttttttaaaaaaaaatcaaatcttatactataaatccatatcttacacatcaaattacatacgcttataatacaaatttcaaattatacaatgcactattcgcattttataggagaaatatggaaaaacaaatttattacttaattatgagaaaaaaaattagtccaaattaacatatatttaaaaaataaaaaaaaatgaaagaattaggaaaatagcaatatagttatatacatactgatcatcatatatcatgcagtgagaaaaggagaccatgatcgaatgctttattattgagcaaaattgatggtattatttttatctttttttagccagatctatctaaccataattaagcaatccgtgttagtagaattttgtatcgtcctgtatcaatatatcatgagattattagtaatagctaagtacaccgacccaaccatactgtgcagagacgataaatgggattggcatatcacgagactattgggtaatggacaacttatcattaattgtgctgtagaaaaaagtaaattacattttgtactatgtattcttaaaagttttcaaattatatcatcctttaataattcttctcatttacacaaaatctaactttacatttcaatttagaccaccgcattctatccatctccaagtccggttactctgtaaccatatcgcatactaactctctctccttttttttccccttcgacagttgggaaatcgtcagatctagcaaggaggagaccggatctagcgtctatgctcttcatcgggtcagctcctaccttcccgggtccttgcaagcccaacacctccgacctcaacggcgaccataaaaatagcgtgcatgaaaacaggggaggagaaaagacatgtcggtgactagaggatgcggctgcacatgcaaaggcggagaggaggatgtgaggaaagatggtggctcatggagaaagagcggtggtggcggtgcgtggagcggcaactagtggttaccggaggtctgaggagtttgctgtcgacaaaattctcaaccgagtttgttgcatttttttctctaagtattgctgatgtgtgggccgcagtcatcgtaaagaaatagctagtttaaaaataataaaaaaattgagataaaggtggagtactcgagtagggacgaaacggttcgaaaacggatgaaaaccacttttatcatttccgtttccttatttcttttgaaatcagaaccggaaacaacggatacgaaaacagaatcgaatattatcgaatacgaaaatggagcaaatatggtaacgggtatttatcggactataaaaacttaagctgaacttctcaaatcaatgcagatgagcttctcaaatcaatgaagagatatagttcaatatcttttctaaaacaataaatcaatatttctattttttatcaattaataataatacaactagttgtacactttattttcttggaaaaataaattatattcatccataactgcagttataagtactatggcacatagtataaatctaattatttagagttgaaaagtctaaagctaaacagctgcatatgagaaatacttcgtttccaattttgagaagaaaaaaactgaatgtgtttccgaaaagtttcctacttcgtttccgacagatagtagcattatcatattcatttttgtttctgaaaaaaaaatatgtattcttttctgtttactaacagtttcatccatgtaactcaggacatttaggcggtgttcgttcctgtgggttcccaacctatctcaccttgttacgtggcccaggtcttggtcgttgtagaggcgacggatgctctatctggccactacccaccaagaagtagagataatctccatcacattggaacccgatggtgtcccccatccggttctccagttcgcaggagaatgtggtgtggttcgcctctggctccggctcagaggcagagcacggaaatccaagggaacacaccggcggcaaatcgaactctggtttttattttcttctgactccacgcaacagggactggtggtggtcgacgtcctggtcctgttggaggaaggcatgcagaaaatcgggcggcgaccgcctaaggatactcaccgagtatggtagaggcaatcatggtaactaccaattttccgcgtatacgcttttcaaactactaaagatacacgttttgtaaaaagtttatataggaaagttgctataaaaaatcatattaatctatttttaagctttttatagttaatacttaattaatcatatgataatatatcgctccgttttccgtgtgaagggttggggttcccggccctggaaagacacaggctaaatactttctccgtttcacaatgtaagtcattctatcatttcccacattcatattgatgttaatgaatctagatagatatatgtctagattcatatatatgtctagatttattaacattagtatgaatgtgggaaacactagaatgacttacattgtgaaacggagggagtatttgctaaccctcgtgtgttaatacgttggtagcgtaaaagaaagaaaatctgccgtctcgtctgctccgctcatctcgctgctgaacaggggagggaaggggaggggaggggcgctgatctccatctcatctggcgaggggagaggaggtgatcctggtgagcatccacatcctctttctgattcatctctctctcccccaccgggactactttaattttgcttgcgttcgttcgttcgttaaccctagcttctcttccagatctggaagaagctcttctcttaatttcagagagagccttaaccttagtaacagtttgtttgttccccgaaaagttcccaagttggatccgcccatgaataatcaataaagcgagatggacgaaccatcatcatcatcatcatcatcatatccatcttcctctggtgggaaaaagaagcgaccacgctctcctggtcacagcgatgagcgtccagtgcacacaacccaaatatacacaagcagccttggttcgttactctcctcgtccaaatttaatcgaacaattgaattgttttatgttcggtgatgattattgctttatatttcagttaccataaagatttattatctgtttgatgatgcagaggacacccttacgttcagtgataccatgattgctcttcaactgatgcgcacacaattcccaaagctagagaaggtttgcacgcactttgaaggttaaatttcatattcagttcttgtcaaaacttgattaatctgtccagtttaaactatttggttcaatatgttttgattgcctagatagttgttttctgtaattcacccgaattgcatccagtatccacataactgctgtatgatttgtcatttttcaccaagtgaatatcatctcttgtttcatatgttctgaacttgatatctaattgaggtactggtaagcaactaaacacagtttatttatacctctcaatgcacatatatgaatgatagatttgagaaacaaccaagttaagttggctcaagtgagtcacttgagagttgagactctagatccctcagttgtgccaatatgctgtaggtcaggtgtaaaaaagcaccttcccaagagatatcaggcgcaaaagaaacaaaagttgttatgagctatatacaagatttaatggaaccaaaatgaaagttgggttgttatactctttgttactacaaataactaagacagtcagagattacagatttttgcattttctttcaatttttattattaatatctctctctagctttgtattgctaggataatcagtgtccaattgggctttatattgagcttttatctctctctggactaacatttttttcttaagagtcattgattgccatttgtgtgtaaacattacatcctgttttatattcacttgcaggttgtgacagaaccattcattttgcagtcacagttgtatagtagtgtgaaggacaggacacaagttgatagagaccttgaggtttgtcttgaattaatgttatcatacctttagtgtagcattctagcatgcctattgtagatgcagtggaatctgtcttgcctttctattgttttctagcagttcttatttgaaattttgaatgtctttcatcttaaattcagcataaataatagatgatcagtcatcctcatactgcacaagaggttcattgagaatttaaacctttttttggctgtagtccttgaagaaagacaaagtattgcgtgtattcaaactcaatactgggcaggatgatcatgcaatcatgttcatggatgattatctgaaacaggtatctcttagtactggtttggcattaaacatgtatctaacattctgttttatgctcaccacctgctgctattactgtaaaggcggagtagtcctccttccgtccctcctcccagtgcacgcacagagcacacgctagagataaaaaaaacaaaaaggccggcacattcccagtgttattggcctgttgcaatgcacggatttgttactagcgcacactaacaccaatctagtttggtgaaacaccatgcatcgaaatcgacatcatggtgttacatggcatcatcccaccatttgctatggtaaaacggtactcaggaacgtgttttttagccaaccaagatattgtgcctgtgtgccaaactttcacattcaagagtgcacttctagagtaggttaatgtcatcccattttgtctcccttgtagaaaatttcaactcctgcataaacactaagaatctttatatctaagacaaactaacgatattctggtgagcaactgcacacataaacagtgatggctgttgcaatacagtataagtagaactgatatcgaacagtagttacacacaaaatttctgtacgcttctgaatcttgaaaaattttacttggtgttgtggccatgtccttgggaatttagcttagatttttagttgcatcatttgttaagaaaattgcttgttaatatgttatagctttattcactcataataaaatttcagttttatctgttcaattctaactatccaggaggaaacagataatttaccacattaacttcatacataatttatcacattaacttcatacatttttacttaattttttggttaatttgtttctctgtacactaaacatatgcagatggcgttggcagtcaagaggtcaaggggtaaggaccaagatggtactgaagtttttgggtggtttgagagatatgttattcatttgaagcttgaagttagcattgatcagcgcgatctggtaatttctgccatcacacaaggagaattgctagttacttcatatagacaatttttgtgttaacctttttgtttctttctggccatcaacattactgtttatagtgtcaaacctaaatccaagttttaatatatatagaacttcgctataatctgccacagaatatttggatttttttttctattcttgacctgacattttgacttagcctattgttttgtcatgtgctaggattatttgggatgaaacagggtgaaaggaaataaattggattataatagaggaaagaacagagaatggccctggacctaaacggcgcgatgctctccgtcgaaccgagaaggcagggccgatgggcactaagataaatcttaatctaatgcctcactgacctgagataggatccctccttatatagatggaggactccttaacctaatcctaacagaccccgactctatccaactgagatacgtacttattgtgaggttgggatatcgttcccattgggcctaggactcccggcccaaagcccatgacatgtttctcaagtaaaggaacacgattaacacttttcacatcaaaagatatcttacactaaaaatctgttaaagatatctaacatctttggttttgtgttgcagttttctctgttatcacttggaggtgatgtaactgacaaacatatcacattactgatgaatgctggtctcttagtaagtattgtcattgatgatgttatgtcagaatagaaacgacaataaggaaatgatattgaaaactctatacatgagaagaatacatgtgatgtcttcactaggataattattttcatgtttgttagtcaaatattaactacacataaatttaaacataattaattttcttgatcaagcatgcttactgtttatactatctattttcagactcgccaattaattgatccaaacatgtactggttttctataccaagtattggtcccgtcttgaaaggcctaacccaggtttgtgttttctttttctttgttcaatggtgtttgttgatcttaatgcttgctagcgtagcttgtggcatgcattcattcatgcatgtgtatcggtgaggtagcacttaattacatctttctagattagcttggtgcagaccaatttataggaccatgtatcatatatgctgatcatattaattgttaaaccttttgcactaagcaaggaaaaatacacacaagttgttccatatgtttctgttttctgtcctatggaaaaatggggttaggcttgagccattttcgacatcctgggttttgcatatcgaatatcaggatcaggcattgacctttgtaatatatacctactaaggcatcacgttatttgcaattccattgggcaatattgacctttgttacatctaccaagtaatatacaggcgcatttgcattcaacgtagctttgatacacatgattatgatccaaagttaattcaaatactttattcataactacacaagttgaagtcgatggatcccttcagtatgcagtccagctcttttttgtgtgtttctagatgtcaataaataaatgttcataatttttatttatttctaaatctctgtttgcaaacacggatatctttcccaaactgtggtaactgaactcttgagaaattcctgtgttctatataggacctcaacagaattgtcaaagttgcttgtagtaataaaaataattagaaattttgactatttgagtttctcatggagagcagggaaggaaggaaattctttcattattgaaccgcaagaagtacaaggagatgctactctcttcactggagaagacaagattacggttttcacctcttgatgtgcgctttcacattcgcgacttaattggatctgggcacataaaaacagttcaaacacccactggtttacttgttcgcatatcaaaagattgataaattcgagtttttattatttgtttggttatctgcttccggcccttaccttgtgatacctgctttagttttctgcttttatttgccaacatgaaaaacttctggtacatctaatagaattcttggatgcccctgattgttagaccaaaagcctgaaattgtcaaatctgtgacttagcttagtaatttcactagctcagtgtttaaagttcctcgtagaatcataggactgaacttctggatgaatagccaaaaaaaaaatgttcgatatttttaggactgaactttttgatgactagctcaatatgaagtagggctgtcaacgagccgagctcaagcgagctggcctctctaggctcgagttcggtacagactcgagccgagcctccttagccttcgagtttagagttgagctcgggctcagctcgttctgagcttcgagcctcttgtcgagcttgtcaaaagaagtttaaaaaatcaacagccggcatgcatactgctctgttacagcacacatgctacatgcatactagtagtaggaatagcttttatggggacttgggtttgagaaaagtagagcaggtactactcatttattggccctgtttggatccaagggttagagtttgaggttagagttagtttctagctctcaactaaccctgaactaactctagccctagaggtgtttggatgaaagggctagattgacaataaatatacttttccaatcatttggctcctttccaaccggatttgatgtggcagactcatgtgtggcctcctccctctcacaaatgacacaaacaaatcatatttcaaaccaagcatccgaaacacgataaattttatttgtctgtacaaatgagatatcacactcaacatacacgataggtagtttagtccatacaaattaagctagacaagaaaaaattacactccataaaataaagcttgagcattgggttataatttttatcctcatcacaggcatcaaattccctatccgcaattctgctctctcgaatgaaattatgaagagccatacaagcaacaataattctagtttgctttgcttctggaaaacttggcatgttcaacaagatcctaaatttcatcttcaacactccaaaagatcgctctatgacattcctaactttggcatgtgcatggttgaaggtttctttcataccttgtggcggcggtccatcgttccattgcgcgacatggtaccttgtacgtgtgtatggtgaaaggtagcccggccggtttgggtaccccgcatcaaccacataatacttcccaacatattgtgaaagtgaggcacacaatgagacttagatgaacaagtgcaattaaagattgttgcaagatagttcaagtagcaaacctttgaaaactctcatgtcatgtgccgaaccaggccatcccaacaatacaaaggtaaatctcatgtcgaaatcacaaacaacaagcacattctgactggtttcattatgcctgttcaagtacggaaccctcttactcttaggcaccacaacattcacatgtgtcccatctatagctcctatgcagtcgttgaagtgtggccaaaatgctggattttccaagtttgggtgcacctctgaaaaagttgggtccttgggtacaattatgtcatgagctaacctaaggaggcatgtcaaaactctattaaatgtcctgcttattgtctccaaagacctccttaaacggttctcagcctgtctaactgactgtggtgaaccaacaatccataaaaacatagcaagagcctctatagatgtcatttttgtagtggacttcaacccatatgactggaccaaagtattatgtagcctgttaaataaaggtctctctaccctaaacatgttgtagcattgggtatctcgggctagtgtatccatgacccaatccataccaaaatctccattgaccctcttaggtagtttcacaaaatagttatcagagtacatacccaagataggaaccaattgcacgatcgaattctctgcatgcaccagattgttgcggcacatcgatataatctcatcctcacttgtgctgcctccatcatcttttgcttcctcaaccatagggccatgatcttcttcctgcttcaacacatgtaaaaaattgtcaacactcgaaaataatatacagataataggttcaacacacaccgataatagtttcaatacacagataatagtctcaacacacagataaatagttcaacaactgacacacagatgataggttcaacacacaaataaatagttcaacagacatatgaaagcaagacatcaactactccaaattgttgtccctgcaccatttcttgaagtaacccaacctaagctcaggagttaattggccacagaagaactctctttgatactctgtttcgaacatcttggacatagcatagacagattcaatggtttgctctacgccacactcaaatgccagctcctgacacctcttgactgaaaatgcagccttgtcacttgcacgtttctgcatttgcttagtgttgactatgacagcttctttgaaggtactggctatgtctttcacaatcttcaccattgggctcttgctcttcttcattggactggacaaagtgcttgtagtgctacttaatggcctcttgcccttttggctcttgctcctctggctgcttgtactactaggtgttggttgaaactcctcgtcctcttcctcttcctcttgcccctggtcctgaccataatcatctccaggcacaagggttgtgcttccatccacagtgtaccctctgaatagttgatcaagcaactcctcgttttctggaggaccccattgcagcctctttagttatggtttcttctgcagcgataaataaaatggatgagcacatatgtactatactagtgcacagataactgaattacatgctcatataacctaaattacagagtactgtactatcataaaggaagagtatagtttatacagcgcactgtactatcacacaaataactatcacaattcgtgttgtgtttactaagcaaatgtttttataataaggttcctcgtcaaatttttgcctacttaatagcagaaagttagtaactacaacagtaagtcagtcctatgagagatcagttcattggacaatttttcgcccactggagctagcaacactgaaattgggcaagcactgtacacaatttgaaacaatttgtaactaggaaactgaaaaatagaatacacagattggctgcttatacctctgtatgtgttttccagaacaaagactcagcatcaatggttccatctggtaacctccccaaccctgtgtgcgcttgcaagtatcgccagaaagagtgggtggttttcagtacgagtatttggttcttcacctggcaacgggtatacaccaacccccttctatacccccttctatcaagtaagccgtcgacgatggcttggtatccttcaccactcatttgtgcaccattatacgttcctactctacgctgctcaatgcacaattctaacaagcaagcattattaacttcattccattaggctcgactagcttggctcaccgggggtccgccggagctcgcaaactcctccacgtcatcctccaattcttcatcttcattggtgaagggagcgtcggagctggatgcttgcccacggacggcactcctcggtgcccggggacgcggtaggcgctggcccctgccaccggcacgtaccgccgtgttgctgtgctggctccggcggccaagtgccgtggcggccgaactcgagtgctgcaaacgcctctccccgaagacaacccgctgggaaagctccaccatttcctcctccgcgaccagctcctgccgaggaggagttgccaaagttcagttgccgagtcagatttggagtcgcccttccgtctccgactccggcacgcggtgggcgatagggagggaggctggagcccctaccgcggccagtgaggagctcgtcgtcgtcgccctggaggaaggctccgtacatcccaagccccgggaacccctccgccgccggcgcttgcgagttgaggtcgaagccggcgccgacagaggaagcagtggtagggccgctcgccgacggctgcgaagcccacgcgctgaggttgtcgaagccatctctgtccatgcgtggtcggcagcacagattggtggaggcggcgacgcggatggtcggaggcagcgcggctcggggtgtggcggtggcgctgagattggccggcagcgcggaatagtggaggcggcggcgcggttggacgaaggcggcgcggctcggggctggcggcggcactgaggttggccggcggcgcaattggacggaggccgcggtgcgggtaatgggggaggccgcgccacgcggatcggggacggaggcgcggattagtggtggtggcggtgtggatcagggaggcggcggcgtccagcgagaggatcccgtgcgagatggggatccggtgcgggcagcgagagagagaaaagtggcttctatggtaggccccactcaaactagctccaataagcacctcttggaggggctagtttttttggtgggttagatgcaactagccccaatctaacccctcatgtttggatcctttagggctatttgagccccaactagctcaaactaactctaacccttggatccaaacagggccattagctgttgacatttgcttcactagctttagccttccaccgcgaacgaccgcatactagtactagttccaaaagcaagtaaagctaagtactggcagatttgaaatgggcaaggaaagataaaggcacatgtgggcagcttcctaagaattgatagggtcgacgaatagctcgagctcgttcgacagagctcgcgagcttagaaacaagctcgagttcgggctcgagtctatacgagctgagctcaaatcgagtctggaacgagccaagttcgagtagctcgcgagcctcgagcttttttggcagccctaatatgaagcataaattggaagggcacacgcgcagcacaaaatatcatatgttttgctataatggctttgtcgccattggacagcgtcatttcgtagttagggattttagaacgcaaaatctaaactgagaagcctcttggtttagtcttacagttagacaccactgaagccattactctactgaaaatataatactagtccatcaagcaaataggaaccacatatgcttcaaataaaattcaattaaactactcatccgatctacgatccggttacatcgttgtgatcgtaacaattaaatctttataacaagatctcacatgattatattatattttgatgaaaaactataaattacttttaaatatatttaaattacttttagatttcattaaattacttcttagacatataaaagtaaattcaataaagtctaaaagtaatttacatatattataaaagtaacttaaaataaaaagaaagtaactttgtcacgacattagaagtaaattcgttgtagggataaaaatatgactctatctagaaattaaatttaatcaacacatgtaagtttaacaatttttaaaagtaacttcaatgttaattggaagtaacttttgcatggttcagaagtaactttctataaatctgttttaagcattgatagtttttttttcctttcacttttgtttttgtttttcatgtagtatgagaaaagaagataaaatctttgatggattgtaaataacattgatggagtaactaatgagaattaatcatgtataagatgtaaaagttacttcccgataacttcctaacattgatggagtaatagattacttttaaattaataaaatgtttgaatatatttaatatggatctcgttttgtcatatattttcagtggggtacaatgatgcaaatagatcttaaaaacaaggtaaaatttgctacaggacaaccaaaaaatgtgtaattatctaggagacactgcaaaaacgtgtttctgctgtaggacaccgcaaaaaattggtaattagctgctggatacccgtggaattattttattatatccggaagaattggagagagaaatagttgtgtaaatacggttctaccctttgattttttttttctttttcttttttcttccttatccttctctccctctctcattctttctcttcctctctgctctcaaccgccgcaggcgccacttcgcccaacgttgtggcgctcacccgccgtcgccgctccgctcgctgcgctcgcccgccgcctctcctcctgcggtacagcgccgccaaccaccgcacccgcagccaccggaatgcaccgaacagccggcttcgcccgccggcgccgccgccgagcctcgcacggtcacacggcggcgcgacgacgcagcagaaacttgcggagggagggagcggcgacgggatgggcactgagggagggagcgcgcgtggtaacggcagcgcgaaggtagcagcggcgactgcactcgagggagtggcgttggcagcggcggctgctgctgccctcggaggaaacggcgcggctctgcttctgctgccctaggagaccaccatcgacgtagcttgctcgtccagcatccaagcctgacatccacccccacctctcttttgactgctgctaccaggaaagacttgcttgtgtgtgttgtcagttgtcacaaggtgttcgacaaacttgatgttggatatgaatatcggttggatttggctatatctgtgcttttgattcattgtatgtaaatatatgtgcttttgcttcatgttcatgttcttcctctcgctagctggtaccagcggcgccccaacctcctccgccaccctggctggccgccatggcacccggaacagcttgactctccgtgcgccggcgtggtcggccatgtgcttcacatccaccatcgtctcttctcctctcttgctctttgcttggcgatgagaatgtaagatgtgtttaagcccgtgattagtgaagactaactaatttgagccaagggcaacctggtctttaatgattgtttctctctcatattcctctaaaaataataaaataatcctgccgggatatcccctagctaattacatgtttttctgacgtcctgtagcaaattttgccaaaacaagaatatgtgatttaaaagatataagttattgaagaggttaaaaaaagacacacactattgtattttttatgttgaatggggatttatactggatggagtgatcacttgacaaaccggtagctctctagtcacgtccataaatttaaatgattgatcagaatccaaacagtcattttaatactcttgggttatatgcatgcatatactcagtggtattcattatgtgcagaatgaattaatttctctttggttttggtgccacaagtaataagtcaaacattttgaatagagggagttacaagtaccagacgaattgaattgaataatcttcatctttgaccaaaaaaaaaaagaaacaaaatgtcttactataactttattaggcaagccgattaattccgtagaaataaattattcctcgttttaattcagattagtatcacttgtacagttctactcgcttgaagtcgacacttctgtttctcttttgtcacacgcacacccacattagagcgtcgcctcgccggctcgcggtgtcatgttcgttcgaattttgcatcgtttttcagctggttggatgcagaggctggagaagctcggggaagggctggtcgcctggccggacgacgtgcacatggccgtggcggcgacaagggacaaagggatgcaccccaaagggtcgtgggaacggtggcgcttcatcggcggcaacggcctgccgaggatcaggagcggagctagaatgatatggagagggtgtcacctgtttaatttactctgttttatatgtgggtatctaaatttatattgaaagggtatatatattatgaaaatagatcaaatatagctataaattttcttgaccgggtttttgaccaccgtcctcaatacttagctccacccctgccggggatcttcccatccactgacggcggcatccatgctcctctgcgactgagacacgctatggcatcatggcacggcatgagaacaacaaaaagtctcgtgctctcgctcccagggtcacaagaccacaggttgattatctaattctaactaattttaatttatgttgtattaattagcatatcggtccataaatagataatcagtaggatgtctattttttaagaaaaatatttttagctaataatcatattaactatatctatgttaaatattatacatgttatatcactatattcatattttaaagtattttcacgtgatgctaattttatattcgttgggaacataacatgaattacattaatgatcaaagtatgtcagatcgtgtaaaaaaaggagtaaattgcatcgccggtacacaaacttatcaggtgagtgcaatctaatgcacgaacttgtaaaatgctcgttttgatgcataaacttatctggtgtgtgcggaggaaggcaaaaaggacactacattgctaatcttattgatttagggcatatatctgagaaggttgctattagacatacatctcttcaataaaaaatagaataggatacagtgatagtagaaaaagattagaaaacgagcaatggtatgaaggttagaaatatatgaaattcatcatttccatggtgaaaaataaagtagagagcaaatttataaatattgaatgtcctatgcatactcatcacacatatgcacgtcacatcctaatcaacataattaacattgtcaagttattttggtcctcattcgcatgaaccagacaaattcgtgtactgaaacgagcatatttcaagtttatgtactaaattgcacccacctaacaagtttgtgtaccaccaatgcaatttgctctaaaaaaaatataagctatacaatttgggaattgtaacggaggaagtatataataggatccctagcaagttttgttctaggttcgcccatatcgctcttgtgagatttgtcgtgtggcagatctgtgattacttctgcggaatcaatggttttcgatgcatgaagctgcggctgaaggcagacgaggacgagaagtcggagattttggttgacaacctccccggctgtcctgactcctgacgacattggccttgcaccagatggacattttggattgccagcaggttactcttctatgctagcacaaaatgaaactaagatgacttgttacttgcctttctaataggccaaaatgggactggatgaagaagagctcgctgttgccgccttgccggacctgaccgccggctataccactgggaagaggatcctcgcctcatttccctcgctcgtcgacaggagcaaggcagggccgacggcacaggcgatggtagctgtccggcgatatcatcaaggtgctcgacaactacgaaaggaaggcgtcggcttggtcgcttcagtgtccaagttcaatggagatctctacaggctgatgagtgaatgaaggcaaggcaatggatgcagaagggaccataggtaataatggggcaaaatagtacaagtgtagaacagaatgaatcatcaaaactacacaaagcatacggtagctttttcaacaccctcaacaatacttacgaacagaaatgaaactagtgggcagtggcattagaagatcggtagcagctctcacaaaaatgagcatattggcctctgaagagtaaattcagatcaaaagataattagactgcatttccattatctgtgttacctaccctgcctgtccaagtaattcaggaatctcgacatacaaatccagcttgtttctggaatcttgtaacaggaatgcattgccaaggctagaaagacatcaagaataaatttctgggattcaggtttcaacaaggtacggaatagcatagcagtccaggcatctggggccaaactgatagcttgacggaatgattgaacaccatgtaccacccttcttatcattttacttctctgcattccaaaagaaacatttagtatatatactcgcttaggcactacgaagtattagcatgtgcgatgatccacacgtttacagtacagatgtagcttagagaatcatatcttttctcataaaaatgaatgaacattcttaggggtgaaaataataaatcgatccaaaaatcgaaagctataatgcttatgcagcagtgaacaagtatgtgatgagggcaactttctgatacaagcaaatgaggttaagcacaacacggtgaaacaacacatcccaaggcaattgacaaatacatgcagtagttcaccacaaatagtgcaaggttacaaacagcagtcaaccaaaaaaagattgtgaaatagagcaatgagggttgtttatgactctaaacatgtagcagaaaagaaatataagctgcgtatgtccaaaaatatgtgaagtggttaagcaccagtggtaaattggttaaattagtctatctacatgcaaaactgaaatgaatacattttcaatctaagaaataagatgtcctaacctctggatgtagctcccctgtagtcccctcttcatcgaatatacctggaaatgttgcttcttgtaggaatgcatctgaagcttttacaatgtcctgaacaagaaaaacacgaaccctccagcctttccttgataaaatgaaatgaaaaaggtcttctgtagctgcaaccacagaatgcatgtcgaatgatctccacccaggtttgttggcagcattttcaccagatctatcttcagacttatttgaagattctgactgttcggatatagctgcaatctgaacatttcaaggatttttagtgaccattacagcaagacatgacggatatttgccaaataattgcatgatattgatgcaaaaacaaaattatcatgataagttctatctcttagtgccatgttcgcagttacaatactggtcccacatgaatgatggtcagcactagaaaattatgcttatgtaatacgttcatgcatatataagtgtttgatagttattccaagtgcacaagtaacaagaggggtatgacagattcttaatcactccaatgaaatcaaggaaataaattaattgttgtaaatcataagcatttcagtgtgtccataactttggaccttgcatgttatcgttaggcctactaatgggttgggtgggaatcggtataatggtttggttttcattttggattgtatttggttgggtagaaatgatctgacgaagctgtagggctggggcggtttggacttcgctgaaagtggattggatcgatctggattttggctgtatacttttgggtccaaaatgggttcaacccatggattttcactggatcgtccccaaatcctctatgctggccagatggacacactgatcttcctcatgagcacattgatgcccgagacatgcccgccgctgccgatctgggcttggacaccatgtgcatcaactttgagcaccttgcgaccatgaggtagttcgaggaccttgaggctacgagcttagggagcaaggcggtggtgcatccgtcagagatcttcgtcagcaacaagtacaagcagcagcagtccgccgccgcactcacttcctccatggttgcagccaggtgatcatctcctgggcacacatgcatacatctcactcctgcattggttttcatttcactaatcgatctgcaaagactaaattttaatctgtccatcaccattgactcaagactccacaagttaaagttgctgccagcatagatgataccgaatttccgtccgccagtggtgtgttctagaagccggccgcgccggagcatggagggggacaacgatcttctcgttgcctcatcagcgtccgcagcgatgccccccttttggatttcttttggtttgggaatggtctccgaatgggttccacccatttttttacctttggattggatcggtttggattgcttttatactttggggagggttggtttggaactttggattctgtgaatgaggaatcgatttggagtggatcgggaagtatgcatacagatgaatggagcagggtggatttgatctggatttcggacctttagcacccctagtgatagtattccaagtgtacaggactataggggtgacacaagttcttaatcatcctaatggaactaactaaaggaaagaaaattaattgttgttcatcataaacatgacagatatgtaatctttatatatttttatgaagaatgtattgcaaaattctttctacaagacaaaatgaaacagcaagcaaaacagaaataattaaggatcgccttaccagccgctccagtcgattccatctgatggatccatcatcgcatatcaagagctgcctcaatattttcctcatatcagggctggggtcttcaagtagcctcccaatgacaaatgggtatgcactttcaataactttgaagtcaggatccaatgcttttgcagtcccttctaaagaacccagtgctcttatcaccagtgcgtaatccggaggaagagagaaattaaactcatacatgacatcatacagatggctcatcaccccctatataaggcaaaaaaaaattgattaacaaggacaccaactcacccacattaaactaaagtaaaggtggcagatgaagctgcaagcatatacaattgaaaaaagaaatgacccataatgagaatttagtacgagacaagtgataaagacccaagtagtagtatgatttaagaaaaaatgcattgcattttcagaggtgaatcagatggaaatccagtaaaggctagtccactacatatacccaaaaaaaatattaacaaacctgaaaatcatttgattgcctccttccatcaccaaaggaaacacgtaatgcatcagcaaccccatgtaggtctgttccctcagggacaaacccaagtgaatggaagtcatttgccaagcccaaggagtcacggttaacatagtgcacaagctggaacaagtgaattcaagaaatcaacacaaatgaagtcaacataaaatgtaaaatattcacagatcaagtgcgctattttttaaaaggcagaagcccctttctgcttgtatagtaatgcgcatgactactcgaacacatgttcagactagtattcatacatccaaaaaaaatgttttgaatgcagaagtacaattatattgtttcttaagagtattaccgccatttttaacttatactgacatcgatagatacagtatatatcttgctagtccatatttcgcagaagttaaaatccatataaagtaaactgggagaagtacaaaatctaatatcttcagcaaactatatattggtgaagcttcaaataagtgttagaccaatttctgaattactaatagttcaactctactctgaaattgctatgataaatttgatgcacttagtggatcttataacttacaaataaagcctaaagctctgcaaaactcaaattaccttgtaggtttgaatgttttgaattttactaaccatagactgaaaagtcgataatctatgcaaaatgcttcaatctaacgatgtgcatacacaggatttggtttactctgaggaacaggccggtaaactttgactataaggagttctgaccaggagataaattagaagagtagttttaaacataatttaaatttcaaatttggtacatgtaggaagcaattatgtatatatatacttgtttctgtacatgctattcaatttatttgtgatttaaccgtgacccaaggtagcctgaggtggtgtttgaatctcctgaagatgaagatgaagataaagattaagtgtttcacacaaaacgaggtggtaataacgtgcgattaattgagttttaattattacaaacatgaaaaattgattaatctgatattttagagcaattttcatatagaaagttttcgcacgaaacgcaccatttagcagtttgaaaagcgtgccacgagtatccaaaactttatcctctacctttagaagatacgaacagggccaggttcagaagatgggccaggttgtatatggtttgcattatgaaaatcatttcttaatatttattttgtaccatgatataacctatttccactctacaatatgatggtaaccaaatcgttcgaagtttgttaccagtcatttcgaattttcaattcaaaatttgaagatgcaaaactgtgcagaaatgcaccagactgcactgcaaccggtcaaaaacagttcttagcacccgacaaaaaccaaatcaggaagaaaacccaacagaaccatatggttacacatgagaaaagggagcaatgattaccatttgtataagccctacacgatagtgccttggaatatcccccatcataccaaaatcaaaatacgcgagtgatccaccttcagttgcaaccagattacctggatgggggtctgcatggaaaaagccttcttcaagaagctgcctcaatgaacaatagagaccctgtaaaatttgttttgaaatattagcatgcctaaataagaacacgactatacatgcaagactaccaaacaccttccatgaaaaacagaagaggtacgaaaatgtgctaaaatggtgaaaaacacctggacaatacactgaaaaacacgcagaaacaagcccaacaaaacagttgcacggtacaaacaaatgcaagcacaatttgcaagtctatgtacaatgtatatggtcagacaagctcatgttatgaaaatatgtggagagaggaaagtagtgatttaatataaatctgaattcttcatagtattgtgttagtcacaatatacagtaagtataacatttctgcgatacctcatcgatcatccttttcctgttcagattggctttgccaatgcgctcagcatcagtgagcttgatcccatcaatccattctagagttaatatagatttacgtgtaaaattccagtagacctttgggactttgatacttgtcccatctccggagctattcccacctaaatctgccaggaaaaaaaacacaatgatggccctacagtgtgctttgtataataaatagcagagagccagagatcaatctgagctgaaagagcactaggaaatgtgaatgtaaaaggtttggatatgatggtcgagataaatgggaaacaggagagcaagcttgtcagatagatttagaggaacccacactagcaggtagcaaaaatcaaaaattgaataaaaattaagaactcaccatgagaataaagtctcgcaaatctttcagcattccttccctctaaaacataataatctcatcaaacatgtgcctgacctgttgaacagaagggtcaaaagctataagcaaactatattgcaatatatattaacggccaaaatatgggaaacgtggtctagaatggaaaaacatagtatatggcagttgcaactaaattgtctgaaacaaattatattacagttgtcttaatgagaccatctattattagtcctacaatacaaaacttaaattttggattgagatattgacatggtttctatgacattattttgaccacaaaaatacattttcatgcatcaacaaaacctagaaaaatacagtattaggaaagtatttcactttcattagaacacacattagaacaacacatattaaattaacatggaaccatagaaaatgtaagcaggacataaggttataatctaatagtatcggattagcatgaatagatcattatatccaattgaaacagaagttaaatgctcacaatctcattgactgctaccagtaaatctttgcgagcctttgcaaaccgtttcaactgtcctccgatcatatggaacaaaagtgcatctagagtcagcaagggagtcattccaggcctctgaactttgactgcgacaagctctccagagtgtagatgagctgcatgacttgaaatatcaaagaatgcatttcaacttggagaactcaggtctgaaatagatgcttaaggtcttaaggaagatagccaccaactcattagataaaatgtcttgtcaggcatggctaacctttatatacttgccccagcgatgctgcagcaactggctctgggctgatatcagcaaatagatcagaaattcgagaacccagttgagactcaatagtcctgattgcgatacgagtaggaaatggtggtatctggtcctgatgagatagttgtgatttgtcaacatacacctctaaaaagaaataaataaagcaaaaggaatgtacggcttaagggtgcttataagccatacggctgccattgattgacctagcctaatgctgattataagccgcaaaaaaaatatttgtgggtaaaacttttatgtgtgtccttagtgatttaaaagccagtgctggaaaataaacttcaaagaaaaacatcaaaatcaagttttaaaattcaaattttgacagcggcttaaagcttcaacatgattgccttcaattccattgagtagagcattactaactgcggaaatcccatataaacagactttgagtactgtctattttggaacctagacttagtttagcactttttatgcctcaattttgggacctagctctgccctgatccctcaatacttacagaaagttggtgcaaacaattagatgaagtatgttgaaggtaaatgctacttgtttcccatcagttaagcaaaattataaaatgcacaacaaagcactacctgtagcttagagagctcttacaatatgcattcggcaatatatcagggcgtgtgctcaatgcttgtccaagctgcatcatgcaaagagacaaggaa

SEQ ID NO: 5360 - DNA, 17823 bp, Oryza sativa
  unsure (1)..(17823): unsure at all n locations
aaataagcataagaatatctgttacagtaaagatacattgtaatgttggtcatttattaaaatgcattgctctgacctaccttgatgtaaaaaggccccaaccggatcaaggtctcctggaactgaaatgagtaaaatgaaaaccagatacatgaaactcaaagtataacaagtactcgtagagagttagggtgtgttcggctgcacgttgcagccggccagccgctgcaacacagtcacacagctgtttgtagtgacacaaattactgtgcaaaatggctgtatcacagctgaaatagggcagccgaacacacccttagagtaggaagaaaggcagaaaagaaataccttctcagcccgtttgtgcacatcactgagcaataaatgccaaatagtgagcttcataacatgaaaagagataattgctgccctgtacattgcaaggaatggaccaaagccacgatctgcaaatagtgtacgtgagcttgaacccaagatccttccaaactggctttctaacgactcctttctgatctttgcatattctgaggacggtctctccccatgaacacttgagaatgcactagaaaagctacaaaacagaaaataaacctcctaagaacaatatatctactcacttattcaacttgatgttcctgaaaaaaaaagaactttgaaatggcatgagcatttggattatcaaatggagaacattcagctgagcttagacaagctgagggagtaaaactttgcttcagagtgatgattgagcgtggcagtgtatagtcattattggatatattggtatgaaaagaattattggagatctgagcaataccttatatgttgatgcacttataagtgaccagatgattaaataacttacaatggtccaacatgcgaatagaactgtatcaaggtatgtcaatggaggcaaaacaaaagtatgctagataagttaaaagttggaaggaataagccacaaatcgttctagcataaggataattaaaatagacaaatccagcaccactaaggtacaaaacgtttgcctcacagctacctcatacaatgggtggtaattaaggttgagatgagtaggcaaacatactttacccaaatgaagaaatttcagttcagacttaagatagagccagggagaacacatattgattcatagtgatattgagcacaacggtgtagccatttgttgaagatctttgtaaaacagtgcatattgcacttatacgtgattggatggttacataacttacgactggttgaattagcgagttgaactgtatcaagttgtactcatggaggcaaaacacaagtatgacaatgcaaacataagagagcttagaaagtagaaggaatcagccagaaagctgatatggttaaaagtttgctacatttaaaatagctaaattcagcaccattacggtgcaaaatgtttgcttcgcctattatgatttatgcagtgttatctaatacagtacatggtatgtaagattaaaatggattgacaacgatgactccaaactatcacacaaccaagaaacagatgcgtgcatggctagtacatgattgcacaggcagagaaaacttgatagttgtaacttgtgagaagcaaaaatagttctctgctattatcccaataatcgttacaaaatggctccgcaaatcagtgctgtcattgtgcatttttgctagtgtatctcccacttctctcctccccgttagtgcaaattgttaagaatacaattacttcgatgtagtataagaacctaaaatggacctgctctcggtagataacgggtttgcgacctagggagaacgacgcgatggtggcggctcagagatcaagcgcctgtgggattcgattacctcctggccgggggcgaggcgggaagcggtggtggcgactaggcggcggcagcggcagcggcctggagcgagcgggccaggacgagtccgtcgcggtggtggtggtggtggtggtggcggcaaaggtgaccagcgcggcgggcgacgaggaggaggaggcggcgcgaggtggggcccgccatggccgggatctcatcggctccgccgccccggggagacgggaggtggggttttagggaggagagatgccgatgctttgcttggggagggagaagagagagagagagagagagagaaaaaaaatggaaaaggtgggaggaagcggtgacacgtgggggagcgaggcgaggtggcgagcatgccgctcgcgccgcggcccgccatggccggcccatgggccatggctagctgctcagttgctcggctcggttggcccaagcccagcacaaaaactgctgtggtagaaattcctttttatttttttatttttttttggttagcaataggcgatgagcgatcggttgccaattgccatgcgatcgaccaaatcagactcctgtaaaacgctactaccttcgtcccaaaataaatacagttttgtattatttatccccaacgtttgatcgttcgtcttatttaaaaaaaaattatgattactatttttattgttattagatgataaaacataaaaagtactttatgtatgactattttttttaaattttttcataaattttttaaataagacggacagtaaaatattggacacggatttttacggctgcacttattttgagacaaatgtagtattgaacagcgcgcatttatcctgcttttgccatcgcggttaggtttccaacctcgtcatctgttagactccaaaaagaaacacattaaatggggtggtgttgtcgctgtaattaagtaacttccttatcgctatcgtcgtgggagggatccatatttaaggtggttacaggagaagaaaaggaaagctttgctaggggtttttttataaaagtattgggcggaagcagattgtttcttgtaaaattgctccgttggatgttagcctttgtatgtgagatcaaaaacatgtgttgaatgtacctggtacgttgaaaaaataataattttctagtgaaactaatgtgaatacatcagcattactatccattgaattaaaaatggttaaaaggtactccatccgttccatttaagtgcagccatgatttttttacacaactttgaccatctatcttatttgaaaaaaatttaaaaaaaaattaaaagcataagttatgtataaagtactattcatactttatcatctcataataataaaaatactaattataaaaaattttaaataagacgaattatcaaagttgggcgcggaaacttgtcgcacttaaaatgggatggagggagtattggttatttggattttaaggtgttgagatatttgatgaagttacaacctaatactataaaccttagggccattttacccaaatataatatagtttgttacttataatatttattagtttaattattttggatgcctgtgaagttgaacaaagtgtgttaaatatttgtttggagatatgggcatatcttaatctatatcctatgttacatatttttctttgtactgggcattagtagatctatttgaaccaacactataatagactattaaaacgaaaaatagtttcccgtcagcattgcaggccaacatcaccttaattggttgttgcatcttctccttttgtgtgtgccacgcatcctcaatcacgggtgaggatgcaacaagtatgtgagctagctttaatttgcgactaactgattcgtgagcacataatcatgggcatactagcggatgaggtagtcgtgagaggagacgactaatgatggtgcatttggtgtgtagaggcagagcaactgctaaccattggtgcggccactggcaatgggacttcgtgacatgctgacatgatggtggtacttgagagccatatgtgaagcatagagcattggcgaaatgaaatgccatgtcactgggatctggagaatagcacagttgctgcttgttgcaatcaagcaatccggcaaacctaggacaaccacttattttaacaacaaaactagtatttatttttctaaactgaacttttcaactaattactacctccttttacgaaacttgtcatctgacgccaccatttatatttaaactttaaccacacttcaataataaacttattgattatgctatatgggtataatcatgcaatattcattcatcataatatggttggatatatataaattatgagaaatttcattgtacaatcaaatttgataaattttcataggggaattagacaaaacacctttatctccctttttcctctactagaaacaaaaatatgtaatttttatcaacttcaaccaaatttcaagaaaattccactaaggggtcaagtgtcttctaaattttcgtaaaatttgatcatagttcatttgaatagttaaatttcagtttttaacttggggataattggttctacaacgccaaacattcccactttagttttatagggaaaaaaagtccattttagctttagtagtatcgaaagttccctctaatactcattttagcattctattcaaactaccattacttcccacagcgtgaccatgtcttcctccttaacgtaccacagcaaatgagctccattgaagagttgtagaaagggcaggagggtgagctcatgggcagcacaaatagatgagattgagggtgctagtagatgagctacaggacgacgtgtccaagtgagttcgatcaggtgcaatcgatgagctcgtgtatgatggtgcgcctgtgtaagcttaggggtgccaacaggtattgaagcagatgagctttcggtcccgttcgtttccactaaaaaatgggatgaaaatttggatactcgtggcacgctttttaaactgctaaacggtgtgtttcgtgcgaaaacttttaatataaaagttactctaaaatatcatattaatctatttttcaagtttgtaataattaaaattcaattaatcatacgttaaaatcacctcgtttttcttaaaacacttaattgtcattttgaatttgcatgtgcacatttttatacataaaatcaagattggttagctagccagcaagatatgtattggaacaacatttttcgtcaagtttcataggcgaagttatggtattgtgacggtgcataggcaaccgccagataggctcaagggcggcgcttgatgaacttgatgacaggagcatcctattgttgtaagtcattcactttcatcatatacaacgatctttattagcgggctctctttgttgccatctaagtaaatttggtaacatgaaagagagagataggagaaagagaaacattgttgctacgctgaaagtgcatctaggcccctaatgattttgatgattgattacaatacaattagagaggactaacatttttattcaagcaaatgtgaagtttgttaagtcctcaacgtgttgtaatacaatgcatatcccgtgaatgcgacatcgcgatgcaatgcggcaatgatcaaatagtatattgtatctttttcctcgcattgtgtcgtaggaaagctgtactattaaggaggatgatgcatagacatataaggagtgacgcgtgtgctcaaaatcaatttttcttcgaagcatttctcttttggagcgttctgaaaatttttggaagttccgaaaagaattttcggaagttccgaaaatacacataaccgtttttgagcgttctggaaattttcggaagttccgaaaatacacagaaccgtttgagagctctctggaaatttttggaagttccgaaaatacacagaagcgttctggaaattttcggaagttccgaaaatgtttttcggaagttccaaaaattgcgttgacttcgatttttttctcagatctggaattttcggaagttccgaaaattgtttcggaagttccgaaaattacttttattgcactccaatgggcagatttgtgctgtgggtataaatacccacctcccctcacttgtgagggctgctggttctattccaattatttgtgccctttgcttgctctctttctctagttcatttgagccttgcttcctcgattcatctctccactcgtgtttgattcagatttggtgtgtgtgtgtgagagtgtggattcgagtttgtgtggatgctacttgtggtctttgtgaagatttgtgagcacttgcatcatctccgggagttctttacatcatcttttactcttggaggttgaggactcctagacggctaggtgtcactcccgagccaccgatctacctgtggttggccgggagaagtttgtgaaggccggatctcgcctccgcaagggaagatatacctcttagtggaaggaggagtacttagtacaacctcttgaggaaagggttagcaaagacccggctcttagtgagctcctcaacggagagtagaatcccctcaaggatttgaactccgggaacaactttgggagctacatcttggtgatatttctttatccctctcctctagctttgcttgcttgtgccactattggtctagttgctgattgtgccttgtattccctgtaatagacttctagatctagatttttcttttgtgtgcattgctctgtgcattttcggaagttccgaaaatcctttcggaagttccgaaaattcccagcctagttctgaaaattactgcttccgcatttcttaagttgtaaattagcctatttacccccctctaggcctaattgaccctttcatacgcatgacaccaactcaactcaagatcgactcttaacattgaatgaaggaaattttgttccatggaggtagagaagaggaaagaaaagtaatttttttttgtgcaggctatgttgtctcaaaagccaatctataactaatgtgttttaattaggagcctatactaggttgtaccattgtatataccttcaatgtgggttgcccctgagttgagaacttctggtactataaaatcaaaaagggaacttttaatgcttttcgaactggtttttccttaaattaagggtcaaataattttaagttgaactcgttttcactttgaggatcatgatttttatggcaacacttattcacaagcgagagggcattttgagactcgtgggtaaaaaaaaatatatgaaaatttactcttcaaggctgtccggttaggcgcgcagacgcgctatccagtatccacgtaggataggaacagtacgcgcttgaagttttacgaaaaaaccctttagtttgagtttaattcgatctaagtccctcccaaacagtctttgaactgatattttacgtttaagcccttacataaaccagatattcgtcacgaagaagagaaaaaagtgaataagggctgtgcttaaaattgtcaaaactgaaggtttttttttcgcaaagtggctctcacagatccaaaaccctagccgttgtctcttgctctctccctctcttgccgccgccgcctttgctttcctctcgtgccgccacctctgtctggtgccgtcagtatcgtttcgcgccgccgtctccgcctccgcgtccgccttcgtcttcccctcgcgccaccgccgcccgcatcccctcttccatgtcatctcgccctttacctctctcgccgccgctgtcgtatccgctttcttctcacgccgtcacctctgcctcgcatcgccgccttcgcctccgcctttgtcttcctctcgtgccgccgtcgcccgcatctcttcctcactcttgtaagtataatggtgatagaaatattatgagcagcgaagacttggacataaaagaaattctctcataatttattggtggtagcatcaagaatggaccatggtatgattctcgaggggtatcacctatcacgaaagaattgtcacttcgctagtgtttgaaaagaatgaacatgtgatagttggttttcggtggagtgtgcaataaaaggttatgtcactaaaggatgtgctccaagtataaacataaaaacatcgagacatgatgccacgagaatcactacacagtaaggaaagcacggggtggtgatagagtcattagtgagtgcatgactttacccattagggttcaaatcttgctacccataaatattacgcgtacgtaagtaaatatcaataggatttagtgtgatcataaatatacagccagtttttatctctctgagcgtgtgtgaagagacgcactcgtggaagtgtgagcgtggtgttgcatgcgcagtggtgtgtatcatgtttcacgtataatggtgtgtccgccgtgtaacggaaataatgtaataagaaaagaaagaatcacagcacaataaaagtctcgagctgtaaccacactatgttgacaagggattggacaaaaactcctgtgaccgaacaccacccgggctggggacgaaaaaataatgtgattagatgggagcgaacaaaatcaacgagccgttggtgcttttgctccgctaataatgcaaaattgcaatttgcaaccccaccatgccatttgcattgcccctcgcctgtcgctgcctgcgccttgtccagccgtggcgccgagttgccgaggaaaccgatcgcctggccgtgccaccgtgccgggtccccatcgccaactcgcgcccaatcccggcttgacacgtcacccctgtaggcgatagtgcccgccacgtcctcttcctctcctcctccccccgggatctcgaaccttctttcccccgcgcgcaccctccaaccccactgaccccccggccccaccctccactgtccccacctcgtcagtcaccgcgaggccacgtgccaccaccgggtgagtgtgacttctgacaggtgaggccacctgccgctgggcccactggtcagtgggtgacggcgccagctactagtggaggagcctctggatccaagcatttttttttatttccggagcccctctttagtctttacttgcgtgaagaaaatttctcctgctcctcctcttcttttttattttttatttttatttttcgtcctcctttcggttcgtgctcgtgttcgtgcgttgatgcgcttgcgcgagagcgtataaatcctcgcggattttcggatttggagggattcttctccgcttcccccgccctcaaatcgcaccccggatttactcccccaattcctcgctctgctctgctgctggattagtgtttcttggcgggatttggtgagcgattgattcgattcgattggattcgattcgatttgatccgccggaggggagggggggagctcgccgcggagttcgtcgccatttcgatccgtacggcggcgtcggggtcggcgtcgtccttggatgattccgatcgatccaggggcaaggccgccaagatttcgtcgggcggaggcggggatcgcggcgggaggggtggatccatggcgacgggggagaaggcgccgcgggctttctcgatggaggagctccccggccacctcatcggggaggtcctgacctccggccgcctcgccgccggggacctcgcgcggctcgaggccacgtgccgcgcgctccgcccgctcgccgagcacgccgcctccaggctttgcgccgcgcgggcggcgttcgcggccatgggccccgccgcgcgcggggagctcctggagcggtgcggcggcagctggaagaaggtgctcaggttcctgcagtccgtcgagcagtcctccggcaccgtccacacctcctccggcaacgtgaggatttctttgcttcgcatctgaattctgagatactagtaaatgcaaccttagtttgactttgtgtggtgtaggatagcctggtagagatgattgtgcttgcctcacacctttgcccgttttagggatccatgtttgatcatgcatgcatgactttgtgaattcggaaacttcgtgataggaatcggatatccacatttggattacactagggacaatgaaacatcttaacaccaagttaaggcatgcgtttgtagtctattgtgagctttttctttttttttttgcttgttatagaattaagagaggttgaccagctcattcctgatgaacaaaattactaacaattctatgatttattgatttgtaagttggcatgcttctgaatgaggaggatatgtggacattggaaatgatttataataaacatatggtaccttgtgttttttcattttcttttagatacgacacacttggctgaatgggaatatgttgctgatgcctcagttgctttgaatccatcatatcttagttgtttttcttacactgattgaatttcaagtcagacattttaaaaatatatggcgcataattatttggcgtgcctactgcatcagattgttctggagggtgcctaatttacttttattctagattttttttcttttattaacatcctagctcatctgctctaccagtttgagagtatgctctatgttggacatgttacttattgccattctgctatgcttgccaatatgaagaccaaatgatcaacaaaagttgcattgttgcacttgggaatagtttccctcatgaacaattctatctttagtatgaaactggaaagttagattttctttttaatgttagaagacatttccaacctggtttcttatatatgtgaacatgctgtatgtttccagatgcaagtagcgacaggaagatatcacacacttttggtccatgactcttctgtctattcttgtggatccagtttgtgtggggtgctaggtcatggcccagatacaacccagtgtgcggcattcagcagggttcccttcccatcactttctcgtgttgtcaacatctctgcctctcacaaccatgcagcttttgtcacagagttaggggaggtaattgatgctcatcttaaacactgtatattgtcaattgtaatatttctaatactttgaacgctgtgaattttgttcaaataggtcttcacttgtggagataattcatcattatgctgtggtcacggtgaggtggggcgaactatatttcgaccaaccgaaataaaggccctaaaaggaatttcttgcaaacaggtggacccaatcatctttattatccttttatgttccatatctcctacaatggaataaatgcctctttcaattattatatttcattttgtaaaaacagaacaatgctctagttatttgatgcaacaggaacgatgttttagttttgtggtcaaatttatttatttgttgatataaaatggagggaagaccctactttttgtaactaaatttgttaatagacaataaggctgttatagccttataggtagttgtttcatatgtctggtctagtcaagtctgcaaaactcttcctctttttcttaattctatctattcccctttttgcaggttgccactggtttaagttttactgtcattcttacaacggatgggcaagtatatacatgtggaagtaacacacatggccagcttggtcatggtgacacaatagacagggctactccaaagatcgttgaattatttgaaggccttgctccggtagtgcaggttgctgctggtgccagctatacatttgctgtaacggatgatggaacagtttattcctttggctcttgtaccaacttctgccttggacatggagatcagcatgatgaacttcgtccacgtgcaatccagtcattcaagaggaggaatattcatgtggttcgcgtgtctgctggtgatgagcatgctgtagctcttgatgcactgggttatgtaagtatacactgttcaaggaactatctgttgtatgttttgattgttatgtatcttcagacagaagttaaggtttgaaaattttaggtttatacatggggcagaggttactgtggagcattaggccatggtgatgagaatgacaaaactagcccagaattgatcagcagtttgaagagtcaagttgctgtgcaggtgtgttccatatgtttgcaccattttccttcttacttcattaagcatcgaagaataaacctggtttaaactatcatcaatcatgtagattaggctgaggtaatatactttatgtagcaagaaatagggcattgctatggttttcgtatttaaaacaaaagttatgcattgctacatgctaatatgatataggagtttcttgttctaataacaatcatatcttgaaacagaactagtagtagtttcatgtataaaggcttaagtatgttcctttaattttgacaggtctgtgcaaggaaaagaaagacatttgttcttactgatgagggctcagtttttgcattcggatggatgggctttgggagtttagggtttcctgaccgaggatcatccgacaaagtaatgaggcctcgagtcctcgatagtctgcgtgatcactatgtttcacaaattagcactggcctgtaccacactgttgcagtgacaaacagaggcattgtatttgggtttggggacaacgagcgcgcacaacttgggcaggagtacattcgtgggtgcttaaaacctacagaaataatgttccagaagagtatggaagaaatagtaattgcggcacccagcgggtaaattcaactccaagatgcaattttagtcccaataatatgcatattgtttccatcccaggtttcttctctgcaagtgtatttttatactagctttcagtgatttgtgagtatatggtaaacgggagaagatcaaaggtggaggacagtgttgtagctaaaggagcatatagtgaggtaatttggtggtgtattaaataatttaactcggccattttctcatgtataaaaattattggtgtgattagagtgacaaactatttctttcccttggctcaggtagttcaatcaagtgttgaactgttggctctagcacattatccttcctagttcatgatggcttaactttccaagtttctcttcttcttgaatgctagcgaaatacccatgctttgctatcggtaaaatgcctatgtttatttaaatatatgttatttacttgattcaaacaaacacatgactatcgcatgatataaaaaatatcagggattaatctgtagaacgtgcaaaagtgattggtggtgggctattatgttgcatagattctcaagcactattttctttgataacagtgagtttacccttctatatccttaagaagagaatttacttatgtgtcaagatggaacaaaattttcccggtcaaccaggatatgcacataaaaaaaacagcagtgtgattattgtctgtggtctttgatgcgttggtgtcattgattggtggtatgcacgtgacatatgtacaagaggcgattgcggataatgaaccaccacatgacatgacatgggtgacatgctttctgtgtttgtttcttttagacggcaacgctttccaggtacagttattaaaaaacgatgttgtggttggcaccagccacttggtaaccacaagcaataccaccctcagtttcttcatcacctgtacagcgaacgaacggtaggtaagcccaacgtttgtagaatgaaatgcttcgaaggtttttctttctttaatttgatgatgaagctttgcatttgagatgtgggtgtatctgaagcagctgtgatcccaagcaaaaatgacagcggcagccggcagcgattgtgaactttttttaattataatttccacaaaattacatatgctttggtcaaattattacaaaattatagatttaatgtgatatatcacaaaactacagattgaacactaaatttatcacaaaactacatgtttaataataaaattatcacaaaactatatatttttgagttcaaatcattaacaataatcaataatgttatgttagagttaaaggtgtccaagttttatggtaactttgtaactaaatttatagttttatgatatttaaattctataatatggtgataactgtgttactaaatgcgtagttttgtgatattccattctatagttctataataattttagtgttaaatctatagttttgtgatacatcatgttaaatatatagtttgtttgataatttattcaaaatacatgtagttttatgaaattttctctttttttttgctttttctgaaacaaaaataataaaccttgttcgtttttgcttaaaaaaaagagaaacaaattctaacacatgactgcaatacggacgtacggtcaatgtccagtcggccccttttaactgggatggaggtccatccgtgtccttcctttagatggaccgaaatctcagcccaccactttatgggcccaaatttggcctataattgtactccctccatttcatattagggactattttcactttttcctaaaagtttgaccgactttatagaaaaatataataatattttcagcacaaaacaaaaatattatgaaaaataaaagaaatatagattttgtcaaattttctataaacttaaccaaaccaaaaaaataagtttgaaaaaaaaaatcaaagccgacatatgggcccatccaattgaggcccaaaatgcgcctatccggcccagcctctcttcactctcctctcatcctctctcggcggagagggggaagcgaaaacctcgccgtcgccgccaccgatcgccgcctcgcgccgtacgaccggccgcctccctccctccctctccccgtctgcgcttggccgcgcccctcgcattgcctcttcgtcgtctctcctggtaagggcctcacccaccgatcctccattgattattccttctaggtaaccacccctttctcctcttcgtgacttcgtgtggtgatgatgaactgatgatgatgatgatggtgcaccttttctacgctagttcattctagatgtgtgattcttggctgggattggttagagaattttcgtatgcgatctgctgatgatgattcagacgccatgggggctgggctgtgaagggtttgttttagttttcttgtcgttgtggccataatcaagaacctgtccgttcttcgatggatcttgcaagaaagaaatgctaccgggtgaaatttgtgatgcagagttgttcatgtagggttagacttcccctttttgtttaactccgttcctgattctcatgcatttgccatctgcatgccattcaggttaccgtcgaaattgctcagtgatgtgacaactgatttagaaaattccttatgtacacatgagttttttgcttaatccctcacgtgcccttgaattttgcctcatcctctgtatgtccctgagtttttattttgatcccttctatacccatgttgtgagttgactgtgaattgaccgttagaattgtcccaaaatgactatattgcccttcgcttgtacttcatgctttctaatttaaaaacataagtcttgttaataaaaaaagcttaacctaaaaataaaaaaagggacatgattattaacattggatttcgaaaacaaaattaatttttcaaacatttttttaaagataatgaaatccaaaaaatgttttattcggaattcgaaaaaccaaaactgttttttatttaaatttcagcgaaaattttcaataaatttcatcaaatctgatttgaaacctatttaaaaatctatgttttagattaagtaattatggcatgtttggttttataaatgaatcaacttttaccttgagagccatgtttttttaatcaactactctgtactaagcaataagtaagacacaagggtaatgtagacatttttggaaaaatctaacagtcaattgacagtcaactcacggaatgggtatatcagggataaaaatgaaaactcaagggtgcgtaggggataagacaaaatttaggggcacagaagaaattgggcgaaaattcatgggtacataagggattttctcatatgtatttgatgtgataccccaaacatgtgctgtgccacttgatccttggtctgatgggttcatctcaacagcagaaactgtgctatgcttaccgatccagtggttccatacttgcagctgtgcacaagtttgatctctgcagctgatagttgataatgattccttaccagatggtttatacacactttaactgacaattagagttgctttcagagaaggacccacgagtcggcgtgttaagttcggttaaaaaaattttccagtcttgtttctctgaatgctggctagtcatcagtactttactctgtcctcaatcaacttcactgtactatattttgtgatttctattatttatttttcctccgaggctggcgatggaatgcatacccatctaagtttgctgctttctggtaacgacagggcattttcaaagtaatgggtagctcaaagaaggccaaggtgaagtctagacgtgccgcgaagtcagacagattgagcagtctacctctagagataaaagccgatatcctctctcgtctgaatgttcaagatgctgtcagaactaacatcctgtcaagcgtttggaggagcacatggactactattccagagatgttgctgtgtgattgcacctacacttcctgtcaaggttcagtaacaagtgcaccacccaagtttattacattggtcgatatggcgttatcactccacaggggacctctgcatgggattacaattttagggagcaaaaattaccacgacgtatttggtaggtggatgcacaagctgtcaatgaagtcaccaaattcagttacaatcaaattgacctctgcgtcaaggtataggataccatcatgcttcttctccatcagtgatttggagcatctggacataaagaactgcatcatcagtttgccccaaatgttcaaaggttttgagtggttaactactttggacctggaaaatttctcctccacagacagtgacattgataatctgatttcctgctgccctgagttgtctgtgctggttttgaaatcctttgaaggcatcagctgtctgaacattcgagctcctgaacttgaaattctagaggttgatgggaagtatgaagacttccatttggatgcccctaatctggagactgcaaatgtcactctgcacaaagctcaagaataccaatctgttccagttgtgcatggtgggaaaagttacctcaagcaggcattgggaagcctaagtgacatcgaaaaacttgtcatcaacggctatttcttgacggtgattcattgttattttcagcattatgatgatgttgtcctgattatgctgtgttggtatttctcatcattcatttttctggttgcagtatctatcaaaagggtgcataatgacgaagatccctgctgtgtttgatcacctcgagatgatgttattagagatatgcttctgggaccaaagggaaatcctgaccggccgtgtcattgtttcagaatgctcctatcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5361 - DNA, 504 bp, Oryza sativa
cacaccggtcattgtcagtgatgctggctttaaagtgccatggtataaatccgttgagaagctgggttggtactggttaagtcgagtaagaggaaaagtacaatatgcagacctaggagcgggaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgct

SEQ ID NO: 5362 - DNA, 19335 bp, Oryza sativa
caccgattccatcgctcacccgagcaccgccgccgtttcgccgccttctgcagcctcttgccgccgttcccgtccacctcaagccgcgccgccaccaccactagcttcgctgctccgccggcaagcccggccaccacgccgctcctccattccacccccgagccgcccgctccacggtgaacccgagccacagccacttttgtgcctccagtcgcacctctgccgtcgccctggccaccgccaagccgtaccgtttccttcaccggctcggccgcttcaagccacagatcggtcgccgctccaaaccaccggaaacccaccagtgctccattcctttcgatccccggtgagcccgccgccgcctaatccgtgccgccggccaccttctcgtcttcgtctcgccgccccattcgctcggtgagaaccgcctccctctccactctctcgccgcctctcgcgccgtcgccgctcgccgccggcgtcgtcgccggtggtctaggctcggcggtcgccgccgcctgtgggcgtgcctgcctggtcgtgccgctcggccgcccccggccgtccgatcggccccggccgatccggagcgtcgggtgcgcgcccacgtggccggctggcgccgtggactcggtccacggtgggctttgccgctgacgtgtggggcccacccctttgtgacgcggtctgcgcctcaccccttgctgacgtcagcatagcctttttcctttgaaaaattaaataataattgcgcaataaatcggtaataattgtaaaaatccattaaaatggctcaaaacttctaaaattcatatctaattcattcgaacttcgaattgagccattcaacttgcaaaattcatctaaaattgagctctacatgtttgtttagtttttatgtactgtttccttggtttttattagagtttttcctcgttttgcgtgccagcgtgttgtttccgtcgtttcggaagtccgcggtcgcgaggaaaagagttcggaagatcaaagtgaagaagcaaggcaagtcacacattccccttgagcattttgatcctaatttacaaatgttttactgtttgcaaataaatatgcatgttttgctaattacacgggatcagggtttacctatctgctcgcttgtgccatgtttacttgatatctatcctttgtcaaccttgagtaataaatcgactagctcatgttacttatgtgacttagctagaactatatgcttagccatgcttaattaccactagctcagttgatgggataattacaatattagacctttttagtatcagagtgagctgcgtgctcgagacatctggccatgcttcatggtcgtaattatccaactaaaatgcgactgaatggtgggttgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagcggggcgggccctgcgatggcctctgtcgcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccaaattcaccgtgattagtcccaccttaataaatcgactcaatgcactgtagttcaggtgggttggttgggcctgttcaacgtggtgtagcgttgatcagtggagatttaatgttactctaaatactcaacagttttactgttttgctcaataaaatgttttacaaccgcctttatgcaaatagccacaaaccatccttgtatccccttgcacgtctgcatcgttggagtggcttgctgagtacggtggttgtactctgtcttgctattattcccccttttcagaagtgtagtgcttctgagctgaagatggagttagaggaccaaagctcagaccccagttgagttttgcctgtggagtggagctgaagccccgctaggatcgcctttttccgctgctgctgcttttgtttcggtgtgaggattaagtgcctcttctgtaagtattttacgctttatttacgtttggaactgtatattacttgtcgttttgtgtaccctggctggtcctggacagggatttaatacgcaaaatagtctggaaatttgggttaaatttctgggcgtgacaagtatggacttcatcgaaggtttgcccaaatctgaagggtatgacacaatattggttgtggttgataaattctccaaatttgcgaagtttattcccctttcacatcccttcacagctttgcaagtggccactgcttttattaagaatgtctatgatatctttggcatgccccaagtgattatttcggatcgcgataaaattttcactagtgctctttggcaagaactgttcaagttggccgatgtgaagctcaatatgagctcttcataccatccccaaactgatggacagacagagcgcttgaatcagtgtctggaggcttatttgcgttgtgctgttcattcttgcccaaagcattggtctaagtggttgtcgcaggttcagcattggtataacacagcttatcatagtgccttggataagtctccttacgaagtgttgtttgctaggaaaccaactccatttggccttattgatgttggcgacagcatggtacctgatgtacatgtttggcttcaagagagggctcatatgaatgaagtgcttcatcagcaacttaccagggctcaacagaggatgaaataccaggctgataagcatcgttcaaaaagagttttcaatgttggggatatggtttatttgaaattacaaccatatgttcagatgtcagttgctaaacgtagttgtcagaaactgtgtttcaggtactttggtccatacaagattttggagcgcattggagaggtggcatacaaattggacctgcccccacaaagtcaagttcatccggtagtccatgtgtctcttctcaagaaggcaattcgtcctgatgtccaagttcaagccgatcttccagcaagttgcatggcagaagatgcagcaattttccctgaagaaattttgcaccgtcaactcatcaagcgaggtaatgcagctgtgccctatggattagtccgttggacaggtttgcctgccgctcttgctacatgggagaatctatgacagctgcaatttcgtttcccatcttctccggcttggggacaagcctcttcttaagcgggggaaattgttatgtgttgtgtgtgctgtagcttgtcagctgttgtgttccctgtattgagtataactgggtgtttgggcctggcttgttgtgggccgtggaccgtgtgtgtgtgtgtttacgacgtgccgtgctggactggcggtcgcgtcgagtgcgtgtgtcttgtacccgttaaaaggggaactccctgccgatgagcaggtatcgatgagaagaaatcaaatacaatcaaactacctctctctctctctctcagttcatccccttcctctctaattcaacccaaatcccctagcgaattccggattagcttggcgtgacgccggcggagtcttggagttcgtcacacgatctcttcctttttatgtatctggtcatctggatatgctgatcttctgaatggaaaaaaaattcattattgattccctcaagtcacaaatacttgcatcggacacatgaaagtggctacatttcagtgtgtcttttcaaaaaaaaaaaaaaacttgcatagtcctctcgtgatttttaatagttgaggttattaataaaaaaacacgaatattagagaaagacctaatatcaaataattggaaggggtgaagcttcgaacataggtcgtctagcccaccaccctgtggagctagccgggagacccctaggcgtttctccgaggttattaacttatggacacatatttgattatttgtcttatgcaaatacataagatataaattatatttaaaacgcacaaacaaaatcaatgataattacttatttcatccagttccataattcttgacattttttacaaggttgatatcaaacttttttaactttgactaacaataactatgtactactagagatttgtcttacaaaatactataataaaagtatgaaaaaaatatttattatacatattataataaaagatatagttaaaatttttttgaagactgttattttctaaatcataaaagttaacaaaccggagataataagtttttgaataagacaaatagtcaaatctgttgaaaattcaactgcagtgcttactgaaagacggaggcagtatggcggacttaaaagatgagtgctaggttggcccaccaatttcttgggccaagctgtgacccactctaaattaatggacgaagctaaaattgtgattatgtagcgttagtcaatttaatttagtcgtccaaatttagtgcttgttgctgatcgccaaaagaaaagattgcacgcagctacgacggtgttgagcagcgtgcttgtggaccaatatttaacatactatctttttttaaactcaatatattaaacattaatagcaaagtacatggataagttcatgatgcaaaaacagaaattgtgatatttaacatgctaaatgcaaaaaccagcatgttaaatgctatgattatgatctaaggattatcattaatctatcatgatgcaaaaatggaaatttcatgctatccaatcatactagctatgacgagtctaacgaagcaaaaaaaagtttcagatgctgctctggtgttaattgaggagttcaatcctggcaacggtttatagattcttctatatatagatctctgaatctgaatccttgaggcacgagctgttgtttggtgttgtgcagtgatagaatgaaagattttctagcattatttatatttatatagatgttaatgaatctagacacacatatatatcgagattcattaacatctatatgagtgtggacaataatagaaagatttatattataaaacggaggaagtagttcgtatcacatattgtgtttctttattattgtaggactcttgcacatttatttgcttgttttattcagtcatcacccgttttcacaaatatccaagatactgcatatattcgccatttctgtgtgaaaacatgaaggatttgactatgatgccaacaagtaaattatcactactcattttgctagttgagatatatcattttttaagataatagttgagatatatcataggttcaatcgttcaagttcctttccttttgttttcacgaaatagatccaatttctgagttttccttcaaatctaggaaatgttgtaacctactcccagttatttttttcggcgttcctagcacttgttcttacagataatggtgtgaacaccatggaaaaatgctgtgaaacaaacggattaacagagggcctgagtacgccaccaacaaatcacccaaaaacaaaattttcagaccgagagccttcggtaaactgattttgacggcaatccactcacaattgatcataattgagtgtttcaaaatccaatagaggtttggcccaagaaattgatgggccggcccaatgcacgtcaacttcaagtccaacatagtattatgcaagtgaaaaagtatgcaaagtatattttaaaatttttatgcgcattgaagtttatatgttttcatttcaatgtatccgatgcaagtatttgtggcaagagggaattaacaatcaattattttttccattcaccagatcatcactgacccagcctagattacatatttaaatttaagaagatgggtttggtttcgatggacggtgatacgaaatgggatgccatgccggcggccggcggctagccgagctcaacgctggcaccgcggcgaggcgttgtcgaaggcgaggctgatcggcgcgctggcggcgtacgtgaacaccaccggcgaccccttcacgatctgcaggccgtcgttgacgaggcagaggccgtcgctgccggcggtgtggatcttgctccggtcgacgccggcgggcacgccgtcgaggcaggacaccacgacgtcgccctccgggcacgagcactcgttgccgatcgtcacctggaactccggcaggccgcccacgacccgcccggtcttcaccgtcgcgatggtgatgtccgacgggtcgcacggctccgggtcctcgccggcgacggcgacgtggacgtggcagaggagcgccgcggcggcggcggcggcgaggaggaggagaagggtggtggccttggtcgtcatggtggtgagctagtgattggatgcgtttgcttcactctcttttgtgtgaagaattagtgtagagaatgtcactatatatagaaaattttggaggagcatatatgtatatctgggcaatatatatcagattatcccaaaattagcgatttgattgtatcttcgtgattacggcgatggatttaattcaatcccctgatgagtgaagatatattgttctacgtggctgtgtatatccattttgagagactggatttctatccactgtctttaaattctacacatttgttttctttctaaaagtacagtgcaagtggctggtatgttatatcatcattctaccggaaatcgtgttttagaaactgtgtacattgagaaaaaaaagacaaatttatgtgtcgatagtattatatgctgaatttgatgatatttacttcacgatgtgtgagttaattttacacttgaagttttgtggtacatgagtaccggagtcaatgttagtactccctcaatcacagtacaatatcgttatagaattcctacagtaaatggaagaagctaactttgatcatggtaagtgcttaggcaaaatctaaattatgcatgcatactatttagttaattttatcgggtacagataacatggtccgcttgatcagtagtcagaagtggcactaataaactactccctccatattttaatgtataacgccgttgactttttaatcaacgtttgaccactcgtcttattcaaaatttttatgcaaatataaaaatacttatatcatgcttaaagaatatttgatgataaatcaagtcacaataaaataaattataattacataattttttgaataagacgaaagatcaaatgtttgtcaaaaagtcaacggcgtcatatattaaaatacggagagagcacaagtgcagcgtgccggctggcgtcgaccggagcaagatccacgccgccggcaacgacgggctctgcctcgtcaacgacggcctgcatatcgtgaaggggtcgccggtggtgttcacgtacgccgccagcgcgcccatcagcctcatcttcgacaatgcctcgccgcgcgcggtgcatgccagcgttgagattggccggccggcatcccatttcgtatctagtactatcatcatccatcgaaacgaaaaatattgtactgtgcttatatgtatctaggctgggtcagtgtgctgatctggtgactggaaaaataattgattattaatcccatctggtcacaaattttgcatcggatacattgaaatgaaaacatatataaatttcaatgtgtctaaaatataataaaaaaatacttgcatactttttctaataagtactccacttgcataaggccgtgtttctttcagcttgggattattataatctagattattgggagtaaactgaaagaaacagacaacttattaaaatagtttattataatctagagcccagcttatataatctaataagctcatttaggtgagctttttctagattattgcgtaaaaaattacccaccatgccactccactccctctttagacctgcaaacccaataatctaggctctaataatctaggaaagaaacaactaaccgcttattttaatacagattataacaatctagcttatagtaatctgactcaataatctagattataataatcccaagctaaaagaaacagggcctaatactgtgttggacttgaagatgatgtggattgggctggcaccaatttattgggccaaacctctaagatcttgttcggtttataggaggttgaagggaattggaggggttttaggggaaataattccacaccacaacaggtgtggaataaatcctctccaatccttctctcttgggaattaaccgaacatagcctatattatgcaactctcaattgtgatcaattgtgagtggattgccgtcaaaatcagtttacccaaggcgctcggtctgtaaattttgtttttcggtgatttgttggttgcgtagtcagtccagaaatgctaatgggcgggtgatcgctcccccgcttgtccagcgatcacccgtccgccccctccctatactactagatacacttctccctccttccttactacagtacaccacacaaaaatttaaaaaaaaacaaaaagttagaaaaaattatgtatagaaatactatatataaaaaatttaaattcaaattcaaatttgaatcgggtatgtaaactttttgacttataaactatgggtctataaattttaggtgtataaactttagatgtatagaaatactatatatagaaaatatttaaattaaaattcaaatttgaatcggatataattcaaattcaaatttgaatcgggtatgtaaactttttgacttataaactttgggtctataaactttgggtctataaactttaggtgtataaactttagatgcatagaaatactatatatagaaaatatttaaattcaaattcaaatttgaatcggatataattcaaattcaaatttgaaacaggtaaatttgaatcggatataattcaaatataaatttgtaacatgtatctaaactttagatgtgtaaacttgaggtgtataaactttaggtctataaactaactttaggtgtataaactttagatgtatagaaatactatatataaaaaatatttgaattcaaattcaaatttgaatcggatatataaacttttgacttataaactttgggtctctaaactttagatgtgtgaacttgaggtgtataaactttatgtgtataaatttactaaaataggaaagtaatacggtgccaaaaaaggaaattaggtggagggagggaggggggagagggtagcgaatctgatcgctaccccccattggcgggcgatcgatcgcccattagggctgccctagtcagtccctctgtaatccttttgtttcacagcattttccatgatgttcacaccatctatctatctatctatctattatatactaaaagtccattaaactttctacaaacgttctcctcatcgttcgatcggggtgtctttcatcctatccgtacgcgaaaaaaaactcccgtgccacgcgtggggcgatttgttgcatcgtcatgtgggatttgttggcccagggctagcagctcttaagtcgccatgtggcattctagaaacgctcttaacttgccacatgttactctagcaaattagagaaaaaagcaaaacatctaaccgttgattttcactaatattcgataatattcgatgatccatattttctaccatcagattgatctaaagaggaaaaagaaaaggcccacaccccacctccagccatcaaaagaaaaggctcattatgtatacgtatgtagttacgtaccatataccacaccctggcctcacgtgatgcacgagggagacctcccctcctattttcaagcaattagtatatagaaaacatattttgtgataaaaattttaaaacaactgtattgtctaaatcatagagctgattttttttattcgtgcatgtcatgggattatttacaataaaaagtttataattcaatttccaaattaactatatttaacaagtacaataaatgtattactttggatcctatatggcaagagactagctattggtcacttgatacatttttagcaaaactcacctagatttttaaaccatatgattagcatcatttagcttatattagaaaatacaacacctgatatattttctcagagatctaaaattatatctatcactaaaaaaaaaaaatctccggccctattcccgctgaacatatacctatggtcctctcccttcttactcccctcctctcctcttctatttttttttaactaacaacctaatataaaacaacgtagctaaacgatttatagtatctaaaattatatttgatttttaatttgtttgaactattttttatttacaattaattaaataattaaagatccattatagctgtattttactatacaaaaattaaaatactctgcatggaaactaaatgacaatggaacattacaatttaaaacatcaaaatatgtattatgtcatattaaatcattctacataataaaaccaattaaacagcctttagatcacacttaagtcaccattaagtcaccatatgtcacgtcttaaaattacaaaatatttcaattaaatcgatgaccaattatttttaactattagatctaatttaaaaaaaatcttacgctgccacgtattatgtcttaaaaatcataaataatcttagaaattatgaggaaaataatgaaacctatcattattggttttaagttacattatttagaaaaggttagaaaataaatcgcatccacctcctcacccccatcacatgcgcacaccattgcatgtcccctccctatatttagctattaaaatataagagaaataatcaataattttagatattaaaacaaccataacttttaagttacacatcttatttcatatatacaaaatatcgcattcagccacattcgacccatgcgctttgcataccatccaaatataatcgaaatagctcaaacaaattgactgcatatattacgtcattttacatcattccgtaaacatgcatagctaaattaaaccaatagtatccaaataaaaattacaagtgaactgtcgtacattttattattgaggtggaatacccctgcccttttacatgtcatttgaattgccataaaagaattttgaaatgatctaacaacacaggttgcatcatcatatgttgtttttgcaaacacgtgtagctaaattagatatacactatctaagaaaatagaactaactataaaatatgaatagtccaaagaaaatccaattccttaaagaaaaccgtaaacaacgagtttacctaggtaagcgagtttagctaggtcttaggttttcaccaatggacccaaaacattcaactaaaaaaagaaaaaaatgactttctttgaatctatacttaatttatttaacatgttttataaacaaactaagtcttaaatgatgatgaagattatttataattgcttatacagttaaattaaatatatatataatatagattagagaaattatcaaagcgatacggacgatgaatatttgtcaaggaaacatactctcaaaacattgcagaggctattcgattaatatgatccattctcaaacgctgctcacgatgcatgaccgcatgaatacgcgggctatctccctagttgttataacaacaagtgcaaaattgaacaaatgtgctaggaacaccgaaacaataactgggaataggttacagcatttccttgatttgaaggaaaactcagaaattggatctatttcctaaaaacaaaaggaaaggaacttcaacctatgatatctctcaactagcaaaatgagtagtgatattttacttgtttccgtcatagtcaaatccttcatcgtttcacacagaaatggtgaatatataggctgtgtttagttaccttcaaacttcaatttttttttgaaaaggactaaaacacggcttgtatcttggatatttgtgaaaacgggggtatctgaataaaacaagcaaataaatgtcctagaataataaagaaacgcagcatatgataggaactactctctccgtaaaaaaaaatgcaaaccctgggtttccgtgtccaactttgacggtccgtcttacagggaatttttttaaattcgtattttcattgttgttagatgataaaacatgattaatattttatgcgtgacttgtctttttaaattttttcataattttttcaaataagacggacggtcaaacgttggacacggaaattagagtttgtctttttttttttttgggacggagggagtactctataccactgcacaacaccaaacaaccagctcgtgcctcaaggattgaaattcagatatctatagaagtacctataaaaccgttgccaggattgaactcctcaattaacaccagagcagcatctgaaacttttgtttgcttcgatagactcgctatggtatgattggatggcatgaaatttccgttttcggatcatgattggggatcctatctcaggtgttggtctctctattgcagcatatttcacgatggaccagcagtctatcactgctagaaaaaatatttttcaaggcggacaaaatcagtcttcctaggcggatggccggtccatctgtacaaagaggtttgcgaaaatgaagttttttcgcaggcgtgccgcctggtcacatagccacttgcgaaaatgggacaaatctgcctggaaaaatatacgcgccaaaatataacttttttctgccaattttttaatattaacttttaattaataatgttgcaattagttaagtaatacataaatacatttaaccattaacaaacatttaattcggatataatgcatatattgcttaagttaaaagtgccgtcaatacatacagtaatatttacaactaatattgtcatttcgaaatgcacgaatataatttttattatttcatcgtgttggtataatcccgaggagacttgtattaattattcactcattgctatgctgacttcacttgcggtgtatgaagtgacagagatcccgctgtatatttttaatgcttgtgtcatcaaagctagttcgacgtttgtgtcatataatattctaggtgaaaccccacgcattgctacaggaatttattatgataataataaaaaaaataacatgtaaaatagctagataacatcagattaagtaagttaatgtggtttatgataatttaaatttaaatagtatgtagaatggtgattcaaacgtaaaaagtaaggtggtatgactttataaaagaagaaaaatagggagatagtttggaccgtagattaatcgatcatctaaaggctaaaaacaattgagatgatatggcttaattagagaaaaaaagagaaagataattttgaccatatagattaatcatttaagcactaattaactgaggatgaactatttaagtatttaggatatcataaaacataataaagatatacattgaaatattatgtgaattatgtgggatgataatttaacatgcttgtattttaaaagctcttaaattataaaaaacgataaaattattgataatatagcatgtttgcatgatgtttaaatgtgatgattgttagtggatgatgatgtagcatcttgttaattagtggatgatgatgtgacatctttagatgttaagcttaaagagttagtatgttataactttatagtaagataggattagtatattaattagatgtgcagttcaccattggaattatatctaagagatttacatcttacatcctttgcgttgctgttgtacctgtcattaaccctaaggaactcatatgtgtaatatccacaaaggacactgcttttaggttttcttgtgacatttcatgacatacacatagaaggaattagttatacattgcaggtaaaatttttaaataaataagtgtgtagagtattactagccagtatatatgcactagcaacttctctatcatttgcagttgttccctgccctttactttgtagtagttgtacgcactgtacacataataggatttatgattcgtattaatgaacaaaatttaataattatgaatacttcatgaatagtacttgcatggatcagaatcacttactattgtaagattattatgaattatctatacgacctgtgattataatcgacgaggtccagaactgtaatgttctcgtacttcgggtagagcaagaaacatacttacttacagttatatagagagaaatctatcatacttacttaaagttgtatacggacattatgactcttttattttgaaatttgaggaatgctcgtcccacatactcatcccacacatttatcccagccttccataaattctacatatgttccgtcagtggctcaagaaatacgtcaatatcaatccaagccgtcaggaccttatattaggacacagagtagaacggactttttcttttgacaaagccagatagaaagattgtacatggtcagaagcattggccaagtgctatgtgagttgcttatgtctccagatgagttcactccatctgtactcaaagcaaacataatattttgtgggtctttagcaaattctagttactttgcatcaaagtttttccactgatgagcatccgttgggtgccggagtatctcatctttcttgctcccttcttgatgccagcgcattaattccgcatctctggggttttagtacaaacgcaatatgcggtctttaacagaaatataccacattaccagctgggggattttttttcttattttcctcgaatgagttagcctcttctttctcaaaacttacacatggagaagtgtttttagttgatttgtacctgttagcactgcatgttgggaatttatccaactaagcgtactccttcctgtataggatgcagtggttcatgcacgcatggatctttttaacaccaagaaaaaggtgataaattagttttttcgcttgatatgtgttgcaaggtaatgagttaggcttcggtagcatgtttttcaaaatttgtagtaagccattaaaaatactagcaaaccaaccatacctggccttcaagcgcattagttcaagcactaatcgtagtgttgagaaccccctgtcacaatcctttgactcatcatacaaaagatccttctctgccttctctaaagattcaaaattatctgttgtctaatggacaactgcgtcacgtcgaaaggcgtggttctctcaacagtagttggaagtaaaaacaattgtattgcttagtgaaaaatttttggatccccctattacatggctttagggggctatttatagtcccattacaggttcccctttagggtttaagttttacaggggaatttacatggttacccttatgatagggaaattattgggggcacatagtgtcctttacatgtatgggcccctattgggtttaaatggctcggcccatttatttgccgaaatccctcggaggcgcaacagcccgcagggcctcctcccggtgaggttcggtactttgcgaaacccgtgccttcgtgccaaggctttcgcctcaccgtcttcgcctgtgcggccctctaacgaggtctttgcctggcgaagtccgcgtattccgagccatggctttcgccatgtggctttcgcccatatggtagccttctcaaccttcgccgcttgcctccggtctgagtctgttgcctaagctcttggtttcggtaggttcggccgagggccctcgtggtgtacctccaacattatctaaacccctaaccgaccccattagcacatcaggttctgtatggcgtaacatttcctctaaatcaatgatattatcaccacaactatcaccatcagcagcctcaatgtgatcatctttgtcatgataagtccatattgtgtaacccttcataaatccacacgtcaccaactgatcccttattctcgaaccgtctatccatactttttcattcttacaatcagtaaatggacaatgtatctccgttacattgttgttgtaagcgtgtgttgtggcaatatcaataaatttagatacttcatccgtatatgacgacaaatacctcggcatatgatagattcattgtctgtccataactctgcaaacaattcatttacaattatattataaattaaattgacataatagtacatatttacaaccaaactaaactgtgcttgttatgagaaagagaaatataaataagtaggggatggggatctacaacacataaatttttcctattatgtggggagtgtggacaatacatattttctctctctttgaaggaagatgtttttctctctctacactagatctaggtgactgggaaagagcaatatacatatagtttggtaatttaggcacaatggaagagagaataacatgacaccatggtgtatacatagatcaaccacaatcatagcataacaaatcataaaaatgaaaaaaaattgcatgcaaaacatggtgctttcactatttttgcatgcatagatccatcactaataaggccaaaaaataaaaaaattgtaagaattaatggaatgcacggatctaaccacggcagaaaaatccaccgaatttcgagttcaaacctccccaccccccaaaaaaatttcttgttttcagagagagaaactccatatgaactgttgggaaactcggggggaggaagcacaatatatataggaccttctttccgtgcgggccacttaagtgctccacctgggaagatggatcttctaaggtggtctgccatctagcccctccttcctatcttacagacggatcgatggggcacatttttagttcacctagaaatacggtagtacctcgtttaggaaaatggtttttctggtactatgttgtatccaccctcttgaggaacgtaaccttgggtctatttgggaagcgaggagaagcagtagaacacgaggaagggaaggggatgagagagaaggaggaaggataaaggatgagagaaggaggcgccgcagttgccggcgaacctacgctccacactatggccctgtttggaagattagcccaggactaattttgagaactaatatttagtcatgaattggtaggctaaacattagcctaaggtggtatgtttggatccataggctaattcaaggctaaaaggtggagagagagtagaaagtgaggagagagaaggagagagagagctgcttttttatggtccccacacaaaattagccccattagcatcccttggaggggctaattcacttgagccaaaaattagcccacctgtttggatcctcgagggctaattcagagctaaaaggtaggggctaatgtttagcccatggaaccaaacaggacctaagtcgcctcgcgtgtcaccccgagagaaaatggtggattatccccttcacatatttgtatctgttattagacaataccaatcgaccaacatattttgcacccacaatgacaagaaaaacaaaactgttcttctttttagaaggtaaagtcggcgttagttttatattcgtcacattcaaaaaaaattatataattatttacttcatgttagaacattttcttttatgtcaagaaaaagacaacaaacaaatgttggtcacgtttagtgatttaaaaagttgggtaacatatcgatatgccctctgattaaatagatggcgatgcatcgttaccattgagctaagataaattttattatccttgagaaagtatctggaggtatcaagattttactctagaaattttggtacccatcaaattttagagcatattttccatacttgaagaagtactatgaggtacgaggtatcatgaggtaccaatctaatctaactattggtttaaagaggcaggatcggctaatgaaaatgaggtgcctctgctaatcaccgcccactcggccaatagcgagttcgtccgtgccgccctcttctcctctcttccatctgccgcatcgccgttgcatcgccgcagcatcgagtctgccgctgccgccgtcgcatccagcccgccgccccgcggccgccgtctcatcgagcacccaggcactttgccagacggagctccaaatccatcacctgtcaatttgtcatctcgtcctccaccctcgtctcagcttccctggcggacgacagagcaagcgccccaaatcggtggctttcatatcaaaattttattcggcaaaattgctattcaaaaaaagttgaaatttatccaagaatagcctgatgacgaacatttatcaagtaaaattgctcttactaaaactccaaaaggtctgaacataaggggaagatgaataaaagtcatacatctgtctacgtactgaatactgaaagcaatatactaatatccatccatcagctgatgccggtgctgttcgatctgcttgctttcttcttcgtgcatgaagcatcactcggcaccacaaaggttgttgagcgtcctcgctatctgccgcttgagctgtggcgggggccaccgcctacatcaacgggattatcgcgatgagatttggcgactgctgtgcttggggcagccagatccaccccgctctcgcagcgcgtaggccttgcggtcggcggcaagtcggcgacagtcctagcgaagtcgagctgtgagaatggaagaggaatgtggccatggctgggccgccgggggatatcggtggaggcgtcgtccctggcttcgctcctctgctcgggatgcatatgcgaaatcatagttttacccctaaaacttacgaacggagtggaggcacctggtggaaagaggtgcggtactgggaggtaccaaatcttcccagccgtttgatcatgcgaaatcaatggctctgattcggtacctccatccctcaaggatggtaaaatctctctaaattttacgctagaaaatgtggtaccttcctataccttttcaagaatgataaaattacccttgagctaatataaaacctaacagttgtaaactagcacaaaagcattaggaagaagtcaaagcgggcggaattacgtgagagaaaacctcagaccttgtatgtgtgtactattaattttgttttctgaaatgtgcactcagagttcctatttttattgttgcgata

SEQ ID NO: 5363 - DNA, 1001 bp, Oryza sativa
  unsure (1)..(1001): unsure at all n locations
actgtctcggcatggcgaccgatctatcccaatcacttgatttaagtatatatcgatataaggactatatgccgttaatatctacggccgatcgagtagatttagttcaaagataatgactatcgatcggtgcatatatgacatcggctcaaatgatatgtcctagctgatcagctatcgtttatggatttaaccgcggtttctttgtctttgttttttgttgattgcaggatcaaatcaactggcacgctagcatacccgaaggcgagttttggacctgcactggagttaagcagatctcccaggcctcgtgttttcacatcaacacgcttttggcacacccgatgggactattagaagtcagaatcacaacagcattttcccatggctgagaaaccaccagcatcgccgtcttcagctggtaaagatggctcttctaaatttaagatctagaagcctggtctatctgaagttaatgagagcaatatcgtgcctatcactctggacaagctgacacccgagcagcaaaaggatcttgaagctatgatgcagcaagcacggaaccaattcttgaactcattcatggagacacgtaagggaacaattgttcagaagtataaagtaaatgtaattgctgatgttcccggaacaggttcgtccaaggatcgagaaatacagcaggttccagatggtgcaactcaatcaggtgataaaggtactgcggatggttttcaaggggtttaaggtgatggctctcaaggggttcaaggtgttggttctcaaggaattcaaggtgatggttctcagggatttcaaggtgaaaatcctaaccaagatggcaacacggcacagctacagtttaacaacttccaagatcggattgattatgatgtgcaacatgctttgattaattaatctggggtattagtcaacacattgtcaaacannnnnnnnnnnnnnnnnnnnnnnnnnnnnnnnnnnnnnnnnnnnnnnnnnnnnnn

SEQ ID NO: 5364 - DNA, 5863 bp, Oryza sativa
ccgggactaaaaatagatctttagtcccggttggtaacatcaatcgggagtaaagcttatattgatcttttttcccggttagtgttaccaaccgagactataaatagatctttagtcccggttggtaacaaatcaaaaaattcctcagagctttcaaaccaggactaaagatgtttttagtcccggtttttaatacaaccgggactattgtgaaatctggtggaccgaccaaaaatggtttctccaccagtgtttgcttctccttttatcttaacgtaagagagatgtattccttgtaatttctatttcagtttagtggaattataatcgcagggaccttcttcttgttctctatgttaggaaaccggccggcccatgaaagctcggcacaggttatactctaatgggccatcactagagagaaggattgtacacttgaagatgaaatgatgagttggaatgttgcctctctacatatctttgtgtttccactttttcagacattatgcaacccctctagactacgcttataacataagggttgcataacacgttctcactacgacattctaccgaagaccgagagagaataactttgtgtctctactttttcagatattatgcaacccctatagactacgcttatagcataagggttgcataacacgttctcactacgatattctaccgaagaccgagagagaataagggaagaacttgtaagatccattctgcatatcgctcatctaattgtgcaaatggtaagaacttctttttcttttgcatgaatcataaatctatctcggttgtcaaaatatagccgtagcgttagcacggataaattattagttacagatgaaacatcaaattttaacggttgaaacatatatgtcttttctctaaattataatctctaaattataatcttgtgatcttattttaaaattttaattaaaacaaattcaatggtataatcgaatcgtagacctgttaattagtttatgagaaaatttgtattagatactagtaatacactttctaacctataaaaaaaaaagagaaaaatgagtatacgttgccctgcatacaacatgcagggggagagagtgcgcgtgctactgtatagaggggctgttgagttaaaaaaaaacatttcacccatcacattaaatttggatatatacatggagtattaaatgtgaaaaaacaattatacagtttgcgtataaattacaagatgaatcttttaaacctaattgtgccatgatttgataatgtggtgctatagtaaacatttactaatgacgaattaattaggcttaataaatttgtctcgtggttttatgtggaatctgttattagactatgtttaatttagttctccgtatatttgatgtgacgcaaggaatttttttttccaactaaacaggcccaccgtttagagaaaaagagagcgggtttcttttcaatcttaaaatcgggatcagcacatgggagaaaggaccgagcgagggctcgaacttttttcccccttgcgcgtcgggcgcccgaggtaaatcattttgaagaacaagttggacggattccattgtcagaccgtatcaatccccttttcatttgttaaagaaaatgttaaaaaaagaagaagagaagtatacctacccgtcccggttttcccccaaacttggctgcactgcagagctcctgttgttgggtgttcgattacagacatctggttcgctgtaggagtttattagcacgtgattaataaaatttattttagctatttttttaagaaaatagattaatataatttttaagcaacttttatataaaacttttataaaaaaacatatcgtttatcagtttaaaaaacgtgcgcgcgaaaaaagagaggggtgagttgaaaaaaagattctgttctttaggtgtaaagttttcgaaatatatggtcgtacatttgaaatattaaatgtaaaataataaaataaattacatattctgtctgtaaactacaagacgaattcattaagcataattaatctgtcattagcaaatatttactgtagcatcatattgtcaaatcatgacgtaattaagcttaaaagattcgtttcgcacatcctgagggcagcaattggttttttttcccatatttagtgccttatgcatatgtctaaatatttgatggcagcaattggttttttttttcatatttagtgccttatgcatatgtccaaacatttaatatgatgtttttggccaaatttttttaatctaaacaaggccatagctcatagctgccctctccctgacttctgaatctcttttagagagagagagagagagagatgagttcttattcccttggcggcatggatgctccggtgagtttctccctaggtgccatgggccctctcctcaggaagctcgattcgcttccggtggctcccgaaatccggctgcctgagccactgaaggacggaatcgagctcctcaaggaagatctagaagaaatcggtgccgccctcgtggagcagtccatggtagattccccaagccacagggcaagatactggatggatgaggtgcgtgacctctcctaccacatcgaggactgcatcgacaccatgttttcgatgcgctgcggcggcgacgacggcaagcccagatccgttcgccgccacaaggttggccgtgtgaaggttgacggtttctccaagacgcagaagccgtgcacgaggctcgccaggatcgcggagctcagggctctggtgcgggaggccagcgagcgccacgaaaggtaccagcttggtgacggccgcgcctcgagctcgagctcgagctctcaccgcgtgttcactgcgcacggccaggttcctgcgccgtgcagaaatctggttggcatggacgaaccgaagacgaagctcaccaatatgctcaccgacgaagcagagctgcatatgaaagtggtatgcattcttggatcagccggtattggtaagaccacgcttgctgaacaagtataccgtaaacttagatggcaattcgattgccatgcttttgtgcgggcatcacgaaaacctgacatgaggaggcttcttggggccatcctctctcaagttcagctgcgtatacggatatctgataccagcacggtgcagagccttattgataatctctgggagtatctacagaaaaagaggtaattaattaacgctatattcactgctttttaatactagttcagctactgagcatcaccaatagactctcaaaattctattcccaaaaatctgttattgggcgttctaaactgattttggggtgttgaatgtattcctccttccaacaaattggcttaattaactgcctaaaattaaggacttggcccatgtaaaaactattaacagaaatcatgctccccatcatccatcatccagcgtgatcacatctgcatgatcggccacgcctccctccgcgatcactcccgccatgattttgggagtcaaccctctcccctagaagagtagagcaagacatacgggaatgggagctgcaaaattttggtagacctttcggatattgttggagcaagatttttacaaaaaaaattgtaaattttggtattgggaatgattttgggagactcttgtgaggctatctccaacccttcatgtcattagcatgaggggactcagtgtccatagcattaagtatattgtcacatcggaaaaaatctgaggtggcaagagagttaatgaggagagagatgaaaagatgaagaaaccatctcttcacaacaaccaagaatgaaaacaagtgataggttcataaaaggagagagaagaaagatgattggatatatagtgtctatatgacatagcaagtatggaaactactttgatagtttctaggttggggatggcctgatgctgcacattgaacaattgctgttccctccgtcacattgaataaggcgcgcatgcattttaaaattgaactctctaaatatctgatcaataatattttgttataaattaacttttatttgacaaaaataatatcattggattgacatttaaatttactttgatataattgtgattttgttgttacaaatatcatagtattttagatattcaaaatcaaagatttgttttaaaaaccataccaagtttgactgcgccggataaagggggtaatttagaaaataaataaataaataaatatattatcctgataaacttcctttcctttttgagagagacctgatacactttgttcttttcccagagaatataatttaattatactttgcaggtattttattgtaattgatgaattatatgaaacagcaacatgggatatcattaccagtgcttttccagaggataataattgcagtaggataatgactacggctggaattgaaggtgtagctctcgaatgctgcagttatcattctgtcaatattttcaagatgatacctcttggccttgatgattctgcaaaattattctttaatagagtttttggatcagagcaacaatgtccttatgaattgaatgaagtttcatataggattacagcaaaatgtggtggattgccactagcagtcattattatagccggtcttttagcaagcctgccgtgcaaaacagagctgtggtacaatatagatggatgtttatgttccagtgtgactacagatattgatttggatgagatactgaaggaaatcataagtcttggctacgacaatcttccacattatttgaagacatgtctgttgtatcttagtttatattcggagggtttcataatttggacggctgacttactgaagcaatggatatctgaaggtttcatcgctgtaatagatggagaagacatagaggaagtcgctgagagctatttctataaccttgttaacaggggaatgatccaaagtgtgaaaactaagtacaataatcaggtgttgtgtactgtgcaccacactgtatttgatcttattattcacaagtccaaagaagagaaatttatctccgcaatagattactctcaaactatgccaggaaattctttagaggctcgtcgattgtcattccactttagcaataccagatatgcaactgaagttgcaggtattacactgtcacaagttcgttcgtttgcctttcttggacttctgaagtgtatgccttctattatggaatttaagcttcttcgggttctaattcttgaattttggggagataaccatggatgcatgagttttaacgttgcaagaatttgtagattgtttcagcttagatatttgaagatctcaagccaaataataatagaattaccagcccagatccgggggctaaaatacttggaaacacttgaaatagatgcaagagtaactgcgattccatctgatattattcatctccgaagtttgttgcatctatattttcaagatgggatcgttctacctgatggcattggctgcatcagatctttgcgtacacttaagtattttgatcttggaagtaactctgaagagaatatacggagtcttggtcagctgacgaacttacgggatcttcatctcacttgttctgcaccaaaatctaatcagcaggcaaagagaaacctcgtaattctagcctcttatactgggaaactcggtaacctcaaatctgtcaaattttctcctggtgattcaggcatggatatttcctttttgttttatggaattggtatttcggttgatcgttccagaacagcgtcctctcttcctttctctgttaggacattagagttgccatccatttgcatatttgctagacttcctgactggattggtcaactc

SEQ ID NO: 5365 - DNA, 7972 bp, Oryza sativa
  unsure (1)..(7972): unsure at all n locations
nnnnnnnnnnnnnnnnnnnnnnnnnnnnnnnnnnnnnnnnnnnnnnnnnnnnnnnnnnnnntttatggaattggtatttcggttgatcgttccagaacagcgtcctctcttcctttctctgttaggacattagagttgccatccatttgcatatttgctagacttcctgactggattggtcaactccgtaaactccacacattgaatcttgctgttagagaactgatagaaaatgatattgatagtcttgcaggactgcctgacctcattgttctctcaatgcatatcatgaaagctcctatggaaaggattgtcttcaacagaaaagcatttccagttctcaagtatttcaagtttatatgtggcacactgcgcatggcttttcaggcaggagccatggccaatcttcacaggctcaagctaggtttcaatgcccataaaggggagaagtatgacaatattcttgtaggcattgagcacctattaaacctcaagaagattgctgttcgaattggaggagctgctgaagccaaggagtctgacaggatggctgcagaggctgcgttgaaagaagccattagaaagcatctaatgtttcttgatgatctcgacatagcaagggtagaatgtgttaaggaagagtataagtgtattaagaaaaaacacaagatcaagattgaagattcaattagcgaaaaaaatggggactcaaaaaagcagcattctgtcgaaaagaaagcagtgtggggcaaaactatgaagaatattgctgatagtgggtatgttctttcctattatttcagcctctacattttccaatatatattgtttagaaataaatgattactacaacaataaccttatagtaaaacgctaaaacacagttgtatcaaaaggaatctttacaaaggtacatctatgctctttgaaaaggataagatgggatgctctatactaattggagcctctactagaagctttcacattaaccttagaaggcaaaagactggaaattcccacattaacaaaaaagaaaactaaaagcattaatctttgaaagatcaaatggtatgcgccaatgtatcaaatctaaggttgatatcttccaccacagaatatgtgcatttatcaaatttggaatcaataaatacctagttatacttggtttggacactcgagtatagtattttgatgaataataattgaaacattcagcattaacaaatattgagttttactcggtctagagtctcactagcttattttttatgattttattttataattccgaaattcagaattgataaatactgtgttgtactaggtttgaagtttttgttgaataatagtttcaaaattcaaaaacaataaatatgctcaatttagagcgtagagtaattttctcatgacctaataattctgcagtttagatttaatcatagtatctcatgatttgataattcaaaaatcgaaattaatacatactcagttgatgcttgtacattcacacgggttaatttctaccggtgtccaagcggtgtagcaagatcaaatagtatgggttagactcaatttacactttgtagtcaaagttgtgtgaccttgtaagcaatctagacaaatggcaaatctatggctatctaaaatttaaaacaaatcagacatgctatttacgggaagctgttttgatccctcaagagaatgtccctcgcttgtaaaaaaaaaccatctagaattctcaaaaaaaattcacaacattcatactatgtatgtatgtatgtatgcatgcatgcatgcatgcacacacacacacatgtatgtacatataacacatatacatatacatatacatattcatacataacgcacacacacaaattaacttaaatttttgaaaattttcaacttatgagtatatactaaggtacaagaatttgattcgtacctatatctagcaacaaaacaactcaaattcaactttattttacaatccattattacatacctaactaattatatgtttgggtggtatatacctagaagcaaaatctaacaaaaaaatgttcaaatttagttcaaacttgttagtaaagaagttaatgtccatacctgatctacattgccttgctctcatcatcgtcagcgttgtggcctttctcacaggcaacctctcctcgctcgagatccataaaaacaagagagaaaaaaatggattggttagttcgtgtgtgtatctatatataggtctatagtaaaaaaattactgggtgatgcgttgtgggatgggcgatgctggtagtctgcgggggtgggtttacacacacaacactccactaggtccaaactcaatttataacatttaggtataaaaaataaatatattcataccggaatttgtctttttgtttctcaatatataggtcgaatttgaagttgttctctcgtggaatgttagatgtcactgtactccacattgttaattaaatttttataactattttaattgaatttaaaagcaaaaaagtatatgaggggatatcctttcgtgggattagaattcattcctgctattaactagacctgtattgcagcgtgtttcctgaagattatactatgtcaagggagcaacgggtcgcagaaggcttcgtagtgggcattgaaaagtgcagggcagaggatgcggccgagcgaataatcaggaatgtgcctgtggactatgatgggcttggccaggtgagcacatccaagatacaggaccacttgcctgaacttgctcctcgtgctgtgcaaaacgagaagttcggctcttcaaatgatcttagcataatgatacaaatcaacaagtatgctcgtctgccatcttatgagtggagggacactgatatatccaaactgaatttccggcttctccgcgccccgatgttacttgaagctgtaacggcccgttgtcacttgttggacttaatcctcattggttcaaacaacattactgttcttgaccttggacgtcccacaatcaccaaactgccggcatctatagaatgtctacctaatttacggtacttgaggttgcagggcacgcaactgaagtcgctgtcggaggttattgtgaagatccccccatcagggggttggacatcaagaataccaagacagaggagctaccacaaggcattttgaggatgaagaagttgagtcacctgagtatgggggagaagcagaaaaatattcaagtattcatggaaaaaatgcagactctggctgagaccgtccaagacagcgatgacttgtccgacgaaacagagggaatagccgacgacgaaggcgagttctctacaagggccaacgcgtcaacaccgaaggtggatgaggacgaggtggaccggagggccaataacttcatcgccaggttcaggaagcagatcacgatcaggaattcaggattcgccaaaaaggagagcagcatcgacgaacgactgtggatacgagatctcgatgagtgccaactctccaagagaggtggacgattttaagaagaagttcgacgagatcattgccaggaacaggcacacatggaagccaatcgagtcaccgcgttctgtcaagcacggcaagtatttcgttcgctgcccgccgtcgctaatcaccagcgctgtcttttcctttttctttctttctatttttctagtatggtactccctccgtttcaggatattgtcaggaaacccctaatcaatcgccttgtgaacactggatgaactcacgcgaaagtggaagaacacgtagaacacaatagtgtagacgaacagacaacaaaaacagagtttttggtgctgcctgaattgcttgcagcttttcggggttttttctctccttttattgtacagaactgaaacatgcaaagctacgccaaaatactcggatctctacccacgactcgcggcttgatcgcgtccatccccacgtccgctcatcgtgcgcatacgcccgcaggcttaggcacgccgcgagctattctcgcttgactcctacacgcacggcttccacacgttggggctcatacactgacaatgcacaaaacagaatccaaagcttagataactagctaaaaacaagcatgcaagatttatcctcgaacaattctccccctaaaccttgcatggctgtaaaacctcaacaagaccgatcttggaccaaagctccatgaatcgatctcgcccaagggcctttgttaagatgtatgcaagctgctcgtcagtattgatgtattattcgatcttaaccctgccttcctcgacgcactcccgaatgaaatgatacctagtgtccatatgtttgctgcgatcgtgaaacacagggtccatatgtggtctaacccctggtttgataggtagccgatgttcaacaattgatcagctgagtcttggcatctcataatactcccaagcgaagcaatctctgaattcctttaacagctctatcaacttggttctaaattccgaagataaattcttactaataaatgtcggccttggtcgatcacccggacctatgtcaatctcttccaaatcatcggctgacatgaaactctgtccttgcttgtcatcgagatcatctactgtgtcctcggtgtagacgtttgaaccctccacgacgccctcaaaataatagcttgggctctccatctttaattggctgtatatcagaatcggacacttttagaaaatctccatcccaaacttttccagataagcaatcgagaccatccatctcccaaagagctaaatcggcactggcaatattaactgacctgtcggctggcacattttcaatctcgtcgccttaccactgaatcaagcattgatgcatggttgaaggaatacaacaaatagcatgaatccgatcccttccaagcaacaagctgtaggaacccttcccatcgatgacaaaaaatgttgtagggatagttttgctgtcgactgtcagttccacattcaaaattcctttggtttctgatggattaccaccaaaatctttgagcaccatgtttgtctagatgagatcctcagcatttctgcccagcttcctaaatatagcataaggcatcaaattcactgcagccctaccatcgaccatcatcttggacatcggcttcccattgacatagccatttatatacaatggtttaagatgccgattctttgccccttccggcttctcgaagactgcttgttctggtgacaaaattaacttagccgattcttcttcaactttgtcaacatcggcttgtttgaccccaaattcagcaggcaacgtgaaaaccatgttagatgcggtcacaacaccttttcctttagccaatctctttgcttcatcggctgtggcttcatcggctgcaggaacttgattcttaacacgccactcctgctttggcttctccttctttagccgatgattgatttcttgctcaacctcctgaaagcgctccctattcctcaacctttgaacccttctcttctgattctttgtaaaaataccagaaggacaccattgagtcttcccgtctttattgtcttcttggtcacaaccttggttcaccgggcccaacctttgatgaacaggaactcttgcttgccttagccgattgcttctattatacgatcggcttgaattctctataacattactgcacccaggacagtcttcaatagatggcagcctcataccttcattccagcaaaatctaaagaactcacagtcccaataaggatcaaaaccgccatcgtcttctccataatgcctcccctgctgttcgtcatattttttctgatacttattgatgattttagccgaattcacctgaaaacctcctgctcttcctccatcggctgtttggccagctgtgtgtaccatattaacaggaaaaggactgccatcaaccttcatcagcctcttggaatcatcaattttgattttgcctccctcaatagctgcatggatctgctgcctgaagactttgcaatcattggtagaatgagacccagaattatgccacttgcaataccttctcttgcccaattcttgagccgatgggattgtatgaccagcaggaagttgaatctgtttctcccgaagtagcaaatcaaaaatcttatcagccttggtaatatcaaagtcatacctctcctcttttccagaactctttacccattggcagggtataacctttttgcttctaacccactcggctactgctatttcagaatcatcatcatcatcatccaatccatatatgtaaggaaaaacatgattaacctttttaaaattcttcctggcctctgcaaacctttgttcatgcagggttaccttctatgcaagatgtgacaaactatcaaagtcttgagatgagaacttctccctgatcggagctatcataccctgaaaagccagatcggctaactgggcatcagtcaaggccaagctgtagcatttattcctcatctctctgaatctctaaatgtactcctgcacaggctcatcatgcctttgcttaattgctgtcaaatctgatagtttcatctcatgaatcccactgtagaaataactatgaaaatgcttctccaaatcggcccaactgttgattgacccacatggcaaagaagaaaaccaagtgaaagccaatccagacaaagacaatggaaaacctcaaggcatccacagccgatgcttcaccacactgagctaaaaatcggctaacgtgttcataggttgaaacactatcttgtcctgagaattttgaaaaatctggaactttgaatcagttaggcagaggaactctctcaaaccactcggggtaaggatgccgatacaaatttccagcatctttcggcttaagcccaaattgttcccttattacatccgcaatcatatcggctcatggtcgttgctgaggcactccttgtgcttgttgtggcacgggctcgaattgattgtattgaggaacaaactgggttgagctggtcctccttgctgatattgaacttgtggcgatggaggctgatactgataattcaaattgcccccctggtaattctgaaagtttggttgtatattacgcaccaaattttctggaaaaacttgaggtaccaccgtttgatctggttgcacattatgaaccaaatgctctgggacaacttgatttgcagcgtgttgccttagctgattgtcaggtgttacaaacccagctgatgtattcattaaaccttgccgctgaatcggttgaacaacttgttgcctccgtggggtttgctgaattggccgcaccacctgctgcgttggcggtgtctgttgaatcggctgttgctggactgcgtcaacagtaggttgagggggtaagaacatggctgcaccttcatcttgagttagccgactcacattctgttcactatgctgtggttgctctctcaccaacaaccgaggattaattaattgacccggtgtcgatgatggtgcagcaggtgcaggggccgatactggtgctaccggttgagccgatggtgcattgggaggaatcggctggacagctgactgattattagtaattaagggccgataatttgggaaaacacctcctggtaaataaaccggtcctatagcctgatactcagctatcgagccatcaaccatcgacttcaccatgtttgacaatgtgttgactaataccccagattaattaatcaaagcatgttgcacatcataatcaatccgatcttggaagttgttaaactgtagctgtgccgtgttgccatcttggttaggattttcaccttgaaatccctgagaaccatcaccttgaattccttgagaaccaacaccttgaaccccttgagagccatcaccttaaaccccttgaaaaccatccgcagtacctttatcacctgattgagttgcaccatctggaacctgctgtatt

SEQ ID NO: 5366 - DNA, 11004 bp, Oryza sativa
tgttgatgtgaaaacacgaggcctgggagatctgcttaactccagtgcaggtccaaaactcgccttcgggtatgctagcgtgccagttgatttgatcctgcaatcaacaaaaaacaaagacaaagaaaccgcggttaaatccataaacgatagctgatcagctaggacatatcatttgagccgatgtcatatatgcaccgatcgatagtcattatctttgaactaaatctactcgatcggccgtagatattaacggcatatagtccttatatcgatatatacttaaatcaagtgattgggatagatcggtcgccatgccgagacagtataaatcacttagaccgaaatatatattaataataagactatatgtgtttatagcatagccgattagatagatctagcatgtatcggctattactccgataccactctatattaagatattaaagcaagtaaaatataccaaacgaaagcctaatatacttaaatgcagcaagatattaacataaagggcggatttaacatgtcaattaagcatataggataaaaagtagttaaatcaggtaagatcggctgaaaccccgatactactctaatcggcaaccaagaagcaggctagagattgagattctaatcacgactcataagatcaaactcaactgatgcagctataagtatgaaaagaaagacaatatctagacaatcaagccattggaagttttatagagtggtggatatcatatataatctaagccaacgtcgatatttaacctaatcggctgccttctattgacagatgttagccgattgtaggttagatagcgatattgccagagattatataagatatatgataactcgacgaattacataaacaagattagagtatcataaagatggaatcactaatactgagaacgcaagccgccataacaagttttatctcttgttgaagatcaaaaccgatgcagctcaacccaaaagcaaaaactcgtcgaaacaaaatgaaagtgaaaaggtggcgatgcgccgagattgtattgaacgtctgttagtttgattacatggggctcggggtctatttataccctagaattacaaaatatgaccatatcggacacgactcttatctctaacaaactctaagataccataagtctttgcggcagacttttgcccaaacatatctctaagaaaattacataaaatatcataattaatagatacaatttccttctcaggactctatccatgcgtggcaatcatcatgaagcacatcaacctaaaccgacaacatatgctatgtcatattgtcggattcggctcaatcggctaacctagtccgactcgaaccctgccgatctagccacagccgattcggacttcagccgatcttcactctgtttgcgggacgatttccatctcgaattccatctcagtttcttcttcttctctgatccttggattaccaaatttggtcgttaacactaagcagaattgcagactggttgtcaaccttcaatgtgacggcgctcccttcttctcccctgagctcaacaaggagacgcgccagccacacacactgtggcacgcagcagtcgtcgccgcaatgtactccgcttcactggacaacagagcgacgaccttttgcttctgagactgccaggtgatcaaattatccccgagaaagaagagaactcccattgtgctcttacggctatcaacatcgcccgcaagatcactgtcattgtagccaatgaggcacacagcatccttcttccttcggtattgacagccatagttggtggtgctggcaatgtatctcaacacccgcttcacagctgccatgtgctcggtggtgggcttcttcgtaaaccggctgacatatcccaccgagaacgccaaatctggccgcgaatttaccaagtatcgcagtgatcccatgatccgcctataatccgttgcatcaacagccggtgcggcactcgacttgctgagcttgaggcgtgattccatgagggtgaggctgggattgctgctgctcatcccggccatctccaatatcttctcagcgtatgcccgctggcacacggtgatgccgtctttagtctgattcacctccaatccgacgtaatacttcaacaatccgagatcgctcatctggaacgtgcccttcatctcctccttgaactgctcgagctcggtggactcgccaccggtgatgatgagatcatcgacgtagatgccgacgaccaaccggcgcgtgcccgtgcctcggaagtacacggcgtgctctgacgagcttcgagagccagcagggatgcgtcgagcttggcataccacgcgcggggcctggcgaagaccgtatagcgctttgtcgagtcgcaacaccatgtgctccttgccggcgtccacgaacccggctggctgcgtgacgtagacttcctcctggagctcaccgttgaggaaggcggacttgacgtccatatgatgaacggcccagccctcactcgccgcgtgcgccagcagcacccgaacggactcgagccgcgccaccggcgcgaacacctcgtcgaagtctatcccctgtcgctgcacgtagccttttgccacaagacgcgccttgtacctggtgacattgccagcggcgtctttctttgtcttgaagacccatttgagtccaatcgggcgctgacacggcggcccgttgacgagacgccaagtgttgttggcttcaatggacttgatctcctcgatcattgcctggcgccagcactgatgttgctctgcttcatcgaacgacgccggctcttccgcagagaccatcaggagatcctcgtcgaactcccgtaccgcctgtccaggtggtgttgctggggcgagcacgttgtcgacggtgcggaacttgagtggcgcgtcatcatggtcgacgtcgaggttgtcctccagacctgatggtggtgacacgaactccaccgtcggtgttccagcgtgcggaggagtgcttggcgacgcctggctcggtgacgacacgaacggcgagcctggcggtggtggcgccgcagctggggaaggtggcgccgtctcacgttccacgaagcgccgtgtcgatggcaccgcatctggatgctgcacggtggcgtactcgacgacgaagtcggtgtcgacgcctgtttcagcctagccgtcccacctccactgagcctcctcgtcaaacacgatatcgcgggagatgtgcacccgtcgcgtcacggggtcgtaggcgcggtacgcctttgatcctagcttgtagcccacgaaaatcatgtgtttactcctgtcatcgagtttcttcacatttggcatggtgttcttcacatgtcccacacacccaaatgtacgaagatgatgaaccgccggcgcaccgccgttccatagctcgtatggagtttttccgccgatgctcttcgacgacgacctattcagcaaatagactgccgtatttactgcctctccccagaacatacctgggagcccttttgcctttaacatgctcctcgtcgtgcccaccaccgattgattccggtgctcgacgacgccgttctgctgtggcgaatacggcgccgtgagttctcgacgcagtccgagctcggcgcagtactcgttgaagtggctgttgacggtcgttatcaatcagtttcgaccgtcaatattactaaaataggagagaactagtgatgcttccaatgcataaatatgatagaacaataatattccactagtattaggtttactaaccattttgcagagaatgacaataaagtggaggagaatcgacatcaacacaaacgataaatcaatcggacgatgtcaagagatagacttatgtatgaatgggccaagaaatcagaattgacatgacaaactgggccaaaattcacaagtctgcggagaagaacaatggaggaggccacctgccgattttgggccaggttgggccggcccctggttcggccgaaactccctctccaccgttggatgtggggtttggcagggacgctccagatcctctcctgatggcggttgcggggtacttcagacatttcgcagcagttacaaccgtcataccttcctataaaaggacttcaccttctcacttcactcacacacctcaagcaagagctctctcattcctccaagtttagtttagtagtatctagctggtggaatagaattagaataggaatcaggagtccggaagtcttcagaagagttcgggtatggctctagcagctttcctttcctcttttgtaagctttgtacttttattagaatactcttctatatacatttatggtattgaaatacttttcgagtatatgagtacgtactttacattatgttcttgttatactgaatgtacggctagcttatctaggagatgctttggtgcgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacgggtattccttcgagcctatatataatcctaagttaatttcctggggagggtattcctccgtatttagccccggttggatggtcatgacgggctgtcgtaaggaactcgacagttaggggtggcttctcgaagtaccaggagggcatcggatagagggtattagctagtatatcagttaactagaatgtatgtatactatgtatattagaagtataggaatagattttctttctcttttctttccacctagcttagaagtatttctgcgtcattactgggaattatatttctagtaatgttgttaagaaataccaacaagcatttctggcgccgttgccggggaagattcataatagagattacttgaactaatactttatatttacctctgtataatcattttcctttgcaagctagccttggttgttttcactttttgttgtgaaagcagggtagtgcatgactggtttcaacctgccggaaaaattcaaagaaaatccagaagctttcttccggagtgtcaggccgcgggtcgttgcttcgcagaaaactctaccgacagagaaaccagccttaccagcgccaccaaccttcaagacaatggccagcaagactcttcgcgagttcgctgctccctctgctgacaatgtggccgttgggccgcaagtaacataggagatgtggattttgacttgaagtccagcctcatttcgacttgtagcacgtacaccatcaagggcgtcagtcccaacgccgttaggctgcggctgtttccgttctccctcctcgggagagcgaagcagtggttttatgccaaccgtgctgctatcaacacctgggataaacgctctacgacattcctcttgaagtgcttcccgatgggcaaaaccaacgcccttcgtggacgaatttccagtttccagcagacaagggacgagtccattccggaagcatgggaacgactgcaggagtacgtggccacctgtcctcattatgggatggacgactggttgatcctgcagaacttttacaatgggctcacctcgatgtcccgcgatcacctagacacaacagctggaggagcgttcttctctaaaacggttcaaggagccgttgaactcatagagaagatggtctccatatgggttggagcgaggaacgactctagacccgtcagcgaggcatgcacaccatcaaggagacagaactacttgctaccaagctggacctcctcatgaaatgcttggacgaccacaagaaacggccacaaggcaccgccaaggccttggactcacatgtcatgtatgaagtctgcggcggcatgggtcattctgggaacgactgcccggaaacctgtgaggaggcgatgcacatgggcaacaacagcaacgggtatcgtctacaaggaggtcaggggtggaaccaaacacgaccatattatcaaggaggaaataataacggtaacttctgtaaccaaccctccttgaaggatcttgtttttgcgcaagctaaaaccactgatgcggtaagcaaaaagcttgctgccaatgattagatcttagagaacataaatgtcaaactagatggctttgcttccgcatttcagaaccggctgagctttaataagatgatggaaacttagttagctcagttggcatccttagtccctgcaaatgaaactaggaggattccggggcaaccagactcctccattgaaaatgttaaagcgatcacgacgaggggaggtaagtccactcgtgatccgccgtatcctaaccctacgggaactaatgggatgtcaaaagaaacgccatgtaatgactcggctgacaaggagattcagccagaaaacaccgtgccgcaggagtactgcgacacactgttgctgccattcccccagcggagtaggaaaccgtcagtggacaagcagttcgcttgttttgttgaagtgatccaaaagatccacatcaacgtgccgtcattggacgctatgcaagtgccaacatacgcccgttatctcaaggacatactcaaaaacaagagaccgctcccaacaacggaggtggtcaagctgacggaacactatagcaacatcatactccacaagctcccggagaagaagaaagatccagggtgtcccacgatcacctgctcgattgaggcacaacaattcgaccaggccttgtgcgaccttggagccagcgtcagcgtcatgccaaaagacgtcttcgacaaactcaacttcacggtgttgacaccaacaccgatgcgcctccaactggctaactcatcagtccgttacccggcagggatagcggaggatgtgccagtcaagatacgggatttcttcatcccggttgactttgtggtgctggacatggacacagggaaggagaagccgctcatcctgggccgaccgttccttagcaccgtaggagccaacattgacgtgggaacggggagtatccgtctccatatcaacgggaaggaggagaagtttgagtttcaaccaaggacggaacaatgctccatggttagaatcaagtatgggccgaacccgcagaatattcaagaggtcaaagtggagccacccaagacggatagcctggtaaggtttatgcagaacttcctggagaaggaaacaacaatgcccaggaatcgttattggaggacgccggtaaaatcacctataccgccaagaagttagagcagtcagctcagaagaagccgtcttccacaccgaaatcaaagaaggtgtggaaggaaaagccaaagacgcccgccccattacctccggagacgggtggaaaatccatgaactgaatcgaaaggagatacggtcttgcacgtcggactttaaatgacgcgaccttcgccaacaggtaaattggtatgtatccgcatatttgttttcaacaatttgaatttttgcatcatcacatatttgaatttcaaaattacatttagggtttttgaattttgaggaaattcttcaaatgaattttttagagcaaactaaaataaaattttcaacgaaaattcactataccacgaccacactgaccgttggattccaacgaccgaaagtggggccggttgggcccaccaggggtttggccgaactcactggttcggccgaaccggctaggcaacggttacttgccatttttggcagggtaatggctagtgggtcccacatgtcatttctgaccgttgtgggtaccctataaaagccagccggccgagagaaggaattccaccccatttcaacacattttcattccctctccaaagtttgctctcaagttcattcaagctttgatagttttcctcaagttcaaatcatttagttgcatatatacaagttgctttggtgaaactaactggcgggtgaaactcttgtcatttctaacccccgccgagttagcccgttcttgctccattgtgcagtatgaggaggcgactgtctcgtctgttcaaagggtcgggctctccatcaagtcgtcatgacgagtctagcactcgctcatcagctgatgtctcgatggaagacgctgacgctccacgacaactcctgagcgacgctgacctagaccttgtcagtgatcgggagagacaagcctactacatgctgagcgaccgggagtatgctcacacgtgaaaatactcaccggagttgctgaaaaagataggtatggatgttgaattttgttctatttggaaagctgttggttggcagagatttgctgtggtagataagcccggttctcgtttgcttactttgcaatttctgtgcactttgaaagaaatagaagatggtatttcttttcgctttttccgtaaggagttcacgctcacatggaaaggcttgagtacacttcttggttttcacgattcctgtaaaatcgatctctagaaaggaatttctgggttcgagaaaaataggttttgggaagatatttctggtgctccaatttgcaagaaacctagaacaaatgatatccataatcctacacttaggctcatgcacaaatggattgctatgactttgtttcctagaagtgatctgagacccattaggggagatgaattaattatcatgtttgccatggttagaaaaatcaatattctcctgtgaaatgtatgataaggcaatggttagaaagtataaagttctctgctcctgttgagtgcacttctctgattactcggatagcaaaagggctaggggtcgttagcgaccaaattgcttttatctcagccgcttgtccgcgtattgatgaggcctatctagtgcaagggcatattttgaaacatggagcagatggatctttgatatactttttccccggttgtacaaatgaaatcccattgccaaatgcagggtatcatttgtacaactgccatgaactaaccattcccctgcagaccatagaagaatctcgtgcaagtggaacatacagggagacgcgcaacctgacaaggaacgaacgagaaagttcatcatcctcgacacccatgcagatgtatgaggcaggttgggcaccaactggggatgcacctggatggacccaagctccacgccatagcatcggagtctcaacctgggcaagcgccagtgaggactcgtggcatgcgcctcatgacgaggggacaaccaaccctccagatcaagtggtgttcctccatctccaagtgaatggcgcttgagttcctctcattgggacttggggtgaaatcactaggagaatggacacccttgatgtgcagacgggggagatctagtaggacctcgcggaacacatagctcaaacgcaagaatggcaacaatctgctgatgctcagttcgctaacatcaacaacatgatgcagcaacagcatgatgaccttcaggcgtactttcgctttcaggggttcaatccttatcaaggactctgagcgaaagccaagcttggggggagatacctctgcccccactgaggtaacttgtatcacattacatatctccctttccaattgcatatttgctttccaattgcatcttacaaaacatagaaacaacataaaattttgtaaaatagaaaataccaaaaagatatgataggtttgagtcatgctaggtaagacaagctagttctctttgttgaaatgatgaaaagttgctctgttttatatctatgatatatgggttcttggtaaatgctctctcaaagattgaatttaagtagccaacaattatccgggaacctgaggtaaatgggctgcacttgctgatctaagcctaggttgttgcgagatatgagatagtaaatatgagtagctatgatcctgttactagtttgacttgaattccggatgttttgtttttcaaaatgataaattgaaagttcctcagttgatataaattcctactagagccaaaaatgtgctatcatgattacaccatatacattttggttacttgccattccattaaactttgtcaaactcatgtgacttgtgtagatacttctcatgctttatgatcaagatcatacactcacatatatgcacatgctaaactccaacactgggagctaagcaatattccattccatatccatatttccaccaaaataaattctccatgctttcatgtgctttcttctcctaaaaaaatcattttgaaaaaaaagagaggagggaaaggcatggttatgagaaataaagttatgctccatcaagcatgagcatattactggaaaaaaaatgtaatcatgccctctcctaataaataaaagaaggatttttgggagaagaaagaaaagcacaaaggagaagcattttcttttatttttcctcatataccatttccactgtataccacacacattttgcacgatcttgattttgagtatgtttagttatctgctttagtctaagtttttgacttagtaataaatgtgaatgcaagtatgccatgtttgatccttaccgagctccacatataatccttagagtaggaatcgacaaggcaacaattcggtgaggaatttatgttgatacacttagagagactgagtgaatcaattgaggaacttggctttcttttgcaaaatcatttgaaaacttccggaataagagttgaataaagattgggtgactagtgctctagttgttgttctgtctttcaaccgtccaaggcaaggagaagcagtgtctcgtgggaatcaggggtaagggtaagccaccgtgccaaagattatttaatctgagagagagtacatataccctgcacctgtatctttgagatatgcaacatagtagcaactcctgatcaacaaccaagtctttgattcctttcgtccttcgctcgagacgagcaaaggttcaagcttggggggttttgttgacggtcgttatcaatcagtt

SEQ ID NO: 5367 - DNA, 13141 bp, Oryza sativa
  unsure (1)..(13141): unsure at all n locations
ttggtgcgggtataatgtttgcttatgcaattactctctgtcatgacgatgatattagagtagtatctggtagtttagacgtggtgtctagattacaggatatcattatttggggttatatattgcggatgagaggtgggccgctgatggtgacagctcagtacgggtattcctccgtgcctatatataatcctaagttaatttcctggggagggtattcctccgtatttagccccggttggatggtcatgacggactgtcgtaaggaactcggcagtcaggggtggcttctcgaagtaccaggagggcatcggataaagggtattagctagtatatcagttaacaagaatgtatatatactatgtatattagaagtataggaatagattttctttctcttttctttccacctagcttagataaattattacgaggatgagtaggaatgcttgtgtgtcactctacccttggattatcttaacccctgcttagaatatgattatcacaagtaatatataaattattagttgagttttctctacatgatcttcacacgggataaaataaatacgatacccttggaatactctcgggtgaaatgctacaatggtatatccgtatgcttgcggatgaactctgtaaccataatataccagaagtattttgtcgcgtcccaaaacgactctaaaatacatcctctaaattatgcctagaataattaaaattcgtgtgaaagcctccaacaattaaaatgtgcaaagttaaaagccaaataaggcttagaggatttttgtaaatttcctaaaagcctaaaatgtgtaaataaattttagtggaattttcagagcacaaataataattattaagaaataaacaaagttaaaatgattttataaaaagaaaaaccctaaaatccctccttccctctcttgggccgaatccggcccatctccctccccctctctcctctcccccgcggcccatccggcctctctccgcacgcgcaccgctgacgggcgggcccgcccgccaccctcgctgacgggtggggcccacccgtcatccccttcctcccgccgctcccgccgcctcccccgcgccctagcgccgccgccgccgagaatcccgccgcctcccgccgtccccgcgtgcaataaagtggggggaatcactccccgtgatcccctctccctttccccccccccatttttccctctctctctcgcgttcaaacgggcggatttggccccgcaaatctcgccggcgccattgatggtggccggacctcccgcgccggtttccttcccctccggccgctctctcccccttccaaccctatttaaaccctccccgcgcctccctcgcccgtttccgccccttgccgcaccgtctccctgccggaatcgagctcgcgccgtcgccctctctctcttccgtcgccgacgacctccggccggccttctccgctcgccgggcccgtctcccgccccggcgtcgcttcctccggcttcgccgcacccccgtcgaccccgtccaccccctcacagagtccgccgacccccggaacgctgtcgaccccgtcgacccgagccgcgccgccgccttcctccgctccggccgcctttttcatcgtcgccgtcgacatagggtgagccgtggaccgccgcctctttttccccttcccttcccctctctcggccgccgctccaccgtgcctatggccaccgccggcgaccataggggcgcgggtgccgcctcccgccgcccgcgccgagtggccgccttcgggcgcgccgagtggcccccgcgtggggcccggccgtcagccgcccgcgcccttgggtgcggctgacgcgtggggcccacggcgccggccggtgcgagcccgggtgcgcccggtccaccgtggaccgtgaggctgccgcgtgggccccaatcccgtggacccggtccgcgcgccccctcccctcggctgatgcaataaaccctttttaaattaaaatttaaatgaagaaattcgcaaatattcatttaaagagcatataaacttcaaatggccataacttggccatttgaactcggaattggaccgttcaagtctctaattcttccttaagaagtcaagaacccatttttgtgctttgttcctgcttgttatatggagtttattagagtaaaagcccttttattttccgttggtcgtgtagacgttgcagcttcggaagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggtttcacaactctagactttgggaatggttggattattgtggaatcggattcacacctccccctccattcaaaaccctcaaaatggttttaggctgggctcggggtgcatggttttgatagtagcacctcggccatataaggaccggtcttcaggcctctgttgcaaagcactaccgtacttccacatgtctagtgggtaaggcttagtttgtggctcagtctggttataaacaaaagtacacggatggagatggacaaagtcgggggtcgatggacatctctagggcaaatgaaggctacacgagctgcggcccggtagtcgagatgtcatggcacagggctggtgtcctgctgctaggggctcagtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggaccatgtttacaaagtagctttgagcaactaagtgacttttaatgctgtttactgcaaaccgtaacccccctatattatggctcccttgtactcccttgcatttattctgcacttgtgggtgtgtcttgttgagtacggtgattgtactcagtcttgctcaatttttcccaaacccagaagaggagcccctggatgatgaaggctttggtgtctagctcgtgcctgccgtcaagcgcctgtggtcgtcgccctagtcttccgctgtttcccgtttgtctttgtgtgtgctgggccttcgccgcccatgtaataaagtaactatttacgcttccgcttgataaactctgaaatgtatcagcttttggtgtaccttgcctcctgggacaaggaataatacaagcacgtaaggaacacccgttgggttatttccggtcgtgacatatttctacgccattgctgggaattatatttctagtaatatcgttaagaaataccaacagtggtcggcggtgaactcgccccctcggtccgtgcgtagtgcacaaagcagcttcccgacttgctctcggcggccgcttgtatctgcttgatggcggctggtgcgacgtccttcgacaaaaggagcttgatccacatgaagcggctgtagtcgtcgacgaggagaaggaagtagcggttcccactcggcgtcgctggcgagatcgggctgcagagatcgccatggaggagttgcaggggctcgttagagcgagacagcacgcgttgtggaaacggcgcccgtcgatgcttcccggcgagacacgcctcgcaaacctgatcgacatgcatcaataatggcaatccacgtaccagggtctccctgctcatttttctcagcgcagtaaagttgatgtgcccgaaccgagcgtgccaacgccacgcgttttcgccggggcgcgccgtcaagcaaactggccgcgcgagcttgatgtcaagcacatacaagcgccctgggctccgagggatttgggtgagcaggcgccactgctcgtcgcggacgcgcatgatgccgtcctcaaccaatacttggaagccagttttgtggagttggccgatgctgacaatgttggcagcgagccacggcagaaagtacgtgttggcgagggtgcggtgttctccattcttgcaggtgaacaacaccgtgctgcgcccctcgatagggacgatcgagccatccccgagccgaacgttgccggtgacactagtgtcgaggtcggagaaggccgctcggcaacctgtcatatggtttgacgcgccggagtccatgatccagctgcgcgggtcgcggtctgcttcatcatctaacgcagtgaacaccttcttctcgacgagctcgatgcagacgcactgaggcgccggcgtcgctggtggcggcggtggcggcaacatggagcctgcggtttcgacgcagcctccagtcaggagcatgagcgtgggctcgtcttgggccacatgggcctggtcttcatgcttgggcttgctccggcactccttggcccaatggccgagcttgccacagttacgacatttgtcatccctgtgtgccagtgaggaggtggtgtaatatacccgaaattctaggactcaaaaatttcatgtcaaaataattagaggttaacttctccaattttgagagccaaaaatttccgttttaaacttaggtgatgaccaacttaaaccattgcatgattaaaatttgggagcaaaataaaatcttttcattcccaacattagactagaaatgtcaccaagcatatgagcatacatgtacataatgcatgcctaggctcgagttctttgtgcatttggagttttggtcttgcattccataataggtcccatgagcataatctaaaagaattatttcactaaacatcactaaacaaacctatagttaatcttaggtgataacatgtggacttaatattaaactcaaatatcatcttctcagtctaaaagaagtttaatgtaatccctataataatattagatgcaattatgaagtgggaatacatatacaaacaaaggtcatcctaattctctaaaatattttgtgcaagataaaatcatggaaaaatttatgtagatagtgattagcacaaacttatcctctgtactttttgtcaaatgttaacactcaagttgatacctcaaattaatcagtcaaagcaaacaactaaaagaaatcaaattaaattttaatcggctaaaaccatatttcatccaaaagtacatttacctgcacataagtgaatatgggaaataatttattcgaatactagattatttatcatgaataaatgtaatttttctagaattttcctcctctgtttaagcctcctaaaaattcaatctagctttctaatagcctatctttgtttaatttctgtgagcagtctacccattatttttaagtgcaaccaaagaaaatggaatctagatataaacatctaccaccagtaaaatctacactaattcttctggtccacatattaagatattgagttgcaaacttagggggaagaaataattccgaaaattatccaaaaactaagtctacccaaactcctacccatacctctcttcctagagcctagcttccatcgacttggccccacctggcagcctctccagctcgcccttcctctgtccctcatcctcagccgaccaagaaacacagagggagagatcgagagccgaccgagtcctggacgcgtcgacgcgtggtgacgacgtgtcgacgccttcaagtcactgagtcatgcctccatctcctccagaccgagtcgcccaactccacacatcactctggagctgaagaagccgagggagaggtcctcagcctctccatcatcctcaacctcgctgccggtcgtagtgacgacgaccttcgccaacgccgattgggtcgaggtcatctgtatgtttttcgcgttcccttctctccacacaatgccgaaccatttctcttttgaccacctcccgttttgtgcatcacagccaccgaaacgcgaccacgccgacgacgccctggagcacgcaccggagcgtcgccgcttcaatcatcgttgtcgtctagccatcctcgaccatctcggagcaagccgctgcgccaagaatctcacctcgacctactcttcaaaacgcctcaagaaccccagccgaagacatcaagaacacggagaacgcatcttttcttccccggcgccgatttgaatccgccaccgtcgccatggtcgattccgccttctctggtgagccattgtctgattctttgcacatgaagcatccctgagacctcgctaacaacgtatgacctcatgcatgccagttggattggtagatcaagccgtcgacgtcatcccggagtgaagcgccgtcgccaagccattttcgtgtgctgccgccatcgtccggacctcatcaactccggccaacaccatgttatatacccatgaacctcaaatactcacatgcatgcacccacttaaccaatacatgactgtagatgcacatgcaccatcacccgaaaacaccttccgctcacactcgccatcggcgctactccgatgtcccctaaccaagaaaactagaggaatggaatcgcgagagcttgctcttcattttatcttttgacctcaacctcaaacgagacaccgtttgccgccggatcgagctcagccatcgctagctctgctctgtctagagcagagggatgtctcctttgaattagattaacagcagggatccatttacaattgtagaaacacactgacatatgggcctaggactgcgggttgattcctagaaacctcaagggcctttttgcatattggtccctcacagccatgtggaccccatcctttataatctggagaataattaagaaaatgcccaaacaaatatatgtttaacacaaaaatgcacaaacttgtaaaatccataagaaatcaaatatagcttattttgaagtgattccagtttctgtagatttatgaagttatgaactctattttataaatataaaactttacactcactgtacaaactttgcctctaaaatttatctaagataagtcatgcaaaaagcatatacaaatttgtaaaatgcatagaaaattcatctcaactcattttgaaacaaactcaaattctaaaaattcatcatcatgcactctctgattaggtgaaataaaagtaattacttactttgcatcaagagcctctaaaactattatctttaaaatgactagttttagataagctaaactttagaaaatcatataaaatccaacttagcttcaattttagtaagcttaagttctttagaataataaaaatgtgtattcccaggttatgaaataaaattatatacttactgtgtagtaaaagtctctaaatattcatgtaaggatttaccaacatagagcagcctttaatttgtaagatttgtagaaaattcatttttagtccaaatgaaatgaaccaagtttctatagaaccagaaaatagtgagcttcaacatagtaaaataaaatatgacaccttttgtacaaattatagctttaatctttaaatagataacctaggagttaattgcctagtgatggttaagcaaaatatatgtgtagaagtatttataatgcactctagctatgaataacctaaataaaacttgttagaacagtggagccatagttcctttcccatccactaaaacttagaagaacttagctcataaaataatttctcggttaatataatgtattgttagtctagatcagagcacccctagtttataaagtatgaaccatagtagtaaaaaccttaaacatgtgaactaaaaatattttagttaaccaaattacttcttttattcaacttaaacaggaggtagcatgttctgaacctacaactctagagtcatgcacatataaaacactatacacctataacacgttatagcttgtaaaatgcataaagaattcattataaatccaaaaattgtgaaaccaaatgtgttagtcttagaaaacacatctacacacccctgttaagtctaatctaataaaaatcactttacaaaagtattttgtagcactacctaagactatactactataaaccgacataacttataaaaattcataactcccaaatggaataagataaaatagaaattctttcacctaaattcattttagaccagtaccaacccactgtgcacaaatcatgcattttagagcattttggatttttagttctttcggtgtttaattgcataacatgtatttatctagataattgcataatcggtgaaggagtggattagttgctaacatttctctgatcaaggcaagttttctcctcccatcctttgaacacattgaatccccatgatttgaggaatggaaatgtttgattgcaaagttgcatgtgaacttagactatatcggtatttaaaattgggttaaggtagttatgacctatttgctgcattccctaccttgaataattgattctcttgctgtttgaatccctagaaatgtttagagtacagtctttgtgctcaaatgggtttatatatgctctatgtgcaactacttgcttagccatgcttagaaatatgcaaatgctcattccatctataattaaaatgtgattttgacacatgaacctttgctggaataaaatgaatatgatgggtatttgtgaactaaaatgtgtaaaatgtgattttagacttgggcggcaagtggtgtgcatatgatgttagttgcatgccgatagggggagtgtttgcccaagtcagtaaggaccgaacttgtgtcaccaacttaaagttattcgtacatccacatgtgctagtatgggatggtctaagctgattaatctatttagaactagccttgcattctggtaggccggtgtgtatgagttagtcgataattctgaagaattagtcgatgattcagaggaacttcctatttgccctgacgtggtagtttaggtgactaagtctgtccaatacaacggtattatgccacgtgggtgggttctcgttgtgtccgccaccacggcgttaagtttaaggcgtgggcccgccacttaacggttctagacatatttccaagtatgcctaggatggaggaaaacgtatcgtgctggtgcaaggctagattctatgtagtgtaaaggcttcgttttgacctctagtccgcactcataatgtagagtgtggggtgcttggccggcactgaaccaactagagtgtagcctctgggcttctatcacatcatgtgggtaaaggtatacaaactctgcagagttctttaaactaatcgattagccgtgcttacggtcaagagcgctttggtgaagtgtcgtgagtatagactatgctttaaaatgtgtacatgtgacttggtttaaaattgataaaatgtgttgagttgtgtgagtgtgatgatatattatgacttgttgtcaaggatgacaacaagagtttgattatgatggaattatgatgaacttaatattgaaacttaaaatttgttttgttaattgaagcatcaactcctttacaaaagaattgcgaaacaaaacttgctttatgctgaaattgaattacatgttgccttcctttgaatatatgccttacatgtagtatagtaggattgacttgtgcttgccagtacattaacttgtttaatgtactgactcttgctgttgatataactttttgtttgcaggtttatacttagtctttgagtgatgcgggttccgattgcttcttctaggatgagaacttaatggggtaaacccctagtcggtgtgcttgtgattgggtagtcaagcttccgttgttctctaataagtctatttggccggtcgacctatgtaattattaagttgttgtaagtcttaagtttctttcatcttagttgcgtttgctatgtataatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggtacatctcaggctgaagttgactggcaggctaagggctcagcaatgtctccaatattcctctctcgaggcgtcggatgttttattatgcttttttgatgacttgaattattcacttcatctctcaaatataatggaaggtccgaagagcctacgataggtggacccatccgagctgccgccggtgcacccctttctgccgcggcgcttgttgcgtccgctggaaccggcaccagagcgtttcgcctcctgctccttcttgtggcactccagccattcttcttcggttaggtagagcttgccgtcggtgttctgggaggatggtgggggctggtaatcctcggccgccttgagtctcccggtgatttcctccaaagataaggtagatatatcgagaagagtttcaattgaaagaacgagttggctaaacatcggtcgggcgacgcgcagatacttctcgacaaccttgtcatcgggctcgggatcaccgagggtggcgagttggttgacgacactggtaagccgcatggcgaagtcctccaccgactagccgtcccggaacacgatcctctcgtactccgtacgcacccgctgtgcgctggccttgcggatgcggtcgtcgccgacgcgcattgtcttgatgcagtcccacgcctccttcaccgacgccttcgtcgccaaggtcgagatcatctcgggtggaaccgtgctgcagatcccatcaagtgccatccgatcctcgtgcagctcgacagcagcgcggccacattcgacagcgtcccacaggcaacgtgctcgcaacttgatcttcatgagcaatgcccagtcattgtaattcgtcttcgtgagaaccggatagttcgtagacgatcctgactccttgaccacgcggtgtataaccagcccgcggtcattcccgccgctgcctgaggcacggccgctggaacctccaggagtgcgtgcgctcggcgacaccgaccaacggcacggggagcttgtgacgccttggcataagtgcttcttctagcgcacgatcacgtgtccaagccctaaaccttgctctgataccaattgtcaggaaacccctaatcaattggcttgtgaacactggatgaactcacttgaaagtggaagaacacaagaacacgtagaacacaatactgtagacgaacagacagcagaaacagagtttttggtgctgcctgaattgcttgcagcttttcggggtttttttctctccttttattgtgcagaactgaaacatgcaaagtgacgccaaaatactcggatcgctacccatgactcgcggcttgatcacgtccatccccgcgtccacacgttgaggctcatgcgctgacaatgcacaaaacagaatccnnnnnnnnnnnnnnnnnnnnnnnnnnnnnnnnnnnnnnnnnctctggtaggaatttatattaaacgaggatcttcaaagtttattatttgggaaaataaaacatccggagtttaagtcaaacttagaacgggatcatagcagctcttattactctctcatatcttgtaacaacctagacttagttcagcaagtgcagcccacttacctcaggttcccggataatatgtggctactttttttcaatctttgagagagtactctagcgtgaacccatataaaagagatataaaacagagcaactattcatcatttcaacaagaaaactcagtttcttacctagcatgataaaatctaacctatatttttagtattttctattttgcaaatttttatgttgtttttgttttataagatgcaatgtggaaatttaaatatgtagtttggaaagggaaatatgcaatgtgatacaagttacctcagtgggggaagagacatctacctncccaacnnnnnnnnnnnnnnnnnnnnnnnnnnnnnnnnnnnnnnnnncgaaggtcgcgtcatttaaagtccgacgtgcaagaccgtatctcctttcgattcagttcatggattttccacccgtctccggaggtaatggggcgggcgtctttggcttttccttccacaccttctttgatttcggtgtggaagacggcttcttctgagctgactgctctaacttcttggcggtataggtgattttaccggcgtcctccaataacgattcctgggcattgttgtttccttctccaggaagttctgcataaaccttaccaggctatccgtcttgggtggctccactttgacctcttgaatattctgcgggttcggcccatacttgattctaaccatggagcattgttccgtccttggttgaaactcaaacttctcctccttcccgttgatatggagacggatactccccgttcccacgtcaatgttggctcctacggtgctaaggaacggtcggcccaggatgagcggcttctccttccctgtgtccatgtccagcaccacaaagtcaaccgggatgaagaaatcccgtatcttgactggcacatcctncgctatccctgccgggtaacggactgatgagttagccagttggaggcgcatcggtgttggtgtcaacacccgtgaagttgagttgtcgaagacgtcttttggcatgacgctgacgctggcttcaaagtcgcacaaggccttgtcgaattgt

SEQ ID NO: 5368 - DNA, 543 bp, Oryza sativa
aatacctctctgggcaagctttgttggacaacaattgctttgagcagttcttatcaagcctgctcattttgtgcaaatacccattcgcagaacagcaggcattagctactgactggatggtcgtcgtgaccactattctgctgccaatatccttatcagtcggaaaagccgatttgatgcttttccactgatcttctgtttgaatgtcatcgataacaatgaagtacctgcaagacgaggcagatcaagaaagaataattgtaaacatccccatctggagccacagtaatcaacaaattgaaacgaataatttgtataatttcatacggtagagcaatttagaagcagtgaattgttttttccatttttattctattatagtaaatttgtaaaagataaagcgcatgagaaatgcactgtatgcatttgatgactaaattagtgcagctaacacctagcagttagcaagatatagtatctgttcatgattcactttgctattgaaagtgtcagtcgcactgaacttgtgcaaaagaacaggcg

SEQ ID NO: 5369 - DNA, 797 bp, Oryza sativa
  unsure (1)..(797): unsure at all n locations
agggtcatctggatctagtggaccatgactattagggggccaggcctgatcatggttagaaatttcggactgaaatttctgaaaattcgctcatttcggacccctctgatatgatattattctggccgaaattttttacttttttaaatttttcatgatttaggtaatatttgttcaaatttaactaaattttgttcgaaatttcggtatatcggtgaccttcgatcaaatcagctaaaccaaaaaagtaaaccctaggctgacgtctcgcactttgttaccactagaactacggatgttgacaacaagagtagaaagaggaagtggaagctgctttggatctagacagcccagtgacaaggacggcgagcttggttgggtgatctcgaggcatcgacaacattaaggaggaggtggaaagctccactatgggaacacaatatgtgcggtagcggtggagttggagcaagaggtgaggccatggcaaagagggcaagtgcgagagggtcagtaagcagcagggtacgagcaagagagaaggtgagcagtttggtagacggggaacaaagatacgtcttccgtgaagatagacagatagaccttacaatatatcactgatattgcaaccgtcccagacgtggggccaaaacgatgatcctacttttgtgatggttcattttcctcttcaatccatatcttattttagacaagtattatatatcagttggggcagcgnnnnnnnnnnnnnnnnnnnnnnnnnnnnnnnnnnnnnnnnnnnnnnnnnnnnnnnnnnnnnn

SEQ ID NO: 5370 - DNA, 18128 bp, Oryza sativa
aaaaccactagacactttttgacaggagattttcttgaattgtgagaaatcgataaacagagttaggctttgtcgcaccttttggaggaaagtttgatcgacgtgttccttacagtgggtgcaaagattctccaagatctcggctgatattgtcctgtgtctggtgttgtacttggcatcaagcattccaatgagacgatcaacgatgtcattatgctccctcacgatgaacttagagatagcttcactctttgatgataagattgacagtgtttccccagctgtagctttgatggtcttgttcatcttcttcttcttcttgataggtataggggctctcagcttcttcttcttcctcttcttgatgggattggttgcagcaggaggaactggtggtagttgtatttcatcttcccctccattagcgaggaggaaggtctgcaattgcttcctgacgaggttttctctggtttccaaggtgatgtcgagagaagaatccaaaacaagttcagtgaagatctccatggttcgcacctgctgctcctctgttcccagatcaagaatactttgcaggttggtgaccgcctgtttatttgaggagatctcgtggcgcagccttgttccaggagcggcatgggttatgaggtggtgcaccaccttgagcgagctgtttgctatgttggcccacggctcgctcctgccgatgtcttggatgagcgtggcagagtagagcggcacggtgatcttgtcgaggaggcccggagcggcgcggatgtccgtgcaattgtgtgggtcgcaggtgagcccctcgagaatcctgagtccctgcaggatcagctcgttgcagcctacttgttcttcttcttcttccctgccatcgttctcgttttgtcgcatgccaacacctggcttcttcctctcacgccgccgctgcttcctctcacgccgcttcttctccatttctgcttttctacgagcccattcccgatctcttctttcagatggtaagagctgatcatcgtcgcgctgattattgttccagagtggctggacggttgtttcgagcaatgatgacacggaccggattgctccagggaagtgcgcaagctggatgccgccggcgagatgcgccacaatcctcgcggcgaggactctcatctctttgttgttgttgccatctgattctgactctgatgatcctgttcctgtttgtgtgctccccagcttatctacgagtatctgtatcttggtcttggagcgaagaataatgctactcgcatcttccccggccgtgatgagcctgtctaggatccttgctccccagaggcattcttcctgcgactcagattccagcagccctgctgcgtagctgagaaaggtccttttctcagcaagaggagcagggtcccgcacgcatttcttccgggtgtactgaaggtattttctaactgacctcatgcgccactcttctgggaacttgcattgcttggagaaattaacggcgaggctgatctcgcaaatgagaagacatatcaagaagcagtagagcacacactggcacagaaccaggacgtagaagaagtccagtcctggcgtcaggttcgctaagctgctcgcttcaccagtaataatggaggaggatgaggatttgtcccaatggccctggtaatcacggtgcctcaggcgccatgacgagaggccgatgcacacgataggaccaaaaaagttgaataggagtagaatattgaacatcggaaggactgggcttgctagtattgcagtaaatgcgtgagcaatcgccccctccccaacacgaatgtatgagggcaacaatggcaacgtcaacaagtcggaggcagtaacgagtaccatatttcttatgttccaaacgctgactgtcaggatgtcctgcgactgcaactcgttgaagatgctgtgggatggacaaacagagtaatgttaatgatatgcacgtcccagagaaagtcatagtatagacgattgcatcacacactgtattcgtaaatcttagtatgcacatgcgcgtgcatcccgttgtaaagctatgaatatttctttttacatgacttttatatatgatattatactgttacattttttaacttatgatcttatactttgagttaactatggggaattattctaaactctcaaataattatgaaaacttttgaaacaattcagcaagatagaataaccaagatcagcgctgagagaaattatgttgcttgagatgcattctacaggtgtcaatcggcacgcgcgagatgtacaagtctgcatagagagcctcctccttatctcttcccacacgagcacacgcggttagagtggagcgggtgacgacacgcccgcgcccccccccccccctcttccagcaaactggccccatggagaagaggggatgtagttgagcgacggcgatgtccgtccagtgagttccctcctcctctaccccccctcctccaccgttccgctgctcggcctcgccaacaccaaaaggcgtcaacgtgctaacgtggccacgccaaccggtctccttcccttcccctttgccccgctttgcctccgccacctacactggattacctcccactgctggcaccggggttttggcggcaccaccactccacctcaccggcaccaaaaacatcaacttgtcagcgtgacccagctggcctcctccccctccccctccccttcgcctcactttgcctccactgccaacactagcctaccccccgttgctgaccccatggcttcggcgatgccaccgccgcctcgccgtgtgccctagtccgtcacccaccaccggtttgctgcctcccatgtcatccctctaagcccgatcacccactcccccttcccatagcgctaccctttccccaccctaccctcaaaaccttaatcctagcttgtcgccatgtggtcgaaaaccgcacacaacttctctccctggcgcttctaataagtattctactccctttgttctcttatatatgacgttggttacaaaatacaagaaaaccccacgaaaatcgctcctaggcctattcgacgactggcgccaattttcagtagctgccaccccacaacactctgtactagccgagccactgccattaagcacttccctgccagatcagcccaatcgacagtggccacagtgccctcttcgtgtcgaatgtattgcgacaatcccagatgagctcccggtcctccacgcctttgccattcttttatcttgaacataatcctgcccatgccccttccaccatgcgtcaccacttcctgtgttggatccggctggctgacggccaaaacctcgggatttggacggttgatgccttgatggtatgcatttcctctctcaagttagttctgatggataagttggagaggaggaagaatggcaacggggctgcacccgccgggttgtagcatcccgtccccgtccccggagtggaaaaaatctcccgtctccatccccatccccgcactcgggtggagattttcccccgtccccgtccccatgggggtgatagccaccccccgggttcctcacccccgacgacggcagcaagaagacacagcagcagaggaggcgacaatggcatctaaacaccggcaacggcgtgcagcaggcgctcgcgcgagctcgtggcttggcgacggcaacaacggcgtgcacgcggcgccccactcgaacccgcggctttggaggcggcgatggcagctcatcgtggacgcgctgcgacgcggcacggaggcaacagcagtgcagcatcactgcagcttggcttggaggcggcggcgatgtggcgtggtcgactgccgcggcttggtggcgcccctggccttggtcaacgagaggacgagtggtccgtgctgttgtttgtgcctagggtttagttggtatatatgcacctacgaatgggcctcaagtgggcttttaatttctttatggttgtgggcttttaacatagacatgtgcacatggacctaactacacaggccccatggggattcggggacggggagctaaggaatgtccccgcccccgctccacccgacggggggcaatttttgtctgataacaaccccatgggggatgatatggtctcatttgaagcccctaatagaggttttccccgtcggggatcggagagagtgacgaatgagcaagagggattggggcaggacaggatacccccaccgtcttgccttcattctcacgcaagataagcagaaggccagacaaccgcaacagacctacagcctcatcttttcgcttttgcttatgcttatcagccaaaatttgaatttcaaccttaaatttaaagttgattttaaagttttttcatcaaaatttatttttcagcatttgcttttagatcgttaagaacgcatatataaaagttttatttacaaactatttttcgtttacaaatataccgtttggctagcacagtcgtgccagcttccttgctgatgctgacgcccacaggtgcgcgcatgggcagctgatgcgtctgcgcttgcacgtgtcgaggcccattgggaaaggtgtttatgtttttttttgtttgtttgaattattttgattgtattttagaagtccacctacatcatgaatctttcaacccaaattttaaaacattctattgaatctttaaaaaaaataagagaataactttcaactcaaaatttcaaaattttaaacttccattccgaacttagaaacttttaagtcgaatttaaaaaatctcatctcaaaatttaaaacactgaactcaactttttaaaaactttcaactcaaaattaaaaaacttccaactcaaacttcaaaacttttttacttagatttaaagaactttcaacgcaaaattcaaaactttcaactcaaaattaaaaatctttctactaaaattcaaaaactttcaagtcaaaatgtaaaagctttcaactacaaatttaacaccgtcaagtatttttaaaaacttttgaactacattatttatgtattgcattttttaaaaaaataatactaaatacgtactatcaatagcgcgtactaatagtcgtagtgggtatatatactttagagtagcggtgggcacggctgcactacttaccaggacaacagagtgagagatggtgagttggtgactgtcgtgtttctagtgtgagcaaaactcaaggccatttttttcctggttgcggttgtatttctcttctcaatgaaattaggtaaaacttctgcttatgttcaaacttaagaacttttacgatatatttactaccaatataataatggcaatttaggattttaaaaaattatgtatttggcagcgtcacccgcctggacttgttgtggctaccggtgcctccccatgaagaacactgactaggaatgagtaaatagtaatactctctccttttataattatattataagtcgtttgaattttttttctaattaaacttctatttgtttgaccaaatttatagagaaatatagtatgttttcaacaaaaaaacaaaaatattatcaaaatatattcaatgttagatttaatgaaactaatttgatattttaaatgttattaatttttctataaacttggtcaaacttaaaaaagtttaaatagaagaaaagttaaactagggagtagtttggattgctcgggggaaaacgtcttgcgttgtttcaatatatgctatgattttaccgattgccaccaccaaatagtgtagaaagaaaattaacccttttaatatgtaatctacttaagtaaaggggcaagaacacatcaatctaaatacttcagttacttatactaacagtactccttataagtttaaaaaaaaaaagtgtgtaaggctgtcagttgtgccctcgtattccatataatctttttttagacaccatataatcttttaagagagaaggaaaagcagtggggtaggtatatttttagagtaattttactacttcatccttttaagttcaaacaaggtacctaaaactttacgctcatacctcgagttacatacctattaaatatggaaattatccgtacttttactagtgctagcaaattctagtggcaagggcgcgctgaaaagatggaaaattaattgacaaacctggttgcctgtacaacagtaattgctgtcaagcacgcgaaatcctttctttgcagcgagctgacgtagccaccaaggaggactaccgtcgaccacgtgaacgcaaggtacgccatgaacgtgaagaccattctgatgtacacctgcacggcgaggttacgattgatactcacttccagctcggcgcggttctcctgtcgtcggtcggactccgactcggactcgccgccggcaatcatcgtaccctccaccagctatgcttcgcttcaatatggggcgaagctgcagcaggccacacataccatatatatagtacttcgtccgtttcacaatgtaagtcatttttagtatttctcatattcatattgatgttaacgaatctagataaatgcatatgtttagattcattaacatcaatatgaatgtagaaaatggtagaatgacttatattgtgaaacggagggaatacttctctcttttttttaatatatgatgtcgttgatttttttagatatctttaaccattcatcttattaaaaatattactacatatgttttataatataagaagttttagagttggacacagtaattaagaaagtagataggctaggttgcagtgacctaaatagcaccctaaggttctgagttcaaatctctataggagcgaatttcagattgagttatttgaggactaaattccctgtttgataagctaagttcccaatttaaaaatgttgtatatatccggttggatgtagaggccgggtaaaaaatacccttatctaaaaaaaaaagaaatatgtgggaaaaatgaatggtggatggttgtgacttgtgattggttgggaaaaggaatgttggtagagaagttgttatattttaggataaattctgaatgctaaaaattattatatattgggacagatggagtatataattattatttattttataatgatttgatttattatcaaatgatctttaggcatgacgtaaatatttttatatttacacaaagtttttaaataaaacaaataattaagcatttgttaaaaagtcaataacatcgaatgtctggaagaggcgacgctagcaattcttcttgttaggtttagcgctagctgttactggccacttggctatatagtccatggaatcatcgtcaataaattagccccaccagtttatcgaagtgcagataataataaactgggactgtcacgaaaggtcacggacgatcctattcttcgtgtggaatcaggggaacgatggcggctgggcgatccagccaaataagccagcggggtcatcacgtagtacgtactaccttccatttcaaaattaattagcttctttttatacacgaattgtcgaatttgcatataaaccagttcagttttgtaatatataaatgaatttattttagcacgaaaaagtactaaacaatattcctattttggagtcttatgtccagagagttttaacaatgaaagttaatttgtcacaggtaaacggggtctgcagggcggatccagatcactaccaccggggtcagatgaccccgatgacgtttatcaatccatcagccaaaagctcgttgatgattgaccccgccagcagctccaatgatttaatgcaccccactcccttgaaactacgttcaattcggttcaaaatatagcagctaagtacaacatgaaatatttatagtatgataaatttggaaaaaaaaatgtccgtacggatggagatagtactatataacaatgtgtgtgttcaaattttgagaaacgtatattcatacctcatgggatactgggatatacacttgttgttgcatgtcacttgcatgtcacttaaaaagttataaaaaaagtaagatagatcaatatgtgttactccacaaacttgtactctctcggttccataaaaaacgaatctagaactagatatgacatactctaatactacgaatttatatgttcagatttatagtattacgatgtgtcacatcggattctaggttgatttttatgggatagagaaagtaggttcaattcaacctgtacaaatagaaacaaaaacaataaatttaactatgaataaaacgcataagtcatactcaaatttgttagggacaactttgtttttgccctcactttcatctcaatattgattttgcccatatttttttaaggttttctttttgcccccactttttttgaaccgaacaatccgtttacccctttttagatggagcagttaacggtgttaactttttatcaaaaggatatttatacacccttccatctttattcattaattgtgattttacacctagcccaaactcgaaggcggctagcttgctggcactgccctacttcttccctggggcaaaattgggggcaaagtgatgtctaaattgggggcaaaatcacaattaataaataaagatggaagagggtatacatgtccttttgacaaaaagttaacactgttaactgcttcatccaaaacaagggcaatgtgggggcaaaaatgaaaaccctaaaaagtaggggtaaaatcaatattggagatgaaagtgagggcagaaatgaaattggcccaatttattacaattacttctaattgcataagttaaatttaaacttgcatatttatcaaatgatatatcacatattgatctatcttatcaagttttttttttgataacttttttaagtaacatgcataaaacgacggatatctcttgaagagacaaaaatccatgtccccaactctgttgtagaataaagtaagttgtacatctattttatcatctcaaccgattatgactatctctatgtcaacttttctatctcaaccaatccaaacaatctcctatttatttctatttattttttaatccagcactactacacatattaaattttcttactaaatttatagtagcaattatctcaactgtttaatttaagttgaagaaagttataaaaaattatagatacacgtttcctttttaatcaactcttaaaatctccgagagctctccaccgccatcgcctgctcccatagacgacggtgcctaccctccacgcgaggtcgggcattggtcgagcagtgtcgtcattgcatcatcctaccggcccgaggtcacctccgcatccaccgctcatatcaaggctgccgggtcgctcagttttgcggcttaagctcggcatatgcgctactagagtgcgcatctcggtccaccaatcatggttcacccaagtcacattggacctgctccagcataggtctaaccgaagccacaactttaggtcttgagcctacacaacccataagattagtcggaccgtccacaccttttaagtcatgctccccatcattaattaccgatgtggaactaaactcaataatgtcccccatcacacatcgggcccaacaatctctcccattacatcaacccatgtgaccccgaagacttgttacctggcctcaggcccaacatctaccggtcatatcgatccatgtgaccccgaagactttttactcggcctccccaccatgtaacccatgaaaattgttccgggtttcaaaccttagactctgataccacttgttagagtgtgcagctcggcccaccaaccgtgggccatccaggtcacattgggtctgctgtaccacttgcccaacaagagccacaactttaggttatgggcctacacaacccaaaagactagtctgatgggtgaagaccgcttccaccttttaagtcatcctcccccatcattaattaccgattgtcagctttgcccaaggatacgaacggagcagcaaactcacgcaagcagcgaactcaagcgatgacacacgcaagagtagcaaattgtagtggacacacacgatagatcgacaatggcgacgcacacgcactaagcttttctctctatggctcaatggagatgaacacagggaagctttgcggcaacaaatctctttatctgtgactcacacacacaaacacagaatttacatggagcttataaggcccaggcgacgacgtgagttacacgccgagcaacgtcctgatggccgagtctcacgcacatatacgctcacacgatctatacatgcatagccaccgactactgcatgccatgctccacgatccgcatgagacagctaacaaccctgaggaatcgcaccaactaatccatgcaagacacacacacaaactaattatgcactaacaaattagttagtctaccatgcaaacacaaacacgtacttcacgttgctgcctatacacaacacatgcaattaaggatatatcaagcctactagtcaagattaatactaacacatacgagttgtgagactaaacaggtccactaaaaattagtgcatccaaagttaaggtgtttcgatttaagctaatatgttctgatatattttgtgtctgtagattccttttcaaatttcactctgtctgcttgaatctgctagacctattctaacgcgacgcgcgacgatgactgccacgacgacgacggtgccgatgccttggtctaaccgccggctgcgacgacgcagcctggatccgccgccggctcgcaacgggcacgccgatccactaccggctggtctcaggtagggaaagggaggcgacggctgcgcggcggcgaaaaggtgaggcggcggctcggctcctccctctttcggcgacgggcatatatatatatagttgcagcgacgtaagtagcaccccaaagtcttgagttcaaatctttataggagcaaattttatattggattatataagggtgtatgttcttaatttaaaagtaggcctggtaaaaatatacccttctctaaataaaaaaaaaaggcccaaacccttagcaaccaggccttaattagcggagtcgcagactcgcttgttaaaaaatatacccttctcggagtcgcagactcgcttgtaatttggcaacgtttgcgatcttaattagcggagggaaagcttaggagacgactacggatcggacatctgatgcgattgttttcgtcggacgtctgttctactgttggatccacatccatccctttatgtccatctgattaaaaaaaactattacatacgtatgcagagaagagcaacaacaagaaaagtttaaccgtgcatgctcagtaccaaatgagagaggtacatggatagtgacaagcttcaaactattttttctcgaaaactatttatccaatttacaatttgattacactgttgtattcgttataattaaatctatataacaagatatcacatcattatattctgagaaaaaaatacaaatgtttcaaccgttgaacttggatgtttcacgtgtgagaaataaatgtttcaattggaatttgactatgttgcacattttaagttctatattgtagtagatctttataaatattacacgtgatattatttagatgtttcactagttcaatgtaaatgttgcaccggtgttttttttagtgtttcaataaataggtgtagtgttgcaacacttataactcgatgtttcatatatagaataaaaatgtttcaattaggatttaacagtgttttattctttttatttattttttaccaaaatataatcaactaagatcttattgtaaagatttaattgcaacggatataattctgtaatcggattgtagatttaataaatatttttaggagaaaactagtttaaagctactaatgcatgcatagcttttttttacatacatacacacatatattagagtgaagtactaaggagaaaagtaagagagagagaaatgtgcaaccctgcagtaggctgagagaaaaaaaaataagacaacagctagacatatagtatgtaggtcgtgagcagatcatgtctgattttgtttggtgcgtcggacgtccgacggcaagcattttctgaaagcttaggccatgtacaggggtccaagctcaggccttgggtttcactgatcgatcggcaaattagctaacgaatcatagagaacaagttttttagtctttccaaaccctttcaacaagaataactaaaaccccctgagcgagggtttagacaagttgatccgctatcgccgtatttgttcctattgtgtgctgaaggtttctctgccttacacaatttgccacaaagcaccaagttcgtggatattcaatgcaggctcgagcttggctcgtagtcatgaattggaagttcgaatcgagctgaattcgagcagctatcaaacctcgagcttttttgtcaggcctacatggcattatgaggaaaaaaaaggcttattcttggtgagatcggcctcatagagtgttatgtgatgagagccagcgcacaagttatagagaggcagcctcaacaagaatttctgcattggcttctgaaatctgaagaagtattggagagaatttggaagatgaagtgtctaaacagaattgaacattttgtacgtaggttggctcacaacttattgaatagtttcacattagttgtggaagggcaaataatttaagatataagtaggggagccccttacttcaatggctagcttttggggtgggaaaggccctttacgatcctacaattggtatcaaagtctggctaggttaacatctctggtccgatgaacacaatgtgtgaaggcctgatggactgtgggtgcctgcggggcccgtatacctgatggaccatgggccagtggggcccggatacggtgaaggggctgagggataccaatgtgtgaagggggagattgttgaatagtcctacattggttgaggaagggcaaatgacttagttgtggaagggcaaaggacctaagatataagtgggggagcccctcacctaggaatcctaattggcgccgcgccggcgccggcccacatagcccaataggtggatttttccacgtatgtgcaaactttcaacccagatttgaatactttcaactccgacttgaaaactttcaactccgatttgaaaacattcaacttcgacttgaaaactttcaactcatatttgaaaactttcaactcagatttcaaaattttcaactcgagattcaaaaactttcaactcagattcgaaaactttcaactcgagatttgaagactttcaaatcggattcgaaaactttcaactcgagatttgaaaactttcaagaacagatttgaaattttttaagttaagatttgaaaaaacatgaaaactttcgactcagatttaaaaactttcaactcgagatttgaaaactttcgacttcgacttgaaaactttcaactcatatttgaaaactttcaactcagatttaaaaattttcaactcgagattcaaaaactttcaactcggattcgaaaactttcaactcgagatttgaaaactttcaagtacagatttgaaatttttttaagttaagatttgaaaaaatatgaaaactttcgactcagatttaaaaactttcaactcggattcgaaaactttcgactcgagatttgaaaactttcaactcaatttcgaaaactttcaactcgagatttgaatactttcaaatcaaatttaaaaattttcaagttaagatttaaaaactttcaactcaaaatattttttaaaaaataagtgtgctaaagattaaaaaaagtaatcagaaaaaaagaaaaaatcgcaaaaaaaaacgaaagaaaaaaaaatcatgaataaaagaaaaaatcgcgatgggctttgtgggccagggggcagctcgcgagcgcgccagttagcaacacccccctcacctcaatagctagcttttagggtgggaaaggccctttacgatcctacacaactcgctagctttgtgttgcaatctgaagagaaggggaattaaacgttgatactcagtgttttatacgcagaataatggacgaggatggtggccatctgttcttttagtgcaagtacataaaagcacgtttggctggacatgttctaggaggaggtcagacaggaattggcctcaaagagaacagatatagaagtgatggagagcgtacttaagctagatttatcgctacaattgaaggtggtgtttttattctactactggtggtgtgaaagaaagttttccttatttgcttccaattaaaaagtaggtctatgatcaataccgatcaactagagtgacacatcagtagagtcaagcttaacttcattcaagctcaattacaatagattgaagctcaattacaaactagcaaacattgccaggtcccccataagagaacacgccatctctaacatcagtgacagggtaacaatctgatacgtgtgctagatcatggtcaattggatgggcgttgccagctgcatcaaagaatttgagattactaaatgaggcagcatttttgggtggagcaatcccactgcccatcggagggctcggtttatgttctttccagaaggcaaagcccccaaacacaatgttcaccggcttatttgacaaggatgtaaagagagatctcggatagtatcctataatcttggccttcccatcaaaaccaaagtagatttcccagtcaccagagttttgatcctagaatcatgtgtaattgtattgttatgtcagatatatacacgcagaattgtaatcattgatgagtgaatgatttctccattgttggacaaaataatgaatggtaccttggatactctgacagtaatgtattgtttccttctagaggtgctggaaacagggttaatcacctgtccaggaacgaatgggtgcgagccacctgtcctttggaatccaggacagcgcatatctaaacaacctttcttggattcttcaacctagcattggagtagtcatgacatgataaatgtaaaatctatatgatagttcagtctccatctgaccattgcaaattctttttaggatatggcactccctgtctctctcatgggaattaacttaaagaaaaaaaaataatatgtcgaataaagaactgtattgttaatgaagaaacttacaaaccaacttgtagtgaagtgcgtctgtgaatcgttgtatgattcaggatcgacctatatgaggtacaacaaaattaaacataaaaactagatgaaatgaagtaattgattaatttcattattagctctacttcacaaggattttgactgtatgtttaaacttgtttatgtcagtattagagaagtaaagaagaaaaggtaattcaaaaacatggagataaagttcaacttacattccatccagcatgaattacatttgcagctgttgtttcatctgaattataaatctatatgaaacctctggtttgttgcccgtgctctagattaaatccataaacatccatagtagcctctaatacataatactcagtagcaccgtcgtctggaggaatccatccatgtactgcaagctgccaacgtatttggtcatgaaaatcgtaatcatgtcagcagatgcatctttcagaattagaagacaaaaaaaaaacattgggttgggcactcacatattttgcgctagattgatttgattcatgactcgatttagataagtttgcatgaagtatgggggccatcaatgctctccaattcttttgaaccttgttaattgtgttcaggaaaagcagaatgaacaatatcaactatggctgccactactagtacattttacattaaactcaatcaaatttgaatcataattaaagacagtataaagttgtagatgtacttcctcaacagtagggaagcatcctcctattgttgaaccagtaagaaacaacacaaagaacagtgcatatccagaaaaaactttctccatggtggaattggggagtggaaaagatattgtgttctgtgtgccttttgatacacgtgttcctacatatcctctttatatagacgaatcagaaggggcctgcaaactcattaaatcagaaatcaaaactaaatatttaattcgaagagaaatcaaaaccatatctttcattcaatgaatattaatgaatatatatttatattgcaatgaatgagaagtgcatcaatagaagatatcttcaaccaacttaataaataaaatagatacaaagtgtatcaaacctaattattattttgtctgtacagggttaaaggagagatactgttcaagtccatttatgtacctagatcagttcttttgtaattgacctgaaatatcattgtggtcagattagcattgctcaggttaaaaggatggtgaaaattaatacttttccttatgaaaagtgagtcgcctttggtactggactctccaaggcgccatgtataacctgctaatgagggggaaagtggccgtagaatcgttcttggcagccagccaaacaggagatgctcactgagagctccgccgttgaggagtccaaagctccatattcatctcctgtggctgctcatcgtcttgtacgggtcgtcagcagttagtgggaggagatgggcaatggtggcagataaaaattgggtctgaaaacgagttaggcccagtgtattgagccttaaaataggcctcaagtaaattataagaacacaattcatcacaaataatgctttgccacatcagagcatacctcattattggatcgatctggcacagcaataaggtactggttcagtagaaaccggcacctattataaattataagtaccggttaagagcacaaatcaaagctatagaagtatatgtagttgcactctgcacttcgagcatcgcacgtgacgaggccgccgtcgccactcctgaccgctttgcaaaggtggttgaagcatggcagcttagagaaggaggacgacttgttggggtagtaggatcaggggcggagctagagtattgagggggtgcccaggaatctggtcaagaaaaatagttatacctatctattttcactatatgtatcccctcgatacaaatttagacactcgtagcttaaacttgatataaagcagagtaaattaaacaagtggcacggcgattccaagggctaggctccatcaagctctagcataccctccgatttttgcaaaatattttttttaagaattatacagtacaacgcagacactcacaacgcacgcgcactcacccctatgaacacacgcacgcaaaccctacccctatgagcatcttcgaagactgggccagcaaattctggatagattgacgaagtcactacaggcgcctcgctgtcgacgggtacgtcgcctaccactgaaagcacaacgccgttaaatcctggaaaattcattcccatggggagtcgaacccaggacctcgggtgctactaagtctcttgtaaccactattttcaactagatagctaaaccatggcgtgatagcagcgtttttcctgggaagaagatgaacaggcggcggcgcagcgcctaggagtcgagagaaaagaccaccgaaggaatgaagcggtacgcacgtgttaacagtgaaatttggtaagcccagagtagtcatcggcttagagtcaacatcggctttgaagtcctgagattagccgatgagagttgtcaagtcgtcagttgtcggattcgtgctatattcggttaaggaaattgatctactaaaggaagcttatccgaagggaccgagttcaaatagaatgcggcatgacaagttatctattaattaggaatagcttgttagtttccttttatctttaggaaagtgtgtttagtgtcctataaggactttatcttttccttttatctttaggaaggtttctttcttgtccgacaaggacttgtatcaacccatgggtataaatatgtacacccggggtctatgtaatctatcgctacgatcaatacaattcggtgcatcggccctttttaccctttataatttattt

SEQ ID NO: 5371 - DNA, 18319 bp, Oryza sativa
  unsure (1)..(18319): unsure at all n locations
ctctgctaatctagtcttagcatatcaatttagctctatcggctgcttcttgttttagggtttctactagtatcggctaaatcgcgttgctagattagattagcttagatatctaccaccctgaaaactcagtcaacggcttaattgtctagatattattttttttcatacttagtgctgtatcagttaagtttgatctactaagtcgtgcttataaccataatctctagcctacatcttgattgccaataagggtttcattagggtttcagccggtgagttatctggacgttgcatcagctcataaggattgcatatacatataagttggatttatccgatgacaacaaaggtttcactgtttaatctaatcttgtggatttcatgacatcggacctccagccgatgtgtgctttaaccttcggatcgatgcttatttatcacatcattgctagtcgattggtttatactagattatattgttattttattacatcatcatcaaccgattgcctttatattattatctacattggacatatagccgattgcttaaaccctatcgatatcggctggtatcggcatcggctattatcgctatcatctggaactactccatcggcttgtcagccgattggctgttttgatctactatttgcatatcttgtcaactgcaggatcaaactaactggcacgcccgcatcttaccaagatttcgacctgcacaggagctaagcagatctcctaggccagtgtgttcgaatttttcgtcaacacaaattggcacgcctggtgggacatgagttttgcacctaacaagtctgaagaagaagtcaattccaagaaggggcaatctactaagccgatattttaagattaagttgatgaagcagctcattgcaccttgattgaacagtctgaagttttggtggttacattgtaaattttgatcaagagaacagttgatgagttaattgttcagagacaccagctcgggggcagattgaagagcaataacaatatcggctcggggggggggcaagcacatcagtatcggctcatgaaagccgattgcaagaagcaacagaggatcaattttggagtaatcaacgcgagacagaagataattttgaagcatgagtcctcatactccaaaattggggggcatgtgtgaacagtgaaatttggtaagcccagagtagtcatcggcttagagtcagcatcggctttgaagtcctgagattagccgatgagagttgtcaagtcgtcagttgtcggattcgtgctatattcggttaaggaaattgatctactaaaggaagcttatccagaagggaccgagttcaaatagaatgcggcatgacaagttatctattaattaggaatagcttgttagtttccttttatctttaggaaagtgtgtttagtgtcctataaggactttatcttttccttttatctttaggaaggtttctttcttgtccgacaaggacttgtatcaacccatgggtataaatatgtacacccggggtctatgtaatctatcgctacgatcaatacaattcggcgcatcgccaccttttaccttttctactttattttatcgtccggtgggacttggcacctgatgcggagctgcatcggtgttcgatctccggctaagggataagtccaatgttccgctggcccaagcaattctatcgtttacgtcggcgtcgttcaaggctgcatcagtacattcgacctcttggattgctttggtttggatgatatatttgcctacctatttatcatatgtctctgttaatctagtcttagcacatcaatttagctttatcggctccttctcgttttagggtttctgcctgtatcggctaaatcgcgttactagattagattagcttagacatctaccaccctgaaaactcagtcaacgacttgattgtctagatattatgtttcttttcatacttagtgctgcatcagttaagtttgatctactaagtcgtgcttataaccctaatctctagcatgcttcttgattgccaataagggttttatcggggtttcagccggtgagttatctggacgttgcatcggctcataaggattgcatatacatataagttggatttagccgatgacaacaaaggtttcactatttaatctaatcttgtggatttcatgacatcggacctctagtcgatgtgtgctttaaccttcgaatcggtgcttatttatcacatcattgctagccgattggtttatactggattatattgttattttattacatcatcatcagccgatttcctttatattattatctacattggacatatagccgattgcttaaaccctatcgatatcagctggtatcggcatctgctattatcgctatcggctggaactactccatcgacttgtcagtcgatcggctgttttgatctactatttgcatatttgtcagttgcaggagcaaactgactgggatgcgagccgcatctcaccaagatttggacctgcacaggagctaagcagatctcccaggccagtgtgttcgattttacgtcaacagcacgaaaaagaattattaggccgaaatgcccaattttgtgggctcgtggcctatgtcctcctcccagacttcactgactcggtcaccccaagtccacagccaccagaggcgaagcccccaaatccccctccccccaccctagcacggcgacggcgtgactggcgggcggcggaggcggcattgcgggcttgcggcagtgttgcagtcgaaactcctaatgggcgatcaatcgctgggctacaggagtagcgatcgatttctctttcctttctaatccaaacgcgtgcgtccgccacttaccttttttggctttctcagcctagtccttttttctttcctattgggcttggcccacgagagcccatccgcagccacattactttcctattttagtaaatttatgcatctaaagtctgtacacctcaagtttacacatttaaagtttatacacctaaagtttagagacccaaagtttataagtcaaaattttatatatccgattcaaatttgaatttgaattcaaatatttttatatatagtatttctataaatctaaagtttatacacctaaagtttatagacccaaagtttataagtcaaaagtttatatattcgattcaaatttgaatttgaattcatatattttttatatatagtatttctatacatctaaagtttatacacctaaagtttataaacccaaactttaaaagtcaaaagtttatataccctattcaaatttaaacttttgacttataaacttgggtgaatagctaatttagtccctcaagtttcaccgaaggctcaatttagtccttcacgtttcattttgtccacatagctcctttaaatatttgctttggcttgaaatcatccttgggcccacttaatatgccttatggctatttctagtcaatatttctattagaaaatatcccttttgcccttaatttgtatacaactatgaaaccaagatgaataaacaacattacaaatatactttccattatttcaacatgtgcacatgaaacttaagcaattgctatcgtatacacttgctagtacataatttattttttgttttatataatttactatgcattatctatataaaaaattcaagcatgcaatttttctcttatatatgtgaatgataagggggtataagtgtcatttatcaagagaattgttggttattgataagtttgaactaaaataaaaacttgaaggactaatatgcatagattgaaatattagagagtagagtaaactgagcctcaaataaaacttggaggaccaccttagctattcaccctataaactttgggtctataacctaatatttgaattcaaattcaaatttgaatcgggtatgtaaacttttggctatataaactattagctattcacccaagtttataagtcaaaagtttaaatttgaatagggtatataaacttttgacttttaaactttgggtttataaactttaggtgtataaactttagatgtatagaaatactatatataaaaaatatttgaattcaaattcaaatttgaatctaatatataaacttttgacttataaactttggtctataaattttagatttataaactttagatgtatagaaatactatatataaaaaatatttgaattcaaatttaaatttgaatcaaatataattcaaattcaaatttgaatcgggtatgtaaacttttgacttataaactttgggtctataaactttaggtgcattaactttagatgtatagacatactatatataaaaaaatatttgaattcaaattcaaatttgaatcggatatataaacttttgatttataaactttgggtctctaaactttagatgtgtaaaattaaagtatacaaactttaggtatataaatttactaaaatatgaaagtaatacggtgctttaaaaaaaaaagaaagagaggagggaggaaaacgcgtgaaggcgcaagtgggtccttccctgatcgctcgccgcatgcgccagcgatcaatcgcgcaatagtggccccccacggcgtgggcaggccgtaggacgcaggcagcgatgcgaccgtgcgctgtagacggtagacccatagtgccgagtgggcgagcagagtagacgagcagcagcaaagtcagcaactagcagagcaagctccaaatgcaaaggcagccaagccgtgagtcctcactccatgttttattcttttttatttcagcagcaatagctagaatgctagttgatgagatttacaagaattgagcttcattgtctcatagatttgatttattcatagattagtagctatggagaagaaaacaacattgttaaattattttaaaatgattcaagtggcacccttccaactgatgagaatataaatcagccagaaaggtttggagatcatttcaatggaattcgttcgataaatttgattggttgaatatagtgtggaaaatgatctcttaatattcttagatggttgatgcaaatatgcaatcactcacttcctagtggcaatgtacttttttttatggtttctttttcaatcatatatgtgtgaataactaccttaatgtggtttttttaatcatatatgtgtgaataactaccttaatgctttgaagttgagcctatcctttattcctatcctggattcgccattggggttactgacgtgtgggcctaatctttatgggtctcacataacagtggtaaagtccctctgactttacgtgagaggagactcatccctcgtagacggtgaccagcaactcagcaagaaccggagaacacgaggctgcgctcggaggcccaataaggtggcgaccaatatatctggtagtagatcggtatgggcggcgaaacatataggtgtaggaataagttcatcataggtcccttaacttgtcaacgaatccgattttcatccctcaaccgaaaaaccaaatataacgaatccctcaactatcaaaaccggtgcagattgggtccctcggcggttttgagggtggttttggctgacgtggcgtctacatggctgatttgactcggtcttcatctgacgtggcattgacgtgtcgcctacgtggacccacgtgtctgtttcacacacaaattaattaaaaatggtggagtccacatgggccccacatgtcatcctcacccctcccctcctctccttcctcctctcttccccatatcccctctcttcatcccactctcctctcctctctctccaggtgacggagaggcagcggcacacacggcggctcccggtcgtcgctggccgacttgcgcagcggcgccggaagcaggaggaggtggcggccgcgacgccaactgcgacacgctcgtgccgtccttcgtgcgcactgacggctgcggccgtggcgaccactccccgccggtccacacgttcggcttcggcaaggaccacgacgcggtggcgatgcacaccatcgccgaggtcaccggcgggacgttctccttcattgagaacgaggcggccatccaggacgggttcgcgcagtgcatcggtggcctcctctccgtcgccgtgcaggagctccacttcgacgccgagacatggagaggaccggacagaccacgagcgtggccggcgacgaggaggcggagtccggcgtcgccgagcgctccgtggaggtggaccgggagctggtccgggtggaagccatcgacgacatcgcgctggagtagggattagttatcgttttttctgtttcggtagtagaagagatcgagcagggatcggattgtgggatggcacggttagtcgttgatccggcaagatcgcacatgtaacaacctcctgtgtggagaagaataaaaggaagaagagaactcagaaaagctgcgcagttttgcagcaccaaaacgttgttcttctctggttttctacattgtcgtttttcgtcagacactgttcatcattctgaaaccgtcagacaagctaggatagccactgaaatcgcgtgtgtttgctgatagctccgtcgtggtctccttcatgcagcggccggtgggaagctaccaccatgtcacctgccacgacggcttcaaggtgctccacctgccgtagaaggcggcaacgagcgacgacacccacaacgacctctagctccgacgccgtgggcaggagttcgacgatgatctcgggttcacgctgtgcaatgattactactcgccgccgccgaagttggtggacttcgtcgccgaccatccgttcatctccttctagctactccacgccacgaccccttcccgtgcggccgctcctcggcgctgctgcgaccggccgcctcgccgcgcgacgccctgcgaagacgatggattgcgacctctcctcgacgatgaagccctgcaagggcgaggagctcgcccgccaccgctcctcctctgctccgccagcccgcttcgcccgctcgtccacgcctcgccgccgaggtgctgtcctgctcgtcggcctccacgcgcgctcgtaggcctccctccgtcgcctgtagagaaaggagaggagagagtgatgaagagaggggagatggggagagatgaggaagaagaggaggggtgaggataaaatgtggggcccacgtgggccccaccattttttattaaatttgtgtgtgaaactgacacgtgggtcccatgggttttattattatttttggatcgaattgccatgtaggcgccacgtcaatgccacgtcagatgaagaccgagtcaaattggccacgtaggcaccacgtgagccaaaaccaccctcaaaaccgccgagggatctaatctgcactagttttgatagttaagggagatattgtatctggtttttctgttgagggacgaaaatcggattcgttgacaaattaagggaactcagatgaacttattcctataggcgtatagccaatatttggtgggccacaagggttagcgctgaatgtggcccatgtaaattaagccagaatggaacaattaggaataagttcaccggaggtccctcaacttaatagcgagatttttttaagatcccttaaccataaaaccagaaatgtgaacccctaaactctcacaaaccattcactggaggtccctcggcagtatttttacccggttttgctgacgtggcatcctagtcagtaaaaaaaaagtacgtgggatccacatgtcagctgcacatcttgttttcttgtcttttcttacccttctcttctctccggcggatgcgggaggctggcagcgagcgagcgcggcagcggtctgcgagtggcaggcggaccggtggcgggcagagcggtggagggcgagcacagcagctgccggccgcctttcccctcccccatctggccatatcccgtcgaccacctctccctctcccatcctctccacgtacgcgtcgcgccggcgggagagggggtggagcgccgcatcgtcggccgcgtgtcgtgaggaagaaggcggcggccggcggcggaggtggaggtggaggtggagggaagggcgtggtggcgacgacgacggcgccgacctgctcgtctgcttcccagcgaggcagcacctggcgctgatgcccaagccgatctgcagcccgtcgaggaccaccgtggacaaggcggtggccgcgcggcggtggcggcaacagcagctcccggcggcgcgctccggagcctccttgaacagggagccagatgtaccagtcgacgtacacgtgaggcctccttgaagggcgcgccgtacgcgccattaacgacgcactggacgaacacgtgaggcctcatgtcgcggttgttgttgagcaccacatctctggggctcgggctgtccctgtccatgaccacgctctcgtcctgcaggttgttcaagccgtggaggcagttcaccacgagcacctcttcttcttctcggtcaaggtggaggtcctcgcggcggaccgtctcctactttgcggcaatggcgcggaacttgaatggcacaccgaactggcgcgcgcgcgcagatgctcagccggcggcctgtctcctcgatctggtcggctggccggaagcccggctgcgggacgtcgatgccggtcatcctcacctccggtggtccgccttccctggttcccagcaaaaagaacaaagctggccactggaatccgtagctgaggccgtagtcgacgatgtgcagcttgcgcttcccggcgacggcgttgtagatggtcttgttggagaagatcagaagatgacgctcaccttcttgacgcagcaggccgccgtgaacagcttgtacgccttgaggaagtccaccgtcgatgtgcgcttcgcaacgagcgactggtacatctggctccccgttccggcgagacgcgcctcgagcgtgttctccaagtggctcatggtgctggaagggagcgaagagacacgacacgccggcctcatctccgccctctccggccagcaccagctgctgccgcgccaccgccgccgcccctccgcctgttcctcctgagcctggagccgccactcacccgccgccgccgccgccgttctgccgccgcgctcaccgcagtcgcactcacgaaccgccgctcgcccgccgcgccccgctcagccttccggacccctatgcgccaaagaaaaaagcaattaagaatatcagtgctgactaggattattgacctaacattttttttgtcacttacacgtgggccccacatatttattttttatttttttctaactaggatgccacgtcagcaaaaccgggcaaaaatactgccgagggacctccagtgaacggtttgtgagagtttaggggtacacatttcttttttttttttgaacgactcgcatgagacagtgcgaagttctattgatagagcaggaaaaaaatacaagattacaaccctgaagagtcgtaaccaggtaaaggaaaaaatataccaccacccacacgccgacatcgccaacacacacgaccaggagaaggttagcaccggatcggccgccgctaagcgtgaccgaccgccactagaccaacaaagggcaccgacgagattgcccctgcgaagccacgactgatgcaccgatgctccaccaccacacaagctttgccgacatgtgggacccctgcaccggcgtccctcgccggccagccttcgtgcgccgaagaccgcgccacacctaccggcagctcctcctcacacctaggtcgcctcctccaccgccggccgcgcctttctgcgccaagccggtctcctctaccggacgcgcctctcacgctaatccggcctccctccattggccgcgcctctcgcgccgagccagcctccgctgccattggctgcgcttctctgcgccaagccggtctccgacccctccaccaaacggtgccgcgctggtcggatgcggcagtctcccacgccctcggctagtcaaccgaggccgccatgcctccggtgaccgcgaacacagtcaccaccaccacagccgttgctgccgaacacccagccaccttgncgtcatcattcccaccttgcacccgactccttccccgccgccgacgttgccaccgtcttcagagtcacagtcgccgtcggcgttgtcaccgacgccaaccaccggcttcacaaaaccgtcactgtgccgtcgccctccaccatcaagcagcttggatgcccacgccatggcttccaccgccattgccagttgacacggcagccaccatgttgccgtcgacccactaccgccgccgcggccatcaccacacagccgccgtcgtcgccaactgccgccggcatccagatccggccgagaccgtcgccaactgccgccggccgtcatcgtcgtcgtcgccaactgccgccgccgtcgtcgccacactgtcgccgccgttgccaactgcctccaccctccagatctggctgagaggggcggatctggggggcaccgccgccgtcgccgccaggtttcgcgctgtcgccgccacgggagcaccaccgccgccttcgcgccatcggccaactctgtccccgacgccatcgccatccccgccgccttcagccaccgccgcccagcgtcgcgcgcccttagcatcgccgtcgccctccccgccgccttcagccaccgcagcccagcgtcgcgcgcccttagcatcgacgtcgccatccccgccgtcttcagccaccgccaccctcgccgccgccagccgccgtcccaccagatccagccggagcgggccggatctagcggtcaccgccgctctgcctagggcggccccctgcccgcccggaagagaggatgcgagaagccccgccgccgccgtccttgcggccggccggctttgccggcggcctctcgggcggcggccgctcgggtggcggcaaggtggagggggaggaggggagggagaggggcggccgggtcgccgcctcccgtgccgcccccagggaggacgacgcgagagcttctcaacagaagaactgaagatgggggtacatatttctgattttatggttaagagatcttagaaaaatctcgctgtcaaattaagggacctccggtgaacttattccaatggaattaccgtgaatttgttgcccatagcatagatttggtggtcgagcaacttatcgatgctgcgcgtgtgtctgctgcgtattcaacatggtatacgatcgatacatttccttcttattttttctcaaaaaatactaagatacattattgttctttcaaccttatattattggccttcatatgccgctagcctctcttttcaatggagacatgctagcatggtggacagcttgcaggagagagatggtgaaagaacagagaagaaattttgacggcctcttcatctacacagtttggggcatttggcttcaaagaaatgctagaatcttcaagggtgcttatggcacagtggtgcaagtcgttgagtcaataatcgacatgtgcaaggcctatgatggagctcacaatttagatgagtagttctcgcatcctcctgctagttgctctgcactatataaaaattcctgtcaactcctctgtcaacacctcggaaggggtccccatgggatcctttgtaaccgtacagactcggtttccctctcttctccttttatgaaataggcagagctcctgcttttacctaaaaaaaaaaaaaacttcaaccacaactgcagaagcataatacaagaaagatgcgtatgccaaatatttagtgatctcatttgatgatttaggctctattgtgctcctaggttagttattactcagaatttttactttcaacccaaccgcccccagtcccaattgcactactctcttatatatacaaaagtacatgaattaattaccagcagtactaagtaatgaactacattggcgcttacaacaaataaatcaacacaggactagctttcctgttttttttttcccctcaaacaaagaaatgttgtgtaataatcgcctcggcattcaaatctagtctttggtcagccacagccgctgctgatcctgatcctccaacaccaccatcagctttgtcatcgcgacctgcctccacggcagggtgttctatcacatcgggtttgatgagttcatctgcctggaccagctgggcggctgctggggctattgtgccatcgcaggaagcacggtcgtccaggacaagagcgctgtgagctgcacatagaccagaccttccccgagcaattctatcacacttgtcctcgccaccaccaacgcttgattcccctcctcgccatgagcacagagtatcatctgcacctcctgatccaccgtgcgtcttgcagaaatcggtgcttcgccttgtgctcttggtgcagcccagaaacttacatctcttgccggctccgtggcgtacacagtgtgcactcggcccccatgccatcttggtgcagcctggaaatgagcaggccattttcatgcgatgcttctcgcagagcatggtgactccgtctgcggttcctgtgcatcctggagacttgcaatttttacctgaactcacgtgagtgatggtggctccagagcgagattctgcactcctggacgacttcttatgggtctcagtctcaccctttttgccgcctccatgcttgctgcagaagtcagttttccggcgtgcaaaccggaaacaaccctcgtgcatgcagcggcgactaatatgagctaagcagaagtctgtgtgctcttcggcgctctttgtacagccaggatagtagcacctcttgcctccgccatgggccctgcagaagatggtttttcctccggctttctcctcgcagccttgtttcttgcatttcccgctaccacttgcacccgccacacttccaccactggattttacagtgttagctgcgagcatttctgaagcatcgcttactaccgaagcgcacagggaatgcgaggagctttccttctgatccgacccatctacacatcttggaaactgactggattctgcatcaactgcgcacttttcagggtttcttactcccaataacaacgaaagtgaagagctttctttctgatccgacacatctatacatcctgggaactggttggattctgtatcaactacgcactttccggggtttcttactcccaataacaacgaaagtgaagagctttccgtctgatccgacacatctatacatcctgggaactgactggattctgtatcaactgcgcactttccagggtttcttactcccaaggacaatgaaagtgaagagttttctttctgatccgacacatctatacatcctgggaactgactggattctgtatcaactgcgcactttccagggtttcttactcccaaggacaatgaaagtgaagagttttctttctgatccgacacatctatacatcctgggaactgactggattctgtatcaactgcgcactttccagggtttcttactcccaaggacaatgaaagtgaagagttttctttctgatccgacacatctacacatcccgggaactgactaaattctgttttagtaaatatgaacttttcaaggctacttactcctggagcagacaaggaaagtgaagagctttctgtctgatccaaaatttggggttcccagttactgcaaagcatcaagaaattaatcttcaatcaaaagttaaagcacgatataaataaaactttacaggagacaataaaagagaggtaattaataaggctttgcacttaattcatctttagataaccgagtcaattattttatagttgacttaagtgtataacccaaatggcaaatgacatttgcaaacgaaaagtaatttgtgaataaaatttttatatacatgttcttagcgatctaaaagcaaaggttgaaaaataaacttcgataaaaaaaatcccaaaatcagctccaaatttaaggttaaaaattggtttattgtgcaattagtttcactgaaacagtctttcagccgaggaatagcatgagcttccaggataagctatatgtgttataatttgacagtcataaacaggagagtccatctgatgacttctagcttctcttgctaacttgtcagacaaacatttcacttctcttgggatccaaacaactcttcaagatttctgcaaaattaaatctcgcatttgacttacgattggtctaagactctaggatcttcttgaggatttatagttcttgcatatacaaggccactctcaacgttccataataccatagaaattaataatcttgttattgtatcagaaatctttcttcatactaatttgaagctctcatatagaagtgtccacattattattatcctactccatacattttttttactccctccttccaaaagtctaagtcctatttcattctttggttttccaaaagtctaagtcctatttgtaggcactatgtgctatattaattttttttatcgaaactcaagaagtcattttagtacttattggttgcatgttcattggttttgtcacataatgaatgagtagacgagaaattacctagcatttccttcattaagagaagaagtaagcaattctcacattaatataaataaaatcatatgcatccttatattctatggccaaaatattcaccacacaacaattactgaattcaaaataaataaatgctatttagttgtaattggctttagagtctttactttattttttgatgatttcataattcaaaatctgaattaatacgtaccaaattatttatactccatttggagttcgaattaaatcattatctttatttaataaatctaaatttaggaattaataaaatttagtactcccttaggttccataattgttgatgttttgaacaataatatggttttcaaaacatatcttaactataattttctattataatatatgcaataaataaataaatacttacttttattatagtaccttttaagaccaatttatacatgttattctattatctccaaacttaatattttgagacttattgatagccaaagttctaaagtttgaccataaccttgtctaaaacgtcaagaattatgaaaccagagggaacagtaaattaataaattttgaaatacatagtctcagtatcaattagtttttcagcgaattaataattgtaaaattcaaatatagtaatgccaagtagtgctcagtttgaaatctcaattataatatttccatgatttagtaaattataaaataaaaattaataaataccaagttggcttataatatttccacgatttagtaaattataaaataaaaattaataaataccaagttggctagagcttttcacttgcacgtgaaacggggcaagacattagtgtatcactatttgagtattaactattacaaaattaaaagattaatttatttgattttttaaagaaacttttataagtaaactaggaaggaagtcagtgcagatgcacgggcaattcattttttgtttcgatgacatgcgcctaatttgaatacaattcaaaatagcatatatttttacaacttaaagcatagttaatatgttttttgattattagtttggttttccatctaatctaaatgagaagaaaaaaaaaaaggatgtaggacccgacgcgtgtatgtaccgtaaatacatacattttttcttaaggtggaatacctacgtatctacatgcatgtatattgtccggtagtggcatgacgacgtgagatgttcggatgtttttttttcttataatttctatgattaactagagcgccacatagaggtttagaagcgtttatagggtactatgtgatggattagaagcgtttgtaggaagtttatcctcttgattactttttctccctttttctctttatgaaaatatttgcaacaataaattttaaataaccacaaccttctaaattatgtatatttatttgtaacaatatattttagatcatcataatttttacttttaaatcatatatattttagatcatcataatttttacttttaaatcatgcgttcatttcttttatctatttggacaattagaatttatgacgtatgttttctacttcactcgtaaaatgtatattcttctaagttctatttattatcctttgcatgtcattcaaacatatatgaaaaattataaaaagaaagtgactatgtattatgtcatcctgtaccacttcacaggcattccttaataaaatagaaagtgatatattgttagatcgactttttaaagcctcaccaataagaagaatgcctgtgtgctaaaaacatatattttttcctgtagtgcaactgaaatcatatatgtttacatcatgtattttttattctacattttttaccatatttgtggatgaataaattttgtttttctacaatagaaaacactattttaaaacccatctattttttctacccacgtacatatatttttctgatcttatagcttttcttttttacttgcatatataagtccgtattttttttaaagtaaacagtaccttttaatagttttctatcgtacatacgtacgtttttttaaatgaacagtaccaaaagttttttttttcaactgtgcgtacgtacgtcagatttttccttctttttccattgtgcgtaggtaactaggattttctggtataaacagttcactcgtatacacatgatatgatatcaagaggaagcaaagagatctaacctaatggtctagataatgggttcaccaatttaaatgaaaatcgacggtgagattataaatgccacgtggcaacctaagagcgtttataggaacaccacgtggcggtttagaagcgtttgtaggaagattaatggacatttagtatataatagatagatagatgtactgtttagcggcctgaaaacatgctcgctaaaaatgagggagtaggtaagcccttaagctattcagaactatgccttagttgttcaactttgcagtacatgcagatgaatgttggacttggatgtttaatagataataatgtgttaaaaattaaagaaaggttgagtaagcaattgtgttgcacgagatattgctcaaacgcagaacataagaacatagatatatattgtgaccctgcttgagggagctagagattattgatccttagagtagatgcgggcatgcggctagtaaaatttcagctccctcaagcagtggaaatgctctctagattatgtgaccaagtagttgtagaattcataaatgaactagcagacagaagctagattactcacaaggtgcttgtcagcaacaactcctcaccagagcgcctatattaagggaatgcaatgtcaacacaatttataagaaaaaaaattaattatgagaaggaagaagaaatgtcatcaacaccgaaaacaatgctaagaaaaatgagtaattgtgaaaaacgaaagaaagtgagaggtaggaccccactaattcacagtaagcaataataataagaatgttaatagaatcaatttagatcgttcatattttataatctaatacatcatatctatctatgctatcgcctcaactattggttgcaaaataaaattttctattaacagtagaaattataaatcaactattaagattatttttgctgatgataatattaataatagagtactactaccagtagggaccaccgtaaactttatactatgtattttgcacgccagatcggatttaaacgcattcagtaatatctctaccttttaataggttgaaaaaagaagtatgaacaggaaataattatttctataggttgaaaaaagaagtaggaacaggaaataattatttctctattactgaatgttctattagagaaaagaaaaagacccttactcttcatcaacaccaccaactcttcgtatattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5372 - DNA, 598 bp, Oryza sativa
ccgattgatttatcgtttgtgttgatgtcgattctcctccactttattgtcattctctgcaaaatggttagtaaacctaatactagtggaatattattgttctatcatatttatgcattggaagcatcactagttctctcctattttagtaatattgacggtcgaaactgattgataacgaccgtcaacagccacttcaacgagtactgcgccgagctcggactgcgtcgagaactcacggcgccgtattcgccacagcagaacggcgtcgtcgagcaccggaatcaatcggtggtgggcacgacgaggagcatgttaaaggcaaaagggctcccaggtatgttctggggagaggcagtaaatacggcagtctatttgctgaataggtcgtcgtcgaagagcattggcggaaaaactccatacgagctatggaacggcggtgcgccggcggttcatcatcttcgtacatttgggtgtgtgggacatgtgaagaacaccatgccaaatgtgaagaaactcgatgacaggaggtaacacatgattttcgtgggctacaagctaggatcaaaggcgtaccgggcctaccaccccgtgacgc

SEQ ID NO: 5373 - DNA, 730 bp, Oryza sativa
  unsure (1)..(730): unsure at all n locations
actataggcgaattcgagctcggtaccctcagaaagacctattattcatttggatattaaacctagcaacatactattggatgacaacatggtgccaaaaattgcagattttggtctatcaaggctcttgggtgaagaacaaaccagagtttgcacacaaaatgtcatgggagcaatgtaagtcaccaaacacattccaatgtctattgttttgtagttttcctacaaggtgaatttcatttgcattagtcacataatcctccaactattgatgctgatattatacagaggatacatggcaccggaatatttatatcgaggtgaaatctccactcaatcagatatatacagtttaggtcttctaattatcgagatcacaacaggggagaaaaacttccccaatagagaggacatcattgctaagaacttcattgagaatgtaaggcaaaaataatgactgtaccagttttagaacaaatttactgttttcatactaaggagttcttttagaataatgttatatataagtttgtgtgctgtcgttgtttataggtacgccgaaatcggaccaatattgtgcatatatcactgaagtacccatcgttagacacaaattgcctccagcaggtaaagacatgcattgaaattggactgagnnnnnnnnnnnnnnnnnnnnnnnnnnnnnnnnnnnnnnnnnnnnnnnnnnnnnnnnnnnnnnnnnnnnnnnnnn

SEQ ID NO: 5374 - DNA, 802 bp, Oryza sativa
agttctcttctttctcggggataatttgatcacctggcagtctcagaagcaaaaggtcgtcgctctgttgtccagtgaagcggagtacattgcggcgacgactgctgcgtgccacagtgtgtgtggctggcgcgtctccttgttgagctcaggggagaagaagggagcgccgtcacattgaaggttgacaaccagtctgcaattctgcttagtgttaacgaccaaatttggtaatccaaggatcagagaagaagaagaaactgagatggaattcgagatggaaatcgtcccgcaaacagagtgaagatcggctgaagtccgaatcggctgtggctagatcggcagggttcgagtcggactaggttagccgattgagccgaatccgacaatatgacatagcatatgttgtcggtttaggttgatgtgcttcatgatgattgccacgcatggatagagtcctgagaaggaaattgtatctattaattatgatattttatgtaattttcttagagatatgtttgggcaaaagtctgccgcaaagacttatggtatcttagagtttgttagagataagagtcgtgtccgatatggtcatattttgtaattctagggtataaatagaccccgagccccatgtaatcaaactaacagacgttcaatacaatctcggcgcatcgccaccttttcactttcattttgtttcgacgagtttttgcttttgggttgagctgcatcggttttgatcttcaacaagagataaaacttgttatggcggcttgcgttctcagtattagtgattcca

SEQ ID NO: 5375 - DNA, 476 bp, Oryza sativa
ctaggaatcctaattggcgccgcgccggcgccggcccacatagcccaataggtggatttttccacgtatgtgcaaactttcaacccagatttgaatactttcaactccgacttgaaaactttcaactccgatttgaaaacattcaacttcgacttgaaaactttcaactcatatttgaaaactttcaactcagatttcaaaattttcaactcgagattcaaaaactttcaactcagattcgaaaactttcaactcgagatttgaagactttcaaatcggattcgaaaactttcaactcgagatttgaaaactttcaagaacagatttgaaattttttaagttaagatttgaaaaaacatgaaaactttcgactcagatttaaaaactttcaactcgagatttgaaaactttcgacttcgacttgaaaactttcaactcatatttgaaaactttcaactcagatttaaaaattttca

SEQ ID NO: 5376 - DNA, 601 bp, Oryza sativa
gagagataattatccatcattgttcatcgtttggaagcgtatccttctactgtgtttttgaccaatttcacatgaaaatttacatcatatttcattccatcgacgggtcgacgatgtgtccggcgaagacgaccgcacttgacatctcctccactatgaagtaggcgaacggatgttcggcgacgaagtccaccggcggcggcggcacaccggaaggaagcatccttgtcatggtggcggcggcagccacggttccttcctcgttcacctcgatcaccgccttgtgctggatgtcgccgacgaacaacggccagccggagccgtcgtcctccaccatgtcggacaggtcggcgagctccggcgaaaacggcagccggaggcccagctgctcgagggcgccgacgacgctgccgccgcatgacaccttgaacttgggcacccgaaactcgccgacgggcactggccacgccgccggcatgtgctcgtgcaggaaccccggccgcgacgccatcctctccaccaggccgcgcagcccgtcgcgcgcgttcgggaggaagatggccatggcgtaccgcgtgaactcgccgccgacatcgccgcc

SEQ ID NO: 5377 - DNA, 12812 bp, Oryza sativa
  unsure (1)..(12812): unsure at all n locations
acggaaaatgggtgcctcttacctcagcgatgagctcctgaagggatggatcgcataggtgcgaatgctggcgtaccgtgttgaggatgtattggacagctttttctaccattctattcaattcaagaaagataagttcctgaataagattgttaagggatcacactatgctgttgtttttaatgcaattgctgatgagttggttcagatagagaaggatattgagcatgtttcaaagttgaaggacatgtgggtttaccctgtcagtcagcttattcctactcaagtcaccatctctgaacaccgatttcctcagtacagttttccccgactaatgaaagatgaggatcttgtggggatggagaataacagacaacacttaaagcaattattcagtcatggaatttcagctctcagggtgatatctgtgtggggtatgggtggcatggggaagaccacattggtccttaatgtatatgagcaacataaggagaaatttgacattaatgtgtggcttactgtgtctcaagcattttctgtggaggctttgctgaggaagctattatgggagataaggcgtagatgtgagctcacaacaccaggtgatggtgatagtgtcaacaaggagcagcaggcttcagatgagactgacaaactggaggtttcacaattgaaagaactgaaggatgagttaaagaaagcattaatgcgaaagagatttatggttgtacttgatgatgtatgggaccgtcaagtatttgacatgatgcatgatgtgtttgaggattttaggaatggaagtcgcgttgtgatcaccacaaggagaggggatgtggctgctcttgctcacgagggttgccacctcaaacttaatccgttagaattgaacgatgccctccttctgttcagtaaaaaggcatttcctaatagcaatgaccttgagtgccccttaaagctcaaggacctagccacagacattgctaagaaaagcaatgactcatcactgacagagtgccgattggagctaaatgggctagctactgatattgcagagaaatgcaactgtttgcctttggcaaatagcccagcacaggttcaagagctagttgcttatattgtaaagaactgccaggacttattacagatggaaaataatccatctgggcttcagaagcttgctactgatattttaaagaaatgtgagctcttgcctttggtgaaatgctcagcagagttgcagaagctcgccattgagattgtaaagaaatgtgggggcttgccgcttgcaattgcttcagtaggcagcttgctgtctgcaaggatgcaaatagagtgtgtgtggaagcagattcatgatcagcttccatgtgagctggagaaggatgatcaggtccgaggagttctaactctgagctactatgacttgcctggagagctcagaaattgctttctgtactgcagcatgttcccagaagattacctcttgtcaagggaggttcttgtgagacagtggattgcggaaggttttgtggaaaagaaaggggacagcactctggaggaggtggcagagggatatctcatggagctggttcatcgaaacatgcttcaactcgtgtataatgatgagcttggcagggttagtacatgcagcatgcatgacattctgagagagctggctctttctatctccaaagcagagttgtttggcaccgcaaacaattttagtgagatggcacagatgaacacaaatgtgcgtcgcctgtcagcatgtcgatggacacacacagaacatgatttatcaaagataaaattcccacatcttcgaaccgtaattgcactccagtcaagtatggattttgtaccatcaatattatctgaatctaagcaccttactgtccttgagctgcaagactcaggaatcaaccaagtcccagcatcgataggggatctttttaacttacggtacattggcctaaggaacacagcagtaaaatctctaccggactctatagagaagctcgtgaatcttcaaactcttgatgctaagtcaaccaagatagaaaaattacctagtgggatagtgaagctctataagttaagacacttgctgattgacagattaagtgatggtacaagaacggaattccggtatttcgaaggagtggtagcaccaaaagggttatcgaggttggaagaactgcagacacttgagactgtagaagctagcaaggacttgggggaacatcttgaaaaaatgatccaattaagaaatctctggatcggcaatataaaagctgggcactgtgcacagctgcttgcttcattgtctaagatgccgcttctttatagcttgcttctgtgtgcaagtgatgaggaggagaaacttaacatcgaaaaactcgtaccgacatccacaatgctccaaaagctaattatcagaggatgcaccagtgagagcacacttgagtgcccggtgtttcaggaccatggacgacgcctgaagtatctagctctaagccggtgtcaccttgggcatgatgcatttgagaggctcgaaaagtgtgtgccgaacctgacatatttgagtcttaacaaggtgcataccaatggtgcacacactttggttcttcctgcaaagtcgtttccgctgctgaagacactcgtcttgaggaacatgtccaatgtcaatcttctgaaaattggagctgacgcccttaaatgtatcgaaggtttatacattgtgtcattgtcaaatctaaagagcgtccctgaaggcattgaatcccttagctcccttaagaaactcacccttctaggcttgcacaatgacttcaaagctgagtggaacaagaaacgaatgcacgagaagatgaaacatgtcactaagcttcgtgtgtacgagtggtcctaattcagtatagtcctgcatggatctgaagaacatgaagctgcatgctgcacaactggtgaatccgtgattgcaggttttctcagatatctatatttttttggatactgtagttctgtaattgcataatgctttaaatcctgttaataagtcctggaacaatggtattttgccatccggaagattattcaagttctgtatttttctgttttcttggaagctggttttcttgtaagaaatggcacatatcagcccagctttatttgcaagtagtgtaaggattctctccatttccatcgtttttaggcatgttgcaatgtggtgtgttgtgatcctgtaaaatttctggtaggcagatcttccattgcatttgtctgtatatctatggtatctacttttctctctgatcaggctataattcatacatatatgagagataatttggaaaaagaaacatacgtatatgagagataattatccatcattgttcatcgtttggaagcgtatccttctactgtgtttttgaccaatttcacatgaaaatttacatcatatttcattccatcgacgggtcgacgatgtgtccggcgaagacgaccgcacttgacatctcctccactatgaagtaggcgaacggatgttcggcgacgaagtccaccggcggcggcggcacaccggaaggaagcatccttgtcatggtggcggcggcagccacggttccttcctcgttcacctcgatcaccgccttgtgctggatgtcgccgacgaacaacggccagccggagccgtcgtcctccaccatgtcggacaggtcggcgagctccggcgaaaacggcagccggaggcccagctgctcgagggcgccgacgacgctgccgccgcatgacaccttgaacttgggcacccgaaactcgccgacgggcactggccacgccgccggcatgtgctcgtgcaggaaccccggccgcgacgccatcctctccacgaggccgcgcagcccgtcgcgcgcgtcggggaggaagatggccatggcgtaccgcgtgaactcgccgccgacatcgccgccgccgccgcgcttgcgcttgtcgcggaggagtcgcggcgatcggtagcggagcttgagcaccttgaagccgtcgtgcacggcgacgcgctggtaggaacggctcgacatgtagggcacgtcggcgacggcggcggcggcggcggcgccgtcgtggcggtagaacggcttcctctccgtgtcgctctcattgaagggacgatcccacttgcccttgaagtagatggcgttgccgagcacgacggcggtctccgggccgacggatctcggcggtaggacgtcggtgatgagcttccccgtcgcccgccgcgcccacgcgttgatctgcttcctcgcttcctctgccttctcagaaaccaaatcaagaacacattgatcgatcatggatggatcaagtaaaagaataaatgcatcgatgagtatgctataaccaaccttgttcttgaagtcgacgacggtggcctcggcgttgtactcggcgctnacgacggcgcggtagctgggcttgaacgggcgcgcggcgtcgcaccatacgccgggcgcgaacacgacgcgcggcccgagggactccgggcccctgtcggcgagcgcagtctcggccgtgcgtccgacgaacgccgccaggtcatcgcgcgacgccgcgccgagcacggcgaggatctcgtcgagggtgccgccgcccgcgccggcggcggcgagggaaagctctgcgtgtacggagagcggcgagaaggccaggttgcggccggggctcgcggcgccgaggcggtcggcgaggcggacggccagcgccgtcaggccgccggagatggcccgatggcgatgacgtcgcgccgcctcgccgtcatccatgcgaactgctgcctcgtcgatcgcgggaaaagaggaagggaggtttaaaagtcggcagatcgaattcgtatctctctatttttttatgagaagtaatataaagaaaatcgattcaaactagaaaacctacaaaaccgccggccatgcggaaattttctttgtataagcccggcatatattgcaaagtagtagtgcgatagggaaaaaaacagacgcttgttatagttaagtgaaaattggattgctcttttgcatgcttgtatagttgtacgggtaaagtgttacttcgagaatgctcaaaatcaggcgcccgatgcggcgaaaaaaatcgggcgccacccatgctcgcctccgcctcgcctcccacacgcccccaccacgtgtccccaccatttgcgccctttgcaacaatcgtctggatataacggaaacgtcctgttagggggatttgtttcattttttgttccatcaacaatgtttcagctagtgtactcgtgatgtttcactatgtatggatgaaatgttgcagcggatttttgatactgtttcataatttcatcttaatggacacgttgtttgttcatgtacacagggtgtaagtgttgcaatggctttaaaatcgtttgttgcatacgtttgaaccaaattgtttcatccagtgatcttactgtgtttcacttttttttaagaagtgaaacattctttcgctatttgctgaaacattgtttttatatagggtgaaataatacccgattttttggaaaccgttgtttcatacattgtaccaaaatatttaatgaggtgatttggttgtgtttcagctttttacaagattaaaatatttttgatctacttagtgaaacatgttcaatctacttggtgaaacagcgcccgatttttgaaaaaaaatttaaaaatcaggcgcccgatttgtaggcgcctctacgtattttacattactactagtaacgtattacgtagtaatggaccaagctatataattagtaactagttgggtgcccgtgctttgcaacgggaaaaaataacaccaactttgcctcaactcacattaatttaggtacaatatacgatgaagactacaaacgttcatctagatacaaatagctacaagtgatcattgtaccattatagaatagattagattgtaatcccatctaacaatgaaaaaacaaaaaatataattcaatactcataggacatacagtagcaatttcagatcttagctctcaccattgaccatatttaaatttgttctgaccaataggaaactaagatgatcaacagtatcagtatggccttcaaatttgtaaagaatacttcatacttacatgtcccatatatacccaaagctatcttctgatcaactaaaaatataatttccatttgtaataaaaaaaaacataggctggatgtaacatatgtgtttggaccttgccttccgaggtgagtcttgctcagcaccctcatttgctttccatgccaacaactctgtaccgtctgtaccctactcctttaacaactcaatgaaacagtggccttcatatataacatatattttcattattccaacactacacattctaaaatttgaatctctttacaaacaaacaacatggaactgaaggtctgaagccctaaagtaatgttcatgcaaagcatttcaccctgttcaactcttcatttcttcaaattttcaaatcacactctataattataattaccaaggaactaaaatattaattaaatggaaaaagaagaatatttcagtacattctaagaccaagtaaagaattactacaaaaccatcaatgaccaatttaattatataaagtatgcaaatttaacgccattttgaaaaatcaatagttgttgaagaaaaattggttatttgctgcatatccttcaagctttgctgctcggttagattgggaaaacagggaacataagccatggaagatatgtcacataataagttttatcaaaaaggcacgcagaagccatggaagatatgccacagaaccaaatttatccaaaaaatcacatcacaactatgtaaatgatgcttataaaaattacttgaatagagcaatgatcagcggttcattatttcctgaaacatataacaactgggttagaaattgtgaaacatttgatgactgcagaagatggttccgcatacctaataacttgatgacctcgaagacataacctgcaacgttctcatctaacagatgacagtaaatggaagatcaattccaatgtccttgtttgtactatatatattagtaaatagcagagatcctttgacagcatcagcaaatagaactacaagagaagcatttagtggagcataatcttctgcttcagtagaaatgattaaactcatatcactaagcaataaaatgtcaaaggccctcttctttgctaaataaagtaaggactaaggagcactgctgcagaataacaacaaaagcatcattatgcatcctatcaagtatagagaaagttagtgacaatttaattttcaacattgatgagctgttccataattgtcaacatgtttgcaatatgcagtatccagtgattcagacgatcacacccaaactttaatttcagaagcatgtacatatcaaatataaagaactaaagagtacatttttgtttgatattgacataaactctaaaagaaactatagcaaatacttcgattatttatgacaacttaatgcaatcatgttagggtccaaaaaccaattgtaatctcattatcatctcagagaaagcactattctcaaaccaacaacaggggccagccagatgttgtgtgtatcttccttcattaatctaacatatgcacaaaaagagatagaaaatgtacagctcatgtgacaactgtttacatacccacattgccatggctgagaaaccacaataccactccatgcagctggtatctccattaatatgaaagtagtaaaacatagtagtgggttatgggcttttgatcacatcagagcatcatggttagattatctggcagagggctatgtgcttttgatcacaacagagcatatcaatattcagatgcttgcctagttgctcagtcacccctctctatcaaaaaacaacatattgactgacatatcacctctaggagtataggacttcctaactgatcaggaaccatacataaaaattaacggtccttgccataatgcttaagctattataaacaatatattgatggacaaacacatgtaagtgtgatataacgctatgtagtacctacatgataattgatgccttaggttgagagcaaatcaagtcacaaaagaaaatgaaccacattaaccatgagaaaccataaaaattgaagtgattgccatggataaaatcaatggtccaatctatgataaaaacaaaaataggacgaagtagcagagaggtgtggcataacaaactcttaattttgaaaaattctattggcaatgtaatcaaccaattacaaagacatagtcacagataaataataccttagggacacacccttactcccacaaaatcatttgacatgtatatgtaaaaaaatacatgtacaaatttggtcatttcaaatctaacacctaacatagaagatcagttcaggagcaattaatttgttctgattctcacatggattagaatcaaatagatgatttacaaatcaaatatttgtagcatcaaacgagcatgaactgatggtttaattgccactgaagcaaacaaatgtaagtatgtaacacgataattaaccaatcacaaatgtacaaaggcatcactgcatacatatgacaccaatcagttagacaattgtacttttttttagaaaatcaaagagtatataacatgccactgaaatatggcatttgagaaaaaaagaatgaacaatcacctgagatctaaggggtatgtagtgctcacagtacttgagtccagggcagcctccttcgagcactgccacttcttgccatatataagctctaggtccagcttctttccgaagtacggtccaatagcactttccgaagtacggtccaatagcacgaaacacacatatcagatgaacagtgttatccctttacaatgtcatgaagatgcaacacacacttctacaatgtcatgaagatgcaacacacacttctcttgttagaagtcggtagaaaatgatgagcaagggaagagctgccaaggtgcttcaccaagacaaatgcttatgccagagagatagtggtaaaaaaactctttacctgatcacctcgtcgtcagccatggcaaggaggcggccggagggtctgctcattgcaggaggccgcagtagaagttgtgcagttctgggcatattgaccaccggcggcgatggatttgagtgcaaggtggtctcttcccttttccatctcgtctcgcaggcgagtcaccttgcggatgctactccatccagagccgtgggcggaggaaaagagaggaggcgtggtggtcatcgatggtgacctggcggcagagcttgcagcggatgggtggcgatggagcttgagggccggggacaacagcacgtcgatctgcgcggggcggtggtggagcttccggcaaagggaacagtagcgctcggctgagatcggtggtaacggtggcggtggtggtggcgggagacgatcgaggagagattgggggcgatgcggaggaggacgagaggggatcgggacgagtggcagcgcggagccggtcgtcggggcggagatcgtgggcggcgtttgcggcggcggcagcggtgcgggagggacctagtggaggagatcggcgagggcgacggggaggatcgatggaggcggcggcgctggtcggttaggggaatcacggtgacggtgggggagggagctggtggaggatgaaagagagggcggcggggaggatctatggcgtcgaagctggtgggggaagacggcgatggcggcgacgaggacggcggggacgatcgatggtggcggcagtgggggagcgatctggtggaggacggcgtgggcggcggggaggatcgatggcggcggtggcgcgggacggtgggggaggacggtgggacggcggggaggatcagctggtcgaggaggacggcgagggcgagcgggcgagaggaagggtggcgagaatgcggcgaaaagcgagcgggcgcgcggaagccggaaggccagggcgtactgggtagttggagcacgattggagcgcgatggtgcgggcggataggagcgtctggagcgtcgatttggtgcgaggatcctagaaaacatgtcagccgttcgattgtccaggactcaccaccaccactaggaactttttaagtagtaaagatgggttaggagggtgattaagaataaagcattagatctagatgggtacttcgatgggaggaggggatgaaaggaggacaagtccgcttttaaggtagtatagataaaccaaaagtgcatattcaaaattcaccaatataagaaagacacatggaaaaatagagttagaataatatatctaacttataaaccagaagtgcacataaatttaccaatataaggtcttgtttagttcccaaaacaaaaacttttcacctatcacatcaaatgtttggacacatatatggagtattaaatgtggaaaaaaatcaattacacagtttgcgtgtaaattgcgagacgaatcttttaaacctaattacaccatgatctgacaatgtggtgctacagtaaatatttgctaatgacatattaattaggcttaataaatttgtctcgcagtttctaagcggaaatatgtaatttgttttattattcgataaaatttaatacttcaaatgtgtgtccttatatccaatgtgacacctcaaaacaaaaaattttgccatctaaaccgggcttaagcaaggcacatgctcgaattcaattgacgtggtcaagggtactaatgtctgtacatgagcaattttgtactaaatatttatcactttgtactgaaatatataccgtattagctttttcacggtcctatattcattatcccttgtgtcaaagtacatcttgtattagttgtgctctggataaatcatagccttttaaacaccatctcaagccaatctaacaacagatgattcctcattcaagactttggttggttaatctctcccaagagaattgatagttaattggtggggaattttttggaacgactctcacaagacggtgcgaagttctattgatagagcaggaaaaaattacaagattacaaccctagaaggtcgtaaccaggaaaaacaaaaaaaattataccaacacccacacaccgacagcgccaacacacagaaccaggagaaagctagcaccggaccgactgccgctaagcggaccagcaccaacacacagttaattggaggagattgatcctctccaatccttttctcatagaagttagtcgaacaagttctaagttgatactctgacgatgtacctaatgaactaaacctaaacaaaatattggatggaaattttcaatcaaccatgcatacccgttaactaaaactttgtggcatagcaaagtgtggcaacatttttttttgaagaattttgtcctagtattcgctaaggctgtcgtgaaagatgtttcaattgccaaaaaagtttggcatcaatgcaacatatttacgacttcatgtataagctctgcaaactgaataaccatattcattacctgtaaatttcaatcctcaacttatatatctttttacatctaataagaagagaagctattctttataacaaagcactaaatgaagcagcaaccgtgtgtccagaacatgcagaaacattttatctaaaaaaacacgcataaacatttttgtaggaatttgttttcctcttctgatacgcaatatggtctatataggtggaggtggaattttttctctcaagggaacgtttactcgttttgtacatgtcaagaaaaacttataactttttttgatataatagacccatatataatatatcaatccatgcttgaattcaacctatacaaaatggaaaaaaataacaaaaatacacgtattgtttggactcaaaattattaatttttcacatatgttggaaattcgagtttgcatgtcaaaaatactggcatatcatatatgtgccagctgtatgccacatgttgatgcatcgtgtcaatttttttatgacctttgaaaaacatgcaaaatcaaagataatttccatgtaggggccggagatctagagagagagagattggaggggaaattggcaggataaagaagaacacgaagaacagagtatagtgtcttggagaagaggtagatgtattgagttttgggaagtagtttagtgtttacaattttcatacccctctcctcccttcatccaggcttatatagatgcaccggatacagttggaacttcaacctattcgggccaagcaattttgctcgctatgctgacgcacacgggatgaacatggcttccgtctgatcagattgtctgctgccgtatggtgaacagtggctgtaacagtgttgtcgctggagaggagtgtgagagtcgtaaaatagggaggaagggagggggagtgcagaagattgagcaacaacatagggagaaggagactaggagagagaggttagatggagaggcagagttgtggatggcgggatgaattttctttttacttgacacgaagtaattagttaataaacattttttattaacagaataacattaaagatttgctagttttgaaatatgccattactatttgtgtatttgtaactatgccattgttgtttatttgtaatctcagtgataccattatgatatgtattttacatgcattggacgaannnnnnnnnnnnnnnnnnnnnnnnnnnnnnnnnnnaatgag

SEQ ID NO: 5378 - DNA, 1366 bp, Oryza sativa
ctcaatatgtggctgctggttgccacgggctgcttgcttgaagatgaagggatcaacgaatgagcttgctggggctagtttgctgcttgaagaccacgacgaagacaaagactcaaatcccatcgctggcgatgcctccctgttgctccctgattgggtcgagccgtgcgcatctgccgttagaattcggagcgtcagacagcactgcgcaggccgttgtgccaaatgaccttgtcagatgcagtgatggggaagatgaacagtagagaggagaggttcaagaagatggggtaattttgtccaaaaagtttagaaaatacaataaaggagtaggtagtggcataaaccaaataaccacgaaattataatggtatggttacaaatagttgaatactaacggtatatttcaaaactgacaaatttataatggcatgaatctaattaacctttaaaaaaagctaccatgaaatatcacaaatgtgtaaaaaaaacccaaatataacaaggcagtaagttaagactatattctaacctccctcttcccaccttccgctcgtttttcttgagcatatgcttctcaaattattaaatagtgtgcttttaaaaatgttctaaagaaatgttgttgtaaaaatacatattaatccatttttaagtttttagctaataattaattaattacgtcctaataagctattgagcaaagaaaaaaaaagttaactgctgcttgattatttgggttcaactggcaagaactatgaggggatatcgattacctattctgtggtaagcatacccattaattaatttacggccactttcgctactcgctaaaaatagaactaataatgacttaaaatagaaaacaagagaggagcaaacacgtactctgaatgaacggaggctactgacgaccaaactgaaccaaacacttgtgaagctctcctgccaaataccactccatacccgcgaaaaacgctattcaattagcctatataataacgcgtaaccacagcctcttaattcatcccagcaaaatcatctcgatcgatcgacaaagctatagctagcccagtcatggccgcctctcccgcaatggcgacactcctcctcctcctcctccatgctgtcctcgtcgcggcagccgatgccggcgccgccgataaggaggcctatgcggcaacaggatcaaccgctggcaaggagaccgctgcggcggccgacaaggagacctctgcagcggccggatcaaccgcgggcgccgtccctgaccccaacatcttcaacaaggaggccgtgtgccccaagacgacggacgagaaggcgtgccagcaactggtgaaggtcctgccgcccgagtttgcag

SEQ ID NO: 5379 - DNA, 18319 bp, Oryza sativa
  unsure (1)..(18319): unsure at all n locations
caaccgaaggcaaggagaccgctccggcggccgaatcaactgtcgataaggagacctctccagcggccgaatcaaccgtcgacatggcgacctctgcggcagccggatcaaccgccgacaaaaacgcctacccggcggccgaatcaactgccgataaggagacctctccagcggccgaatcaaccgccgacacggcaacctctgcggcagccggaccaactgccgataaggagacctctccagccgccgaatcaaccgccgacacggcaacctctgcggcagccggatcaactgccgataaggagacctctctagcggccgaaccaaccgccgacacggcaacctctgcggtagccggatcaactgccgataaggagacctctccagcggccgaaccaaccgccgacacggcgacctctgcggcagccggatcaaccgctgataaggagacctctccagcggctgaatcaaccgtcgacacggcgacctctgcggcagccggatcaaccgccgataaggagacctctccagcagccgaatcaaccgtcgacaaggagacctctgcggtggccggatcaaccgccgataagaacacctatccagcggccggatcagccgccgagaaggagacctcttcggcagccggatcagctcctgtcgtcgacactgcgcctgcggccccgccgacaacttatgtttaattacaaacattcggtacttaatattttttaggatgctatacgaactttaaataactcttccaaaatttttactacaccaataaaaaatccttacaaaattttgactacagcaatgtttgtaaggagttaatcgaacaaggtctaagttgatactctgatgtgtctaatgtttcctaaacaaaatattggatgaaatttttcaatcaaccatagccgttaactaaaattttgtggcaaagcagcaaacaaaaattgaagaatttggtccaagtattcgccaaggctgtggcaaaagatgtttcagttgcccaaaaaagtttgtcatcaatgcaacatatttacgacttcacctataagctctgcaatctgaataaccatgcatagtttccaaaaaaaaaaaaaccatgcatattcatcacctgtaaatttcaattctcaacttatatatctgttttcatctaataagtagagaagctattctttactataactaagcactaaattaagcaacaaccgtgtgtctagaacatgcagaaacattttatctaaaaaaaacgcagaaacatttttgtaggaatttgttttcctcttctcatatgcaatatggtctataacactcgatctatataggcggaggtggaattttttctttctagggaacgttgtcaaccaaaaagttaaaaaacaacttttttttaatataatagacccattataagatatatcaatccatatttgaattcgaccaaactaacacgtactgtttgaactgaatattattattattttacatatgttgagtttgcatgttttatgtaacgatatgccacgagcgtttaatatttcggtttggtcatttgtagggtgaaaatttcggtccgaattatatgaatttttaaacaaaatttgaataaaatattaccaaattcatgaaaaaaattaaaaatttcagccaaaataatatcatatcgggggggggggggggtccgatagaaccaaaattttccaaaatccgaaattttgaatcctgtatgccacatgttgatgcatcatgccacctttgaagtttgaagtgaaatgcaaaatcaaagataatttccatgtagtgataataaatactccctccattttacaatgtaagactttctagcattgtccatatttatatagatgctaatgaatctatttatataataatatccagattcattagcatctatatgaatgtgggtaatgctagaaagtcttacattgtgaaacggagaaagcaaatcactttcctctctatagtctatacactactcttcggaaaaaaatttggtggagaccgggtgtaaaccggctcccgtgcagccccgaccccgatggttgctacgtggacaaccttaggatcgaacgtctcgctgtgcatggctgtgcatggctccaagcgcagcgcaaataggacggaggagtcgcgactcgctcgatggctctgggcccgtcagctcaccggctcagatcatatcaacatctcttctcagcagcagccactgtcgccgatgcagcctctctcgtccgtcgtccgcatggcggcgatagagagtggccaagggcgaccgccctggctgaggacgtacgaagacgacgcgccgcttggggcaacgtagaggttgaggtcgccctgtttgccggcggctagcgcagagatgtactccatcttcctatatatgggcagtagctgctatactatctcttcccaatcacaggctcacgggcttctttctcaccatggcgcatgattgatttgattagttagtatgatctgggcttctgcattcaaactttagtgtagttgttaactgctacattttaatggatgtacgtagtctgaatgtttgcagattctaattagatttgataaagtactaatattgattttggtcttttaccatgtagatttgatacatactaaagattttggagatttgagcatttcatttcttcatggtcacttggtcagtgcatatatttcagtaaaagatcagtgtcaagttcagttgaacaaattaacatatcatacggttttccggccgagtggacgacgttcgagaaagggagtggtgacggacgagagactgtagatgagaaaggcgccgcttgccgccgctggcagcggctgcggaggaaccggtaggagagggatctgagcctgcaagccaacggcccgggagccgagtcgagcgaggctcatctgccatatttgcgttgtgcttgaagccgcaacgagctagacgtccgattctgagattgtccacgcggcaaccatcggggtcaggattgcccagaagcctactcttcctcggaaggatcgagcacatgccctgcgaagacgatggcttgcgacctctcctccacgatgaagaaggcgaacggatggtcggcgacgaagtccaccagcttcggcggcggcgtgtagtcgtcgtcgtacagcgagcacccgaggtcgtcgtcggactcctcgtgtacgccgccgcctcgctcccctcctcgttcacctccaccaccaccttgtggatcacgctgctcacgaacatcgccgggtcctcgccgtcgccctccaccgcgatgccgctcatctccgcggcgaacatgtcgaacggcaggcggagcccgaggccgcggaggacgtcggcgatgccgtagtggcagaaggcgagcttgaacttgggcacccggaacctgcccacggagacgcaccccggcgggaggtgctcgtcgacgaactccggcgaggcggtgatcctgtcgaggaggcccgggaggccgtcgcggtcgtcggggaggaagacgagcatggcgaacgacgggaggctgtagcggagcttgaggttgtaggtgtcgctcgtcgccttgtacggcaggcggagcaccctgaagccgtcgtggcaggcgacgtggtggtagctccccgacggccgctgcatgaaggggacctcgacggagctcccgtcgaggcggcggaactcgcgctccgccgtgtcggacttgtcgaacggggcgagccactcgcccttgaagtagatggcgttgccgacgacgtgcctcgtgtccacgctctggctctccggcttgatcacctccgtgatcaggttcttcgtcgccctcgccacccacgcgttgatctccttccttgcttccaccggctgcatcatcaatggccacacatcaaatattaaatcaaacaaaagttgatgaattagctactccatccgtctctaaatatttgacgctgttgattttttagcatatgttttaccgttcgttttattcaaaaacttttgtgaaatatataaaactatatgtatacataaaagtatatctaacaatgaatcaaatgataagaaaagaattaataattacttaaattttttaaataagatgaacgattaaacatatttaaaaaagttaacggcgtcaaatatttacaaacggagagagtagatctgatgaatttgaggtggatttgtgagaggatttacgtgattcttgaagtcgacggtggaggcggcgcccttgtacgtgccgacgatggcgtcgcggtacgccggcttgagcgagtacgacgcgtcgagccacgagccgcaggcgaaggagacgcacgggccgccggtgggggcctggtcggcgaggacgcggcccatgacgacgccgcggacgaacgcctcaagctccgggcgcgacggcgcgccggccacggcgaggatctcggcgagcgtgctcccgccgcgccggccgacatcatcgcgacggcaacgtggatggacagcggggagaagatgaggttgccgcccgccgcgcccgacgagcccgacgcgaggctcttcagcaggcgcgccgccagcgccgcctgtccggaccggcaggcttcgccgccgccgaccgtgtcgtcctccttcgccgccgccatggcaaatcgacgacttcttggcttgctggctgcacgagatgttaacctaatccggtataataggtggcgttgcagctagcgatgcgtcaatttgtagcggtttcgaagtttagatttgattcggagtagaactctacatgtatacttctgtttgtgaattgtgacgtgccgattacctaaaaaggatgccggcgatattttcagtttctgggctcattgaatattctattttggaaaaagtccaaatactctcctaagctccgcctatcaccttaagctttaaaaccggacatttaaccccctaaactttacaatacaatctatattacaaagtttagaatgctagacggactttcatctaaaatttaggggggggtatttgaattttttccttctatttttctaacatataagtgtactttatatgtaaaaaaaactttatatgtgtactatagttggagaaagtgtttttatccgtggaaggaatgttatctttttttatgccacctaaatagtcattaaaaaaataaaagacattgacaagatagattaatatgaaacattactccacaaacatatatcacggtggttgtggagttggtcaagagctatctgtcctcgccattgccaattccaattccttcgctcgcgctcatgctcgatctggtggtcatgacgagggggcaatcagacctacacattacaacagaaccaggcattcgtaaccccaaaagatatattatactgtctaagataagatatggaggaagtggaagatgaaccatcacaaaagtaggatcatcgttttggccccacgtctgtgacggttgcaatatcagtgatatattgtaaggtctatctgtctatcttcacggaagacgtatctttgttccccgtctaccaaactgctcaccttctctcttgctcgtaccctgctgcttactgaccctctcgcacttgccctctttgccatggcctcacctcttgctccaactccaccgctaccgcacatattgtgttcccatagtggagctttccacctcctccttaatgttgtcgatgcctcgagatcacccaaccaagctcgccgtccttgtcactgggctgtctagatccaaagcagcttccacttcctctttctactcttgttgtcaacatccgtagttctagtggtaacaaagtgcgagacgtcagcctagggtttacttttttggtttagctgatttgatcgaaggtcaccgatataccgaaatttcgaacaaaatttagttaaatttgaacaaatattacctaaatcatgaaaaatttaaaaaagtaaaaaatttcggccagaataatatcatatcagaggggtccgaaatgagcgaattttcagaaatttcagtccgaaatttctaaccatgatcaggcctggcctcctaatagtcatggtccactagatccagatgaccctgacctcatggtggggtggtgtcggtggcaaagggtggaggaagtagaaggtggcaaaggtaggaggaagtaggaaggtagtgttagcggatcagatggtgcttgatgctgcaacttcaacaaaggagaggcacaggctaatataagtgtttggtggagtggcctcgacgaggacgagcggctgtgttgtgatggcggcagctagtggcctcgactttttctaatagctagctgctcgggcatggcatgcaagcatgtcgacgatgacatcgagatgtggatggtgacgagctgatggcacgacgagcatgattcaggtacacatggccggtacgaggatggcaacatctctcttgtcatctcatgacaatgttggaggggatgagtggtctggccaggtggcgacaccaaccatggatgggatgagtgggatgagtgtacgcaagcgtcctttttaatctttttaggaaaactactacagatggtgggaaactattttaacatctcgagtcttgtttatatttttttaatttactagtttacatataataaactagcatgatggcccgcacagattgcgcggctagcatcattatattttctttcatatattagcatatatgttttctcattatattattaaaatatattacaatgtcaacataattttacattttgtaataactttacgaaactactaatgtgtaatattcatattgtattttatatacgtgttagttattaattatttttaatatcaaattttagttatttgtaaattatatatattcctatatggactctagacttatcttttaatatttctttttttaattctgaatttttattatttctaattgtatttctatatggactctaaacttatctttcaatattctttaatttttaatttaaaattttagttacttctaaattgtattcctatattaactttaaactattcttcccatgtttttcctaatttccaattttagttatttgtaaattatatttttatacggactctaaacactacttttcattttattatgtttattttgaattttagttagttttaaattcctatatggattctatactctacttctaatattccttttttttattccgaaattttatttttttcataattgtatttcacttctaatattccttatttttaattccaaatttcagttatttcctaattgtatttctatatggactctagtctcctcttctaatgttccttattttttaattctgaatttcaactatttctaaattgtatttctatatagactctagtctcctcttctaatattccttatttttaattctgaatttcagctatttctaaattatatttctatatggactctactttttctttttctccgattaatgtgagaatttctaggccatgagagcgaacgaggaggctcctttttctattcctttaataatataatagatagatggatatccactcaaactattagaattcatctccgtagattagtaataggtggtcagctgtcggaacaattttttttttatcaaaaatgaacttttttttaccacttcacataactattctagtgacatttgtcaccgacgtcacaccatgctcagaacagcaaggagttagttagatctagcggcctccaccctagctttcccatcatcactgttgtcatcaattcttgtgcttggtgacaaatgtgatagcgctgagctcaggccgtagatttggtcttcctacatctcctcttcttgtcattgccattgctggagactgcagggtggtggtgtgttgtcgctggagagcgtgcgagggtgagccctaaaatagggaggaagagagggcgagtgtagaagagattgagcaacagcagagggagaaggagagaggtgttagagggagaggcggagtagtggatgcatggcctgatgagtttcccttttacttggcatgaagttcttttatgatcgaacaagataacacaaatgtagccatatatatatatcacaaatgttgtctgttcaacgaagagctactaaaaacccaaacatgtctctacctaacttacttcctcggtttctgtgattacgaactgtttagtgcactttttgtaaaagttttctgtaagaaagttgatgtaaaaatacatattaatcctttttaattttttagctgatacttaactacttatatgctaagagcacccgcaatggtaaagtaacgtgctatctataaaacatgtatatctcagcaattgattagattaatagtaaaccacttcaatagtatgtctacatgggtatctatagctctctcatgcattgcctcgtttttctctatagactatctctaagttagtagatagttttgctctctcttttcatttaatatcttccatgtaggaaaatatgctgacattgatctcttgtatagagcctataaataatcattgtgggtgccctaataagctactttattttacgtgcggaggaaaacaaaagttcccaactactaacaaacacagcctttaaattggttttacgctgattacgagtatatatgttcaatcggaaaggactatatacgaggggatatcgattacctgttcttagctaagtgtacccattaattaatttacagccggatatactttcgctgctaataatgacttaacgattttgctaaaaatctggcgacaaatttttggcacgaaatcactcggatttacttcccttgtggattagtctgtgcatgatttaattagcggctgtgatgcgtttccttcccacgcacgcatgaggccagcaacatctagcttggcacataattgatgagtacatacattgcacgtcgttgcagctaggtgaacagattgaagaaataaaatataaagttacagtcctatataactaaaattacattcgtaaattcagttgatatgacatgtaagtgcactataattttggtaaaaatgttgtgtaagtaaatatgtacttgttatttcctttaaaatataaaattacaatcctatataactaaaattatatttataagtttagttgatatgacatgtaagtgcactgtaattacactatagttacactgtaactacactatagttacactgtaactatagtgaaattacactgtaactatagtgtaattacactgtaacttttagtagatgggttggtgatatatttttttcaatgtaaagatctaacaaataaaatatatgcaatatatataattaatatatgttgatacatgtatagactcttctaatcaagtgatcaaatgagcctaatccaactaatctaaaatctgtgtgatttggacccaaaaatctgtcgtgtgatggatagctagtcccatgacttaaaatagaaaaaaagaagtgtacaaaactgaaccaaacacttgtgaagctctcctattagttagatccatgcaggcgaaaacgctgtgcgattagcctatataaaaacggcgtaaccacggcctctttagccatcgatcaccattaattcatctccatcgacaaagctagctaagcccagtcatggccgcctctcccgcaatgccgtcactcctcctcctcctcctcctagccgttctcgtctcggcggccgatgcctacgactccgccgccagcgccaacaccaacgccggcgccatccccgaccccaacatcttgaacatggaggccatgtgccccaagacgacggacgtgaaggcgtgccagcaactggtgaagaacatgccgtccaacatcgtcgcggggaagaaggacgccaggagcatcgcccgggggtgcatcgccaccgcctggttcgtggcgagggacggcgccaaggactgcaccgccgccgtggacgagtgcaaggacaaggtcgaccagtgcttcgacagctgccgccacgctttcgccgccgtgaacgacgccctggagccccagggcaccggcgacgacgccgtcaaggtccccgaggacgagaagctcctcgccatccacgcaagcctcaagcagttgctccgcggccccacgggcacgcgccgcccgcccctttgcaacacttgctgccaggacggctcgtgcacggaggagaagaagcgcaacgtcgtcgcgctgttcgtgcaattgtggagcttgctggatttcgccgacgcggtgctcgaggacctgtatcctctgacgaagctgccaggggacaaggccgcgggatcagatacctctgcggcggcggccggatcaaccgccgacaaggagacctctgcggcggctggatcaaccgccgacacggcgacctctgcggcggccggatcaacctccgcaaaggagacatctccagtagccggatcaaccgccgataagacctatgcagcggccggatcagctcctcctgtcgtcgacactgcgcctgctcctcccgtgacaacttatgattaattacaaacattcggtatttcatattttggaggatgctataggaactttaaataactcttccaaaatttttaggacaccaacgaaaatccttacaaaattttgactaatcaacgtttctaaggagtttaacaaatttctatacgtgtaactttttcttacatatctgagtaggtgcattgctgagggcagggtgcgccttccgtggttgtcattcgaaattgtctttgtaacctcgtcaatttaatgaagtttagaatcaaaatgatgagccttttatctcacttattgtcctctttttttttttggcgcccgtacacattatatggtaccaacgtaatttttaaaagtcaatagcagtttattattacaaggacattcaaatatataaccatgggcaatagtagtaatggtctaactacaatatatattaggatcgaaattaacatatcgtcgtagactacattcatatgaagtaaatcaagtatatataattgtgattatgtgggttttaagatcactttcagtgcaataacttttaatgtaattggctaagtttgatagcatatttctattgtccggagaaaactatgggttcaaatacctacaccatccgtctaaaaaaacaaatgctgactatgaatttggacgaacacatattttatagttagaatttgatttctttttttgaaatagagagagcacaaatttaattcgcccctacatacaaaggctgcctcctataagatccacttacccggaaaaatatgtggtgaaaaccacatgtggaaacttagaaactatctttggatcgaaaaatggacgtctgacattcgtccacgccatcacgagtaaaaattttactcacggatttactcataagtaaagattttaccttgagtatttttactggtaatgacgtgaacaaatcttagacgtccattttttatccaacggtagttttcaagatttcactgcatagctggtttccaccgtatattttccctacttacccggtcagagtgggtagtgtccagcgatgtgtaactactaactagttaacaacttgattgcattgggaagggagattgatgatatatttcaacctgaaattggattaatgttaagtacctttctaggtatagtgagtgagtgatttttttttccatccttatttttagaaattaagtcttttgattgacaccaaattattttctttttctttcctgcggtttggtgcttcctcttgttcctcttcctccacacagacaacttataaattgaagatatatgtttataaaaaaatataatcatgtgagatcttattagcaagagttaattgtaacgaatataatgatgtaatcggatttcaattcagataagtaatttagaagaagaaaacaatttgaagttttattggagttgtactttgagaaaaaaaaagataatacaaacatgtagcaagccttagcatagcatgtaacttgcacgatttatcaattagtgtcaggattttaatggacatgaacactaacgtaacgcgccggatcgataatttcctccaaacttttctggagaaagctagccatcaaacgtcgctcactttgccgcatctctgtagcgttgcatgcgtacagggagctaggggtggcggagcatcgtatgcatgtctgactctgcattctctctcccttttctttttgtttaatcaaactttaaacaacttatttctaatttctaagatattccaaccgtcaaaaaaaatcaaccttatgatatatcccagtacaataaaagtaaatatagagggagggtggaggggtggcgatcgctacccggtcgctaccgcgatcgatcgcctattagattttccgagagagagagagagggggggaggagaagaaaaggtggtggggttggcctaaaaagaaaagtggtgggtccaaccaaagatgagtgcattgtagagaggggagcgtcgactgcttttcttcctatgtggatgtttggcgggacgtattgctactaccctaagatagtgcgatttgatctgacttgttgactcttatcattctcctattagttcaataagacatactaatttcatcccaaaataactatgtagcaaaatctcttgtattttgagtacaactaacatattttgtcagttttgtttcttatatttttctataaatttggtcaaatataaagaaatttgaattatgaaaaaaattcaaaacaaattataataaaacggatgttgtaccaactaacttggctgcagttaatgacattaaaatagttactcccccatcattttggaacatagagggagtaaatagattccgtttatctaaagtagttttgtttgtaatgttatactgcatgcgtgaaactgatgcagttatttgataacgttccacacattttgggacagagggaagtacatatgtgagctgctctctccgtttatattttaagttgtttgaattctttcttaataaaattatttaaatttgtccaaatttataaaaaaaaagcaacttctacagtatcaaattaattccactaaatttgacattgaatacgaaaatgttactatattttgctaaaaacttgatcaaactttaaaattttgattaaggacttatataatataaacggatcgagggagtaattaagaaacggatcgatcatatatcacgatctaaaatgatcatcttcgagaaaatctttggaaggatagaatgtatgaactaaggtgatcagcatgcattattcctcggtcggcccacgtacgtggcattgctctcctgccacttaacacatttttgcatgcagactgaaatcgcgcgtactcatttcatgttccctttttttttaaaaaaaaaaataaagcttactcattcattccctccattcacaaaaaaacgatgttttaggcattttaataaagtcagtaaaatatcaactaaaagagtcagtaagatgtaacctcgatcactttgataaacaaaaaatagttgcacaagtataatactatgacaactttgtatataatgactgttactttaataacgtgaacaattatattatggtgaaagttagcttctaccacctatatatatgtacggattataaaatgatattttagattgtggaaaatatcaaattcaacatattattaacagtatttgtagtactattcacatagtacaaattatccctctctatagggattagaatccatcttcgtataacatcctccattcctccactcatcatacagtcatacatggaggggaaaagatcgatcaaatcacgtgatttctgatataccatttgcagtacatttttgagagaaaaaaaacgcgtaggaggaatgggaggatgtccatcttcgtaatcaggaagagatacatgcaaatcgccaaattgagctaatctgatatgttgcccttaattatgtacccatatagtactacaaactgatgatccctataaatagtgacactatctacactaattttcctcacaccacagagagttgaaccaaaccatctaccatcaagcttatctaacgccatcatcgtcacgaccatgacgaccaaggccaccacccttctcctcctcctcgccgccgccgccgcggcgctcctctgccacatccacgtcgccgtcgccgccggcgaggacccggagccgtgcgagtgtgcgacccgtcggacatcaccatcgcgacggtgaagaccgggcgggtcgtgggcggcctgccggagttccaggtgacgatcggcaacgagtgctcgtgcccggagggggacgtcgtgctgtcctgcctcgacggcgtgcccgccggcgtcgaccggagcaagatccacgccgccggcggcagcgacgggctctgcctcgtcaacgacggcctgcagatcgtgaaggggtcgccggtggtgttcacgtacgccgccagcgcgccggtcagcctcgccttcgacaacgcctcgccgcggtgccaacgacgttgagtttggctgcaggcgtaccattaattgcttgcatcatcttccatggaagcgatctgttatgtgtcatgtgtgctgtagcttgtcagctgttgtgttccctgtattgagtataactgggtgtttgggcctggcttgttgtgggccgtggaccgtgtgtgtgtttacgacgtgccgtgctggactggcggtcgtgtcgagtgcgtgtgtcttgtacccgttaaaaggggaactccctgccgatgagcaggtatcgatgagaagaaatcaaatacaatcaaactacctctctctctctcagttcatccccttcctctctaattcaacccaaatcccctagcgaattccggattagcttggcgtgacgccggcggagtcttggagttcgtcacatctggtatcagagcagtgatcccgctggcgaggaagaaggggccaaatctcacggagaggatggttgctgcggaggcagagctcgtcgatctgaatcagcgagttggggagctcacgagcaacctcaacgaactcctggggtcgctgaccaagctggagacgtggattccatcggtggacacggggatccaagcgctgaacaaggccgtggaaggaatcgccgcaagagtgacggttttggagaacttacctgcagcggcatcggggatgacgaccccaacgcccatcgagcacggcgaaatcgagaatcaccagggagacgaatccaaagccctcgcggctcaggatcgatccctggtcaagggtaagtcccgattccccaactctcccatcacttttgatataggagagtcttcagttcagaatcaatccagcaataggttccaaggtcctaggcttcccaagtctgatttcccaaagtttgatggtaacaatcctaagctctggaagaactctaaaaagtattttgaaatgtatcaagtgtcttatgaaaattgggcaaaatttgctaccctccactttgttggaaatgctgccttgtggctccaaacttatgaggccctccatagtgttgaaacctggcctgaactctgtatagcagtgcatagcaaatttggcaaggacaaatatcaggaacatttagaagagttagaagggcttaggcaaattgctagtgttgaggagtattacaccaagtttgaggaattaatgcatagggtcttagtttataatcaggcctatgatgaaacctattttgtcacaaagtttgttgggggtctaaaaactgaaatcaaagcagctatatatcaagctgcataggcccaggactgttgatacggctttgtctcttgccaaaacgcaggaggaacttgtcttggagttgaagaagggtactcaaaagctgggttacaaagagagttacaagttagcggctgtgaagaataattaccagggcaagggaatattggggcatgctcctgatgatgctggaaaaactgaagagaaaccaaaatgggaggacagatttgagtccttgaaggcttccaggagagctaaaggagaatgtttcaaatgtggagaaaagtggggacctaaccataaatgcccaaaatctgttcagttgcatgtcttggaggaattacttgaagttcttcaaattcaagagaatcaggaagctgggcaagattgtgaatcagaaggcagtgatgaagaattggtagtctctgaatgtgcagtttcaggaactatgggaaaaagaacagtcaggctgcaagggttaattcaaaatcaagaagtgctgatattaattgattcagggagttctagcagttttgtggctcagcatctggtggatagtttgagtctggcagtccttgaaacagctcctgctcaagtggttattgctgatggaggtgttttacaatgtaacaaggtagcaacaaaggttgattggtggtgccaagggcatagttttacttcagatctaaaggtacttcagcttgggggatatgatgtgatcttaggcatggactggctagagcatttcagcccaatgtggattaactggcaaaggaaaaagttaaggtttacataccaaggaaagagaattactcttactggggttaaggaaaatctgtctgattgcaaatcagttactgctaagcagttaaaaggaatgttcaaatctagagctattgctcaagttgttcaactatgctcaattgaagaaattgaaacaaatgaacagttgcctcctgaaattagtgcagtattgcaagagtcccaagatcaatttcaggaaccttctaggttaccaccacatagagattttgatcataacattcctctcatgccaaatgccaagccagtgaatgctaaaccttataggtatgctccgaaacaaaaggatgagatagagagacaagtgaaagttatgctggaacaaggaataattaaggacagttccagtccctttgcctctccagttcttctagtcaaaaagaaagatggttcctggcggttttgtgttgactatagagggctgaatgacattaccattaagaacaaatttccaatgccagtggtggatgaattacttgatgaattggctggagcaaagtggtttaccaaacttgatttacggtcaggctatcacaagatcagacttttgcctcaagatgaacataaaacagcatttcgaactcatcaaggattgtatgagtttagggttatgcctttcggtcttaccaatgcaccagcttcatttcagggactgatgaacaaaatctttgcactaatgatcaggaaaaatgtgcttgtgtttgtggacgacattcctgtttacagcaaaagcttggcagaacatgtgcagcatttgagacaggtgtttcagatactacagcaccatcagctgtttgtgaaggctagcaagtgttcctttgccaaacaacaattggagtatctagggcatataattggtgaacatggggtggcaacagatccagcaaaagttcaagcggttcaggaatggccggtgccaaagaatctgaaacagttaaggggatttcttggacttactggctactacagaaaatttataaggcattatggagttatcactcgaccactaacagagttgctcaaaaaggataagtcatacaattggacagatgctcaacaaaaggctttctgtcaagtcaagatggctatggtccaggctcctgtgtctgtgctggccatgctagatttttctcaagaatttgtgttggaaactgatgcctatgacaggggtattggagctgtgttgacccaaaatggacacccaattgcctatttgagcaaggcccttggagtgaaggctcaggcattatcaacatatgaaaaagaatgcttggccatcttaatggcagttcaaaaatggagggcataccttcaacattcagaatttgttattctaacagaccacaggagtttgactcacttgggtgaacaaaaactaaccacaagtatgcagcacaaagcttttgtgaggttaatgggccttcagtatagaattcaatacaaacaaggatctgaaaacaaggtggcatatgccctttcaaggagagatgctcagacagaattgttagcaatctctgttgggaggcccaaatggttggaaatagtggtagagcggtatgaacaggatgatgaggcaaagcaactattgnnnnnnnnnnnnnnnnnnnnnnnnnnnnnnnnnnnnnnnnnnnnnnnnnnnnnnnnnnnnnn

SEQ ID NO: 5380 - DNA, 1562 bp, Oryza sativa
  unsure (1)..(1562): unsure at all n locations
atggctatggtccaggctcctgttgtctgtgcggccatgctagatttttttcaagaatttgtgtggaaactaatgcctatgacaggggtaatggagctgtgttgacccaaaatgaacacccaattgcctatttgaccaaggcccttggagtgaaggctcaggcattatcaacatatgaaaaagaatgcttggccatcttaatggcagttcaaaaatggagggcataccttcaacattcagaatttgttattctaacagaccacaggagtttgactcacttgggtgaacaaaaactaaccacaagtatgcagcacaaagcttttgtgaggttaatgggccttcagtatagaattcaatacaaacaaggatctgaaaacaaggtggcatatgccctttcaaggagagatgctcagacagaattgttagcaatctctgttgggaggcccaaatggttggaaatagtggtagagcggtatgaacaggatgatgaggcaaagcaactattggcacaattgattttgaatccgactggtgttgagcatttctctctacttaatggggtcattcggttccaaggcagaatttggttgggtaaatttgaagatgcacattaagcagctttgctggctttacatgctagtggggtcggtggtcactcaggaataacagccacttataacaggatcaaaaatttgttttattggcctggcatgaagaaagatgtgcagaagtatgttgcttcttgtgaggtttgtcagcaagcaaaacctgaacattgcaaaagccctagaaaattgcaacccctaccagtcccttttcaggcttggaccaccatcagtattgtaacgccccgattttcgttcgggaataaaaatcaattaataatacattttctagaaattaaataaaagttaaatcaatttaatcaagtaaaataatgggagaattaaaattttcccttaaaaatcattggccgggaatattttgtaatattctttgtgccctaatgtactctccggaattttccgtgaattttcggagctcgagaaatagttttaaagtcacgaagatcatttaaccaattaaaataaaaagaaaacaaataaaatcctccctcctctctttgggcccctttcggcccaattcccccccctctctccctcccgggccggccttctccctcggcccgctcagctctctctctccctcaagtctgttttgcctccccagccggcctctccctccctctctctccgacagatgggacccgtgggccccacctgtcatccccaacctccagcccgggccggcaactgccatggccgcccgagccgcccacgtagacgcccctccccgcgcgtcttccgattcccgcgcgcgtgtgggcacggtccaccccacgtcatccccttcctccaccatttcccctacttctcccctccaaaaccggcgccaaactgcccccactcacccacgtcgccggcgccccttcccccttcaaatnnnnnnnnnnnnnnnnnnnnnnnnnnnnnnnnnnnnnnnnnnnnnnnnnnnnnnnnnnn

SEQ ID NO: 5381 - DNA, 670 bp, Oryza sativa
gagcttctcgtcctcggggaccttgacggcgtcgtcgccggtgccctggggctccagggcgtcgttcacgccggcgaaggcgtggcggcagctgtcaaggcactggtcgaccttgtccttgcactcgtccacgggggcggtgcagtccttggcgccgtccctcgccacgaaccaggcggtggcgatgcacccccgggcgatgctcctggcgtccttcttccccgcgacgatgttggacggcatgttcttcaccagttgctggcacgccttcacgtccgtcgtcttggggcacatggcctccatgttcaagatgttggggtcggggatggcgccggcgttggtgttggcgctggcggcggagtcgtaggcatcggccgccgagacgagaacggctaggaggaggaggaggaggagtgacggcattgcgggagaggcggccatgactgggcttagctagctttgtcgatggagatgaattaatggtgatcgatggctaaagaggccgtggttacgccgtttttatataggctaatcgcacagcgttttcgcctgcatggatctaactaataggagagcttcacaagtgtttggttcagttttgtacacttctttttttctattttaagtcatgggactagctatccatcacacgacagatttttgggtccaa

SEQ ID NO: 5382 - DNA, 1560 bp, Oryza sativa
tacaaaaagcacttagcatttttaaacgtttgctaaagatgagaccgaggtgaaagacgagagttgagaagtcgaacactcatcactaaaaatgaaaaagggtcgaagtaataagccctcaaacaaacgaagcgattaaaaaataacaagaggaccgaaacaggcagacctggatggtcgaagtatattcacatgataaaaaaaatactttacagatagattacaatatccggatcaggacattttcgccttacccctgttacctcagacgaacatggttcgtcatcgctacttattttatatattactctaaggggggaaggaggtgaaatgcacgccaaactataccgacgtcaagcaatagcagcttggcaattggtcatcttgaagtttcgccaaaacatagctacatttttgcggcgttggacatgacaccggtcgtaattttcgaaagatcggccaggatgtcttcgcatccagttcgccactttgacaaccacatagttatttccgttgataaccatttcacggtatacgggcttgcacgaatacctaatctttggtaagcccttaattgtgacaatttactcgtttgcgctttgccagtctttgaaaggaggctgaacgcattctttacgcagtggaacctgcgaagaatgtggaaatacatagcaaatcgccttaagaacaaagtcattcggaaaatttgcaagtttaaggcaagattctggcgaagatttccattccattcacataaacataaatgccatttctgctacataaaagcaaatcgccagcagcaaacaaaagctgaaccaagaaaaatttacatcaaaagaaaagaaggcctcacacctcacgatggtcttgcatatcttcgtctcttagtagttgcagtagtcggtcagggccgcggcctccttcttcgtcttttccaatttggcctttaagaccttattctctaccttcgcctatttaaaggcgtcggcgacaacctcattgtagggatacgcgcaggctatgataacataaatcaaaattttctagcacataaaccaggaaccatataagtattagatcatagatcgttaccactcgacatactgtgtccacattattaatttggtatctctataccatgatccatgagacatgatcatcaattaatacatgtgctgatcattaaacatatttgttccacatatgatatttgatcagggatcctttagaaatagtaacatacaacataaagagtctcatgaaaaaatcacatattcattaaccaataatgagttatctatttcaagaaacaatatcggataaatatgtaaacatagtatgtgatacaatcatctatatgattgcctctagggcatatcactaacagtctcccacttgcatatctaatacccattgccctagtgtgcgcctcatgcttagcctaagggagtggctttgtcaacggatctgcaacgttcaaatccatatgtattttgcatatcttcacatctcctctacccactatctcgtgaatgaggtgataccgccgtaaaatgtgtt

SEQ ID NO: 5383 - DNA, 1216 bp, Oryza sativa
  unsure (1)..(1216): unsure at all n locations
nnnnnnnnnnnnnnnnnnnnnnnnnnnnnnnnnnnnnnnnnnnnnnnnnnnnnnncatcggtaagaatcatttcttagagtcttacatgttgagcctcttcaacaccttgtcaatgtatgtactctggcttaatccaattagcctatttgatctatctctatagatccttatgcccagaatatatactgcttcccctaagtccttcattgaaaaactatttttcaacgatgtcttaacggattcaagcataggaatatcattcccaatcaacaatatgtcatctacatataggattaaaaaccacctctgccagttgagctcattggtccacatacattagtatgtactagtgccaatagttcacttgccctttcactttgacccgtgaaaggtgcctttgtcattttgccaagtaaacaagattcacatgtctcaaatgattcaaaatcaaaagagtgtagaagtccatctctatgaagcttctccatgcgtttctcatttataagacccaagcgacagtgccaaataaaagtgggattcaaatcattaggacgttgccttttcgcattaatgttatagactgaacatccatcaagattcacaatgtataagccattcatcattggtgcatggaaatagaaaatatcattataatagattgaacaaccattgtccactgatctaaaaccataaccctctgcttgcaaacaagaagcagagataacgttcttacacaaagcttgaatgcaataacaattatttaactccaaaactaatcctgacgataaagataatggcatagtgccaacggcaacaacaacaactcttgctccattgcccacgcgaatgtccacttcgcttcttgataagctcctacttctttttagcccctgcaacgatttttatatgtgagcaactgacctgctatcaaatacccaagaatcagtagaggaagtagcaagattaatttctataacattaatacctaaggtggaactctttccatcctgctgcatctgcttgaggtgctctaggtatttcctacagttcctcttccagtgacctgtctccttgcaaaagaagcactctgtatccttagcgggccctgtcttttgaaccttggtcttagagttgccagtactcgtgatctcatcagagtttagctttctcttttgaccagtcatcttgttattgggcttgcgcttatgcataacc

SEQ ID NO: 5384 - DNA, 761 bp, Oryza sativa
tagaagagcgaagccgccatagaagaaatgagagaagaccacaacctcgtttgtatcgggggtcggaaaagcctcaccgcatgctggccgccacccgatgatttccttgacagggagaacgccgtgcgccaccatctccttcaggttctcctccgtcacgtcggacggcgcccattggccttcaaagctttctttctcttccgccatcgattttacccgaatgcgctgatttggttcgagggatggctgtggagagatgagggattaaggcggtggatcacgggaaggattttgatgaactttttgaaggtggattcgagtgggatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagctcagtatttttaacagcgtggcccattgtgttccttagggacttaggcattttttgctttggcaatttatgcgcacaatagtgttgcccaatgctgataaaatcctttttatgcggtcatataattctttgaattattgcaatgcaaattaaaaggtgcccgacagaaaggtgttatactgtttttgtcagctttattaggctacaaaagcagtctgggttaacttggaatgacttgtttttaccatagtcatttccttggtatgttatatgcctg

SEQ ID NO: 5385 - DNA, 689 bp, Oryza sativa
tctctcctctctcattcctacttatcctctcctcctctcactttcctctccctctcaccttctccttctcctgtgccgtggcgccgtgtgcctccttctcctcctccgggcggctctcggcggcgggctcgcgatggcggtgggcggaccgggagtggcgcgtgcttccttctcctcctcctctgggcggctctcagcggcaggctcgacggcgagtggcgggagtggcggtgggtgggagcggcgtggctcgccgaccaggagcggtgtgcgcacgacagcaagctcgcggcagagggtgaccgggagcggcgtgcgcacggcgggtggacggtggggaggcggcggcgggcagacgggggccactgccaacgacgacgacggggaccggcggtggtagctgccccccacccagatctggcggcggtggcggtggggtgcccggatctagggttagagtttccattttttgaattttttttggatttttattttcccgtgcgggcggcataagcacccacacgcaaaaatagtgattttcgcagacgatttgctctagacgggccgaagttccgcacgagaaaatctgattcgaccgcacggaaaaatctgtcgtgtagatccatacaaaaaaaacttttatatttataggcgaaggtagtgtcacgcttgttctcattttcttttag

SEQ ID NO: 5386 - DNA, 1685 bp, Oryza sativa
  unsure (1)..(1685): unsure at all n locations
tgttttaatataacacggtaatccatataacacattaatccatttttcatctctctcctgaatatgatgccatcatatataggtggtaaaatataagcaattttgcaaggtaattaacttgcaacaagtgatagatgatatggacttgaattcaatagtcagatatactaccctttctcacaattctttggcctagtatcacagtaaatacagttcgctgcaaagtgacacttctctatgcgctctgggtaatgttcttggtggcattttcgaagcgtcatttggtataatttgattttggaggataatgattgtgtataaataaatatagaacaaacgttaaagttagaaattagatcttgttaagcagttaattagtccttaattattaatatcattgcgaacttgtatacttctctatgtctcaatatatagctacttttggctatacatacacataactaaaaatagctattttctaggatagagggtgtcggtgacatgggaccgggggtatcttggctagaggtttggggcagccgcggtcacccacgtggcctgaccccctcgggggggggggggggtcgggcccgagggtgatgtgnccgcccctccctctgtctccccgaggggtcgggccgctcccgtttcggcnccgagggctggggcgcnccgaccccctgtgggtttggctccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagccggagccggcgtgctgactcctggagttagcacgtcagtcccggctagattcataccaggtttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcagagggtcattcggacaacagccatggcaaatctccgcccattaatgagggagtaacagggagatccccggtgttaggcgagtgatgacgctgggcctcactcaaagacaagctgtgatttagcttccaggcgaaggcgcaagccagttttttcttttttgggaagatagggtgagtccccacccaaaagaagagtaggtagaagtggtgcatgtgggatccccttgagatataaaaggaggaccttgcccactttgaagaagaggggagctcggagaggagagaaaaagaggaagagggtctctagagtttgaactctcttgctctccagctctttgtaactccttcacacacagatccaccagaacacaggagtagggtattacgcttctcagcggcccgaacctgtttacgtcgcccgtgtcttgtgcgcttcttctcgctgacaatcctcagatcgggggcttagaaactcccctagcgcccccggccgaaccgg

SEQ ID NO: 5387 - DNA, 667 bp, Oryza sativa
attagcaaggtgttgcttacctattttgataattgtctagctgtgatgccaaagctcactagacactaataaaatgaggatcttgctagagggaattttgtttcacaacacatagtgggagtatctttttttaaattgtttaataaaagattaaatgtagacatggtgctaattttgcatatatatatatatatatataattgttctcaggtaagagcacaaagagtttgtgcttaaagagccttttccagctaacttgcccaacaatgctagtactgctcagcgtagggatcatgaaaagcgatgcaatgattatcttgatataagctgtctcatacttgctactatgtcccttgagcttcagaagcaatatgaaacattggatgctcatacgataatcatgggactacataacatgtttgaggaccaagcaagagctgagaggtttaatacctcaaagtccttgtttgcgtgcaggcttgcagaaggtaaaccagtgagtccccatgtgatcaaaatgattgggtacaccgagagtctagaaaagcttggttctccagtcgctccctcccagctttgagccattcatattgaatttcaacatgaacaacatggacaggaccttggccgaattgtatgggatgctaaagactgccgaggaaagcat

SEQ ID NO: 5388 - DNA, 601 bp, Oryza sativa
agcatatggtttggtaatggcctcaataaagctgaaacattatttccatgcccatagaatcatagtgcgttcgcaatacccaataggcgaagtgcttaggggcaaagaaatcactgggcgattgagcaagtgggcatttgagctatctcccttcgacctacactttcttgcaagtctcaagttctggctgacttcttagccgaatggactctagccttcttccccgaacctgagccgatcaaccaaccatgggtaatgtactctgacggcttatggtctcacaaggggtgggagttgccatgatcctaacttcgctaggaggcatgccgatccgctatgctgcccaactgcagttcgacacaacgaacaataccatagagtatgaagctgtgttgatgggcctgaggaaggcgaaagctctaggcgtttggcatttgctgattcgcacgaattccaagctagtggcaagccaggttgataaatcttttgaggtgaaagacgacactatgaaaaaatatttggaggcagttcgctccatggaaaaatacttcactggaataacgttcgaacatttacctagagggcataataaagaggcaga

SEQ ID NO: 5389 - DNA, 696 bp, Oryza sativa
catcgactccttcactgcggcctggaggtacggaaggttcaccacatcggcctccgtgatcgtcccattgcctccaagtgcggccttcatctctgctcgcgtggtggccatcacattagggttgcgcagcagttctgccatggcccactccaccgtgatcttggtcgtctcggtccctgctgcaaggatgtcaaacaaaaggattttcacgtcacggcgagagagcttgccggtggacatgagcacaaggagagagtccagcacatccttgcactggtcgtcggtgccctgggctaaacggcagtcaattatgctgtccaggatatggaggactcgactcatgtgtatggccgtccagtggcgaatgccttgcaaatctagcggccggagcagcgggaagaaatcggacgcgttcggcttcgcaagtattgcaacgatatcctccataagatcccttaaattggggtgggcatcgacggagagaagcacgttcgccaggaggtcgaacatgccatggtacaggacctggccgatatcaacctcctgcccagcgcggcgacggaagctgtccaccatgtcgtgcaccttacgctcgcgggcgctgcgcgccacgccgagactgcgtggcgagaagacgtgcgttaccgcgatgctgcgcagggtcttccatagaggatcgtagctcggcagccaaac

SEQ ID NO: 5390 - DNA, 358 bp, Oryza sativa
ctcttattctaaaaaccctctccagatcatcccccctccagcccccgatcgttctgggatcgtcttctctttttttttttctctaagtgggcaaggtcctccttttatatctcaaggggataccacatgcaccatctctccctctctttcttttgtgtggggactcatcctctcttccctccaacttgacttctcttcattaatggacggagatttgtatggctgccgtccgaatgaccttctgatgggacgggccatacctacctccacttccgccggaagcaggcgcgacgtgggaacatggctgtctgctgacgacatgaccattgtcagaccggtcacaaatcggtcattcttg

SEQ ID NO: 5391 - DNA, 342 bp, Oryza sativa
gccaacccggagaaagttactgcaatcctcaacatgaaaccgccaagtacccagaaagatgttcagaagctgactggatgcatggcggggctcagccgattcgtttcaagacttggcgagcgggggatgcccttctttaagctactgaagaaaacagatgattcccagtggggacccgaagcacagaaggcctacgaagatttcaagaaactcctcaccgagccgccagtcttagcttcaccacatccgcaggagccgttggtgctgtatgtatctgccacctcccaggttgttagcacagtcctggtcgttgagcacgaggaagagggccatgtccagaaa

SEQ ID NO: 5392 - DNA, 470 bp, Oryza sativa
ggggcgcctagcaccgtcggacaagcaggcggagggccagctccggccatcgggggcctcgggccgccgttcggctcgggggcctctcctgcctgctctctcccaggtcgagtcgacgcagggtggggatgcgcggagtgagggttgtctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccctccaggtaaacggcccggagcatttgaggagcttaaataggggcagtgccttctctcccagcctcgatatgaaccgacttagggcggccatgcagccggtgacgcactgcacatccctaagcttgctgggggggtgcatccgctctatagctcgtatcttctcggggttg

SEQ ID NO: 5393 - DNA, 2034 bp, Oryza sativa
  unsure (1)..(2034): unsure at all n locations
ctgaaagagtaaattacacctacggtgcatcaacttagcagatgggtgtaatttggtgcaagaatttgagaaatgagcgttttaacgtaacaacttggcagataggtgtaatttagtaccagaactttataagtgatcacataaatgcaacaacttgcaagatatgtacgatttcgatacaataagttaacaagttatgcggcaacttaattatttggagcacttttttatacatatttaatttttaagtacttattttgacaatatactagcgtggatttgtatattttaagtacctagcatatgcttagctaagtttatgtatcaaatactaaattgtcaagttcttatactaaaacgcacctacttatcaagttgttgcactcgaacgttcaattctcgagttattgcactgtatcgcacccacccccgccaaattgttgtaccatgtgaaacaaggaaacatctttgggattgagctattcccattatcggaacgaaaccattgtgattgaggttgcgccaggccatatatagcttagctctaaatatttgcaccagccagagacatgtttacatttgtttaagccagcatattacaatactcaagcacatttaatttgtcaaagaaaggaagtacatctatatggtactgatatcaaccatcaaatattctatcagataaatccaatagcaggaaagctcgttgcaacaacagaacagctcttacgctcgttagagagagaatagcttttacatctaccgattctcctagggagctcagcgaccccattagtgtcttgatagatttagacataggtacattgcaattactgcgtcatgtacaaatttcacaacccctgtatgaaaatttcatggcatagtgttgtggccaagattcgtgggctagaagaacataacactgattacaatgttccaacaacctgtgaccctaaatatcgacatgtccagagtcaatacattgttgataagctaatctaaaactgaaaaattgatgctgatgcagccacctgagattatttagtttttattaactagagaggttgccccctcccgtttctattaaagaaacatatatttttacagcagaacacctgagattatttagttggaagtggaaagtgatgtggcaacttcctagtgcatgcagtgcagagatggtttttttctgtacaatttcatttgcgtcaaaatttttgtttgaaatcagttttgtttagttgctaggagatggtatattggtagatatctccacaatatggatggagacaactgaaaatcagttcttgaaatttgatccccttttgtttggtgtccaagactcatgataatctaatacgtacctgcttggacgagctgtcctacatgcacattgctagtcattgagtaggcatagaaaagtgattttataaaatgaaaatgctttcatatgtgtatggatttagctctttgccaccataccatttcatcaacctatttcgatctaaactggaaactatccgtatcagcatttgtatatttaccagatttctacaggccccaccatatcctcatttcgaacagattgggagtggagcggataggacacaatatctgatctatttaaacctatatgaaaaattgtctggtttgaaccaaagacatactatgaagtactcctaggcgaaaatctatagtatgtgatactgttacatactgcatggacggaagtacaacttttgatctctagagaacttgaggtacttccctcgttcctctaaatacatagaaacaatatatacaatttttataacatttagtttgatttagctaggaaacgtatacggtataccatcctaaatgttcaagtcttaattcaacttgaatgcaatgtcaaaacattggagagacaaatccgagatataagcaatacaagtattattcacatccaaattgattatgaaatagaaatttgatgannnnnnnnnnnnnnnnnnnnnnnnnnnnnnnnnnnnnnnnnnnnnnnnnnnnnnn

SEQ ID NO: 5394 - DNA, 1371 bp, Oryza sativa
  unsure (1)..(1371): unsure at all n locations
cgtagaactcattgagatccatgaacgggctaggcccacccgccggtgaaacgagttcgttctcccccccccccacgatgaagggcataagctccgccctcaaaatctaaagggacaaaccgggggagggcggtgagggtgtttttagagtttgaactgtcgggggcgcgtttccctttcctnnnnnnnnnnnnnnnnnnnnntgcgcctaaaaagatcaatcttcgcaggcgacgcttatatggcccgcctgcaaagatgcccctatatagtcttcttcctccccgagccctgttcattctccccgacgtttctctctcctaaagtgacttaaatatagggggggaggttttgaacttcaaatcttcgggggatttttctacggtacttagatctactcatttccacactaggtatgcatttttaagcttttagaccttaatttgtgatggatttatgcatccaaaattttgaaggaagagctccatgttttttaattttatttcttgtcatatgtttatgttagatgtatgcgtaatacttgatgcctttttgtgtagtggtttaatgtggtaacataaattctcgttttttaattttttgctatcatatccaccacctagttctagatctagatctagatcttgtcatgtatagagagagaaaaaaattttaaatgtctattcttcggtggaatcacaaaaatagtaagagtattttgtaaaacccccatgaatttgattgtgtaagattttcctaatgtactaatttggcatgtctgtgtaaaaaaattgaaataaactatgattttttattactttacacttaacttttagttaattagtttttaatagcgataagtttttcaataaaccctacaaatttggtattaattgtgcaaatattttatgtgtattttttagagatatagaaagtcgggaatggatgtatcattggccgaggtttttatctccatatagaaacgaagtggctaaatttattggtattgccaaggttcacgctgagaagaacaatatgaggaagataatttgtccgtgtgctgactgtaagaatgaaatagcctgggactttgacgatgcttttaaagtgaaggagcacttagtaactcgcggatttatggacaagtacgaaatatggacacgtcatggcgaagaacatgtggacgagcctgaaaatgtagttccgaaacaagttgaagacatggtgcatgacgatggttctgttgaggacaaaatcgacctagaggaaatgttacgtcatgcagaacccgaggtgctgatggggtcggcaagagggctaaataactttgaagcttaacaaaaggcagcaaaggaagttttgtacgatgag

SEQ ID NO: 5395 - DNA, 1419 bp, Oryza sativa
gttattctaagggggaggtgtagaatatatatatatatatatatatatatatatatatatatatatatatatatatatatatatatatagaaagtaatgaaagggccacgtaatctgaaaaacaatggccatcggatgaatgtttggataaaagatgaccatccgatcatagatatccatgcagcaaaagaaaatacttttagcgtcttctagcgtctcccctttgacacatgaataaaagaggcacttccctccggtttcttctagcgtctcccctttgacacatggcaaggaaaaaagagtccacaacatgaaaaatacactataggatattgatttgcatggaaaatgactacactactgtttgatctcgtgctgattaattaaatttgagaagtgaaataagtaaaacaaacatacatgaattggtgttgtgtaaaaaaaataaagatattgctgtagtagtatgtaatttatgggctacttcgcagtagtaacatttaggggcaagacagcaagaccactataattgtaaaaaaaaaatttaagatctttaacaaagatgcatctcatggtcgcacaaatgcacaactttgagtggctaatatgtaatggaaacctataaaaatactgtaggatgtaaaaatagacgtataaattaaatttgtacatgtcataccaagtaaaacttttactcctaaattaaaccataagtaaaagtttcagttaggatgacgtagataaatctcaaacatccatttttcatcctacaatagataaacaaagtcaagaatgatgtcccatgcatttacacaacaattttttatctaagggtttgtgtttaagaggaggagaacagagaagatcgaaaaaaaatacacaaaacgagttgtactattacgcatgattaattgagtattttttaaaaaagatttaaaaatgaattaatacaattttttaataaaattttctatagaacttcttttgaaaaaaaatacatcatttagcagttcgaaaaacgtgcgcacgaataacaatgaagattttctcccaaatcactattgccgaacacagccatgtttttattcaaatagaagttactgaaggattttcaatttgaaattcttgtggaaaaaacttctaaattattatatttttcaatccaaattgcaattaatcttatgatgtattaattagttaatcctaaattgcatttgatatgttctttctggtttattgagaccaacattgagctgggctgcaaaggaaattaatatggaattatgaatgtgccttttttcgctatttcaataatatgatttatagtagaacgatgttaaaagaaaactagtatatatatatatatatatatgtatatgtatatgtatatgtatatgtatatatatgtatatatatatg

SEQ ID NO: 5396 - DNA, 604 bp, Oryza sativa
atggggagcgtcgcctcctcgtctacggcgacggcagcgcgccccagggcgcgctccaagctgcgggcgcgctcctgcgtcacccgcctgtcgtccctgacctggagtctccagcccaacgatgactggacgacgtggccaacttggtcatgacggcacagcggcgcctaggtgctggtggttggtcctccgccaccaagacctctggcgctgctaccaccggctccgtgtcgtcaaggcggagggcgcgacgagcggcggctgttgctcgccattcggctgccactccctcgtcagcgcctccgacccgggaagatcagcgtggggggccagatgcccgcatcgatatcgagcgccggcgtaatggtcggcgtgctccccacgcaacggagggcgcctcctcgtccggagagtcacctcaacacagacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgc

SEQ ID NO: 5397 - DNA, 1594 bp, Oryza sativa
ccaccgaggtgaacctgatttccaggtttagccctttgcacatctctctgaacttgtcggagtcgaattgcttaccattgtcagtgataaattcctttggcactccgaaacggcaaacaatgtttttccatacaaatttctgtactgctgccgaagtgattgccccaagcggttcagcttcgatccaacgggagaagtattcgattgctacaattgtaaacttgtacccatttcgtgctaccgggaaagggctgatgatgtctaacccccatctggcgaaaggctagactggtgcgataggttgcagctcataatgggatgctgcttggcttcggctataccgctgacagctttcgtacttcttagcttgctcaacacaaactttcagcacggtgggccaatacaccccctggtgaaacactttggaagcaaccgttcttgcggcttgatgagcaccgcacagccccttgtgtatttctttcgccatttcctcgccttcggcaaaggagatgcagtgaagcaggggttggagcaccccggtgcgatacagctgccctgagaccaacttgtatcttgcggctctgagttgtaggcgcttcgcttctgcttcgtcctccgggagccaaccgttcttgaggtactttatgaacggtgtttgccagtcttcagggtcttcgcccagttctgcctggtcgattgccatgatgtccaggctctctgtgggcacaattggtgtgtacaagacttcaaagatgatgcctggcgaatgtgggcctccacaagcagcggatttcgctagggcgtctgcttccttggtctggcctctaggtaagtgttagaccgttatgccggtgaaacacttttccatagatcgaacaacctccagatacctcttcattccttcttcttttggtcaaaaagattgtcaacatgacttgcctccagcttggagtctgttccgatgagcaagcgtcgaacccccactgctttcgcctttcttaggcccacaagtacagcttcgtattctgccgtgttgttggtcgtgtcgaactgcagccttgcagcgtaccgaatcggcaggccccctggggaagcgacaactgctacggcgctcgcccccttgtgcgaccacgagccgtccgagtacatcacccaaggttgtttggcaggctcgggtttaggggcgaatgctggcgtccattcggccacaaagtcggctaggatttgggacttgatggcagtacgggcgacaaaatgcaggtcgaagggagataactccgccgcccacttgctgagccggccagtaatttccttgccccggagcacttcgcccaaaggatactgtaatggcacagtgactttgtgggcctgaaagtagtgtttaagcttgcgcgaagccatcactagggcgtaagcaagcttttccatttcaatgtatcttattttcgccccttgcaaagcttcggagacgaaatacactggtttctggcctgactctgtctcttggatgaggattgcattgaccgccactggcgaagctgctagatagagtagcagatcgcttcccggtgctgggctgaccaaatcgggtggg

SEQ ID NO: 5398 - DNA, 292 bp, Oryza sativa
agtacgcatccaaaaagctcatgagttcccagccagctgtagaatcaacaagctggtcgatccgcgacaggggaaagtcgtctttcaggcacaccttgttgaggtctgtgaaatcgacgcacaagcgccatttgccgttcgacttccacaccaatatcgggttcgccaaccactcggggtggtcgatctctcggaccaccccggccttgatcagcttttgcacttcggcttttgctgcctcttggagatcagcggacatcatgcgcagcttctgtttccttggcctggcatc

SEQ ID NO: 5399 - DNA, 367 bp, Oryza sativa
ggagctgggcaattcggtcccttaattccttctctgactttttggcgagctccttggcctcatgtagctggtccctaactgctttaagagttccaaaatgaggaaccagcttttccaaagttgtagtcttggcctcattgcgaagatggattctctgcatgatgggtcatggtttagttctgctaaagagagaacaaagttattaaagacagtcacccggaagatttacattcacgatgcgagtgggctctccaagtgccttcttcaactggcacacttcctcatcttctttttgacgatttatgacgatgccggcgacttgtgagttctcgtcccaccatttgagcaagataggaggacgagagtc

SEQ ID NO: 5400 - DNA, 805 bp, Oryza sativa
tgccaaaatatatatattacaatattgttttacattgtcactttaaataacgtcatctagttacattatggcatagtagtgttccactcctgaagatccttgaattcgtcacttgccgctagggcaccctctgggtcgaagaaatctcttttgacatgacagcactcatggtggatgaagtggcacagatcacgctgcacatttgtgatacctgtatcgtcaaagcttgttcgacattctaatcttggcaactgcatgtattgaaattaatcaatatattagtatcaaaaatatcaagagctgtctagtacatagtatagagacttacatcctccgcgttagtcctgtaccgtccattaaccttaaggaattcgcacgcataatacccgcaaaggaccgttcctcgcggttgcttgtgacactgaagaacatatcatagaaaaaagtagttataatttgcaattagtgaaactattggaatatataaagtgagtggagtattaccggccaataggtacgtactagcagcttctcccgtgttcgggtctgttctccacccttgaacttgtagtattggtatgaactgtatggatgtcataccgtttcagagtaaggaggatatttatttgtaatacatccatatacaaatgcaagagtcataataacttactactgtaagatggttagaaattctttgtattgcttgtgattgtaatcgagaggatccaagactaccacggttccgtctttagggtggatgagtaaacagatataatgatcgctacatattaacaacattattatt

SEQ ID NO: 5401 - DNA, 392 bp, Oryza sativa
acgcacagcggttcgcgcaggaaatggcgaaagccactgaatccgccaagaccgcttgctgtacacttcgccttgccctcactgacatggggggcaaaggtgcgaggagtccctagcgaagatgcctccgcttttgacttctcggagtggactcaacagcccggccttgcggtctctgattgcgtcaccgcgtacggcgattgttgtgcacgtgtgtcggcggctttcaccatgggactgctgcaacagttcgggagcgagcacatcggcgagtttccaaaatttgcgaagggggactgggaggtcagttctcaagatgtttcgcctgcactccatgcctggcgtaagtagttcttgcaaaaggatgggcgatctactgccaaggcgcgtct

SEQ ID NO: 5402 - DNA, 509 bp, Oryza sativa
cgaacgtgttgacgcgcgagcgctgtcgagaagagtgggtggcggttgcaacaagttccgcaggcttacgcttgcggtccttattgttgttacttccacctcctcccggagccggcgtacccttgtttggcttccaactgggacccgactgctttgatgcggtgacgacgtcttcagctttggcgtactcgttggctttttcaaacataagcttgactgtcctgggaggcttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaataacgttgtagaggtcgtattgtgtgccgggacgctcgaaggtgccttggaagttggcgatgaaatggtcgcgtaattcggcccaagatccaattgtaccacggggcaatccatggagccaagatcgggcg

SEQ ID NO: 5403 - DNA, 513 bp, Oryza sativa
cttatttttctaacccgtttgcatcatggcgttcgtaaaataatgtccttaacgaaactagaaccatcataactatttttaacgtcgttactgcggaaagtagtcgtgttactatacattagccgtcgcgttactacgccattctagtgagacgaggattaaaaagaggtaaatcccaatctttagagaacaatatctctcacatcatatcttgtttttttaatttgtttgcaccatgacgttcgtaaaaaaaagtcttaacgaaactagatccatcatgactactttttgacgttggtattgcgagaaagttgtcctgttactgcacgatgaccgtcctattactgcggaatttcttgtgagacgagaagaacaaagtgatgggcgggggagggggtggtgggcaggttttgattcgggtttgacctgcgggagggggctttgaccagcctttgactgaggtgggaggggggatttgtgccctaggaagagtgggggaggtgggattgaccc

SEQ ID NO: 5404 - DNA, 257 bp, Oryza sativa
cagccgcgctgacggagcgtggggctcctcaccgggagaccgcgcaggcccccctttgccagttcggccgggggccctgggtgagattctaagctcctagtctgtggaaagttcgcgagagtggaaaaagcacaagacacgggcgatgtatacaggttcgggccgctgagaagcgtaataccctactcctgtgttctggtgaatctgtgtatgaagaagttacaaagagctggagagccagagagctcttattctaa

SEQ ID NO: 5405 - DNA, 473 bp, Oryza sativa
tccggtggagaagccaggcttggcgcgagaggcgcggccggtggtggagtagtcgacctcggtgcgaggaggagctgccggtgggtgtggcgcggtcttcggcgcatgaagactggctggcgaaggacgccggtgcaggggtcccgcatgtcggcagagctggagaggtggtggagcatcggtgcatcagccaaggacatcttgtctgtgttcctttgttagtccaccggcggtcggtcacgcttagcggcggccggtccggtgctagccttctcccgggttgtgtgttggcgctgttggtgtgcgggtggtggtatatttttttccttttcctagttacgactctccagagttgtaatcttgtaattttttcctgctttatcaatagaccttcgcaccgtaacgtccgagtcgttcaaaaaaaaaattgtacgcctgtgtgcatcacatgatgcagaggctgggatttgtat

SEQ ID NO: 5406 - DNA, 533 bp, Oryza sativa
  unsure (1)..(533): unsure at all n locations
tccctcccctcctccccctccaccttgccgccacccgagcggccgccgcccgagaggccgccggcanagccggccggccgcaaggacggcggcggcggggcttctcgcatcctctcttccgggcgggcagggggccgccctaggcagagcggcggtgaccgctagatccggcccgctccggctggatctggtgggacggcggctggcggcggcgagggtggcggtggctgaagacggcggggatggcgacgtcgatgctaagggcgcgcgacgctgggctgcggtggctgaaggcggcggggagggcgacggcgatgctaagggcgcgcgacgctgggcggcggtggctgaaggcggcggggatggcgatggcgtcggggacagagttggccgatggcgcgaaggcggcggtggtgctcccgtggcggcgacagcgcgaaacctggcggcgacggcggcggtgccccccagatccgcccctctcagccagatctggagggtggaggcagttggcaacggcggcgacagtgtgg

SEQ ID NO: 5407 - DNA, 912 bp, Oryza sativa
  unsure (1)..(912): unsure at all n locations
aggatacggcggatcacgagtggacttacctcccctcgtcgtgatcgctttaacattttcaatggaggagtctggttgccccggaatcctcctagtttcatttgcagggactaaggatgccaactgagctaactaagtttccatcatcttattaaagctcagccggttctgaaatgcggaagcaaagccatctagtttgacatttatgttctctaagatctaatcattggcagcaagctttttgcttaccgcatcagtggttttagcttgcgcaaaaacaagatccttcaaggagggttggttacagaagttaccgttattatttcctccttgataatatggtcgtgtttggttccacccctgacctccttgtagacgatacccgttgctgttgttgcccatgtgcatcgcctcctcacaggtttccgggcagtcgttcccagaatgacccatgccgccgcagacttcatacatgacatgtgagtccaaggccttggcggtgccttgtggccgtttcttgtggtcgtccaagcatttcatgaggaggtccagcttggtagcaagtagttctgtctccttgatggtgtgcatgcctcgctgacgggtctagagtcgttcctcgctccaacccatatggagaccatcttctctatgagttcaacggctccttgaaccgttttagagaagaacgctcctccagctgttgtgtctaggtgatcgcgggacatcgaggtgagcccattgtaaaagttctgcaggatcaaccagtcgtccatcccataatgaggacaggtggccacgtactcctgcagtcgttcccatgcttccggaatggactcgtcccttgtctgctggaaactggaaattcgtccannnnnnnnnnnnnnnnnnnnnnnnnnnnnnnnnnnnnnn

SEQ ID NO: 5408 - DNA, 15087 bp, Oryza sativa
atttgtgatgaattttgtagaagttgtgatgtaattttttaaagattttgttatgtatttagagattgatttgagaatttagagactattcggggatgattgatttgggattttgggatgagatagagtgaatcaatatattaaaaacaatgaagaaaagaatagaataaagtagcagcctgagctagcctctttagtctagaaatggatttttactcccggtttttttcacccgggactaaagatagcgatctttagtcccgaattcatagtcccggttagaaaaccgggactacatgggggttacgaactgggagtaaagcccctttctccaccagtgaaataaaactattccttaaggaacatttgccaactaacaaaatttgctatgttgttttcaaagataaccctattttggtgtgcactggactatgggggcatcctgctaaagctggaggagtgctctgtaattgctatgttgttttcatatgttggcagcggttggtccgagcttgttttctcctgatcactttgcaagtcgagctcagtgtcaggacgaaagttcgtctcgccttgatactcgtccatggacacttggtcatgggactctgcttgctcatcactcgacgcgcactcgttggacgtgcatgttgacggtcattattgatcagtttcgaccgtcaatattactaaaatagaggagaactagtgatgcttgcaatgcatatatttgttagaataataatattccagtagtattaggtatactaaccttttgcagagaatgacaataaagtggaggagaatcgatatcaactcaggcgataaatcaatcggacgatgtcgagaatcagacttatgcatgaataggccaagaactcagaattaacacgtcaaattgggtcccaaaattcacaagtctacataaagtagcaacagaggaggccgccagccgaaaggtgggctggttgggccgggcctaacctccctcgcctccgttggatccaggttttggctggacggttgagatgaagccccaatgatggttggagggtattaccgaccattccaaccgtcacaaccatcatagttcagctgtaaaaggagctcctcttctcacttcactcacacacctcaagcaatagctctctcatttctttcaaatttagtttagtagtatctagctggtggaataggaatagaatagaaatcaggagtccggaagccttcagaagagttcgggtatggttctagtagctttcctcttctcttttgtaagctttgtacttttattataatactcttctatatacatttatggtattgaaataatttccgagtatatgaatgcctactttacattatgttcatgttatactgaatatacggcaagcttctctgggagaagctttggtgcgggtataatgtttgcacatgcaattactctatgtcatgacgataatattagagtagtatctggtagtttagacgtggtgtctagattacgggatatcattattcggggttatatattgcggatgagaggcgggctgctgatggtgacagctcagtacaagtattcctccgcgtcagtatataatcctaagttaattccctggggagggtattcctccgtatttagccccggttgtatggtcatgacgggttgtcgtaaggaactcggcagtcaggggtggcttctcgaagtaccgggagggcatcggatagagggtattagctagtatatcggttaactagaatgtatgtatactatgtatattataagtatatgaatagattttctttctcttttctttccacttagcttagataatatattatgagaataagtagttaatgcttgtgtgtcactctacccttggattatttttaacccctgcttagaatatgattatcacaagtaatatataaattattagtcaagttctctctacatgatcttcccacgggataaaataaatacgataccttagaatactctcgggtgaaatgctacgatgatatatccatgtgcttgcagatgaactctgtaaccataatataccaggagtattttcgcaccattgttgggaattatatttctagtaatgttgttaagaaataccaacaagcatttttggcgccgttgcggggaagattcataatagagattacctgaactaatactttatatttacctctatataatcattttcctttgcaggctaaccttggttgttttcactttttattgtgaaaacagggtagtgcatgactagtttcaacttgccggaaaactttaaagaaaatccagaagctttcttctggagcgtcagtccgcgagtcgctgctccgcagaaaaatctaccgacagagaaaccagtcgtaccagcgccaccaaccttcaagactatggctaacaagactctccgcgagttcgctgctccctttgctgacaatgtggccattgggccgcagatcaacatgggagacgtggattttgacttgaagtccagcctcatcataatggcgcaggctagcccattctgtggcaagcctaatgaggatgccaatgctcatctgcaacagttcctggagatctatagcatgtacaccatcaagggcgtcagtcccaacgccgtcaggctgtggctgtttccgttctcctttctcgggagagcgaagcagtggttctatgccaatcgtgctgctgtcaatacctgggacaaatgctctacggcattcctctcgaaattcttcccgatgggcaaaaccaatgcccttcgtggaaggatttcaagtttctagcagacaagggacgagtctattccggaagcatgggaacgactgcaggagtatgtagccgcctgtcctcatcatgggatggacgactggctgatcctgcagaacttttataatagactcaccccgatgtcccgcgatcacctagacgcggtagctggaggagctttcttctctaaaacggttcaaggagccgttgatttaatagagaagatggtctcaaatatgggttggagcgaggaacgactccagacccgtcagcaaggcatgcacaccgtcaaagagacggaattacttgctgccaagctggacttcctcatgaagcgattggacgaccacaagaaacggccacaaggcaccgtcaaggccttagactctcacgtcacgtgtgaggtctgcggcggcacgggtcattctgggaatgactgcccggaaacctgtgaggaggcgatgtacatgggcaacaacaacgggtaccgtccacaaggaggtcagcggtggagccaaccacatccatattatcaaggaggtaacaacaacggtaacttttctaaccagccctcttcgagggatctagtttttacataggctaaaaccactgatgcgctaagcaaaaagcttgcagccaataacaagatcctagaaaacataaatgtcaaattagatggctttgcttctacttttttcgcgctgtgatgcaccccatctcccaaagtgttgaccctaccgagcactggggatctgggtggaggctataattcaatagtggtgtcattgcccttgcctactttatcttacgtgagcaaagaaagtttaggggacaaggcgaatatgaagttgtatgtaaaaaataaaatcattaaaataattgattcgatagtgtcaaattgatttaacagtccaatatgatttaggtgccattgaaactagtgacacttttagtactcccttcgtcccaaaataaacgcatatatgaggaaactgggtttcctgttcaactttaatcgttcgtcttatttaaaaaaatagattggaatttgtattgatattagattataaaatatgaatagtgttttatgcttgacttatgtttttatttttttaaaaaaataaataagataaacaattaaagctggacacgaaaactcatggctgcgcttattttgggacggatggagtaattaatctactcccttcaacccacaatatagtattctagttacctccaacccacaatatagtattttataactagatgagacatcatctgaaattacatatgtgatgtacccacttcgtcccataaaaaaacaacttagtaccggatatgacgcatcctatcacaatttgaattgatgcccgtgcatatacatagtattaggatgtgtcacatcttatcctaaatttattttttattggacatggaagtatgtgaataggctttaccattctactatggccttgtttagttcccacgtaaaaacatttcactatgtcacatcgaatgtttggacacatgtatgaagtattaaatatagacaaaaataaaaactaattatacagattgcgtgtaaattgcgagacgaatcttctaaacctaattgctccatgatttgacaatgtggtgctacagcaaacattttctaatgacatattaattaggcttaataaattcgtctcgcagtttacagcaaatttgtaatttgttttgttattagtatacgtttaatacttcaaacgtgtgtccgtatatccgatgtgacacactaaaacttttcacccctggatctaaacatagcctatgtatgtagacagatctgtccatatatgtagtactccctccgtccctaaatataagggattttggtttcatatgacataagtctatttagattcgttgtattagtatatgtcacatctcaccaaaatcttttatatttaggaacagagggagtattagattatatcgagttgacatgtgacagagagagtacaatagtggcattttaatgtttactctatctgtcatatatatgatacattctaataatatgaatctatatatatctctggctgtgtttagttcagcgcaaagtttgaattttggttgaaattggagatgatgtgactgaaaaattgtgtgtgtatgacaggttgatgtgatggaaaaggactgaaaatttgttatactagaatgtatcatatccgatccaaggtttttttttaatggagggagtagttcagtaattgaggccatctaaaccagagggtagggtggattgaaatcctctgccttcaaagacacaatgtctttgtcactgacagatagccccatagtttattgggcccacatgccagtgacaaaggtagtgtttagattcagggactaaaaactaattacatgaatgagagctaattcacgtgacaatttttaagcctaattaatccataattaatacatgtttactgtagcatcatatatgctaatcatggattaattaatcccaatagattcgtctcgtaaattagttcagagttatgaaatgagttttatcaatagtctatgtttaatacttctaattagcgtcaaacatcgatgtgaaagagaaacaatttttagtttcatccgaacagccccaaatgcacataaatttgaagttaggctgtgttcgcatgagtgggatggaaacttgttagctccgctcgaaaaatgaagcgatccattagcacgtaattaattaagtattagctaatttttttaaaaaaaatggattattttaatttttcaaagcaactttcgtatataaactttttttaaaaaaaacacaacgtttagcagtttgaaaaacgtgcatgtaaaaaagagaaagaggggttggtaacaagggttgcaaacacaggcttagagtagcctgatccgttcttgtcagtcttccccttccccagctctccatcgaatcgtagcttgttgaaggtggaagatggaggccgcgcttctgagcggattcatcaaggccatcctgccgaggctcttctccctcgtcaacgacaagctcaatctgcacaagggcgtcaagggcgacatcgatttcctcatcaaggagctccgcatgatcgtcggcgccatcgacgacgacctctccgtcgaacatggcgccgccgccgccgccgccgccgtatctccatcgaatcgtagcttgttgaaggtggaagatggaggccgcgcttctgagcggattcatcaaggccatcctgccgaggctcttctccctcgtcaacgacaagctcaatctgcacaagggcgtcaagggcgacatcgatttcctcatcaaggagctccgcatgatcgtcggcgccatcgacgacgacctctccgtcgaacatggcgccgccgccgccgccgccgccgtacagacgctatgcatggaggacctccgcgagctcgcccacggcatcgaggactgcatcgacggcgtcctgtaccgcgccgccagggagcagcggcgctcttcgtcgcttctcccccgcacggtccgggcaaccaagaagttgctacagacaaaccagcatctggcccaggagttgcagcggctgaagaggatggtggaggaggcgaaccagcggaagcagaggtacacggcggcggcgcccggtcaacacggtcaggtctactcatcggctgcggcgcaggtggatgagccgtggccgtcgtgctcatctgcctcagatccgcgcatccacgaggcggacctggtcggcgtcgacgcggaccgggcggagctccttgagcagctggcggagcggcagccggagcagctcaaggtgatcgccatcgtcgggttctgcgggctggggaagaccgccctcgccgcggaggcgtacaaccgagagacccgcggcgggagattcgagaggcacgcgtgggtttgcgccgcgcaccggagtgcacgggaggtgctcggcgaattgctccgcaggattgacgccgcttgccatggggactccgatgctggccagctgtgtgtagatatcagacaacagttggagaagaagaggtgaaaaatctcaactttctgcttgaattgcctgatccatttttcacatgaatttgaggtcaacattttagtcaactcgcctgttcttttgcacaagttcagtgcgactgacactttcaatagcaaagtgaatcatgaacagatactatatcttgctaactgctaggtgttagctgcactaatttagtcatcaaatgcatacagtgcatttctcatgcgctttatcttttacaaatttactataatagaataaaaatggaaaaaacaattcactgcttctaaattgctctaccgtatgaaattatacaaattattcgtttcaatttgttgattactgtggctccagatggggatgtttacaattattctttcttgatctgcctcgtcttgcaggtacttcattgttatcgatgacattcaaacagaagatcagtggaaaagcatcaaatcggcttttccgactgataaggatattggcagcagaatagtggtcacgacgaccatccagtcagtagctaatgcctgctgttctgcgaatgggtatttgcacaaaatgagcaggcttgataagaactgctcaaagcaattgttgtccaagaaagcttgcccagagaggtattcacattacaagcagccagattcagcagcaattttgaagaaatgtgatggccagccacttgctcttgttaccataggtgaattcctgcaagctaatggctggccaacggggcctaactgtgaagatctctgcaatcggctacattatcacctagagaatgataaaacacttgaaaggatgcggcgagtgctggtccgcaactacactagtctacctggccatgctctcaaggcctgcttactatattttggtatgttcccatctgatcatccaatcaggaggaaaagtctgttgaggcgatggctggccgagggatttgtagaaccagtgtcttcatctagtaacctagattccacggctgctttcgatgtgctaatggaccggaacattattgagcccatcaatgtaagcaataatgataaagtcaagacatgccaaacgtacggtatgatgcgtgaattcatatcgcatatgtcaatctctcagaactttgtcacctttttctgtgatgacaagttcctgcccaaatatgttcgtcggctttctctccatggtgacactgttgtgaatggcgataacttcaacggtattgatttatcacttgtacggtctctggtagtctttggggaggcaggtacaactgtattagacttcagcaagtatcaattgctgcgagttttagatcttgaaaaatgtgatgatttgaacgatgatcatctcaaagaaatatgcaatctggtgcttctgaaatatctgagccttgggggtaatatctccaaacttccaaaggatattgccaaattgaaagatttggaggcactcgatgtaaggagatcgaaagtaaagataatgccggtagaagtcttcgggttgccatgcctaattcatctgcttggaaaatttaagctctcagataaagtcaagcagaagactgaagtgcaagagtttctctcgaaaggaaaaagcaacttgcagacgctagcaggatttgctagcaacggaagcgaagggtttctgcatcttatgaggtacatgaataagttgagaaagttgaagatttggtgtacgtcgtctgcaggtagcaccgattggactgatcttagggaggccattcaacagttcattctggatgaaaaggaagcaaatattggtacccgttctttatcgcttcatttcactggatgctctgaagatgcgataaattccttaaaagaaccctgctacctcagctcgttgaaattacatggcaacttcccccaattgcctcagtttgttacatcacttcgtggtctcaaggagctttgcctttcatctactaaatttacaacaggccttcttgaagccttgagtaatttgagctacttgcagtatctcaaactggttgccgatgaacttgagaagttcatcataaaagttcaggggttccccaggctgctatgcctttgtattgtgctacaatgtccaacattcccagtaattgaagaaggagctctgccatttcttgtcacacttcagctgctatgcaaagatctacatggcctttctgacatcaaaattgaatgttttaaacatcttcaggaggtaactcttcattctggagtcactccagctacaagacaggaatgggtaaaggctgctaaggagcatccgaataggccaaaagtattgcttctcaaatctgttgatacagcagaaagtgaacatacagacgttgatagtgtaatggaggcagtcaaaagtgagactacagaatattctattgcaccagagggaccagaacaagtgattgacatgaacaacaaaatgcaacttgaccatggattggaatcctcttctgtgctgaacaaacaaaacaattttgcagaccaatcaagctcaaaagatcaactgcattattctttcaacaatatggggctttcagatgtctctcctgctgtgagtgagctgccgaatggcatggtgccttcttgtacatgacaaggatctagaatcttcacgtggcttcccggtcagttatttggacctgttgctttctgattgtgcattttgtgtttacttgtccttcacacaatcatcgtcatcaaaatacctttgatttcctacactccctgttacctcccttgatgaaatcagggggattcatgggcacagctacatgttctgtctgcattttgtatagtgacgtggcatacctagtacttgttttgtctccatcctgtttggcagagcaacaggttgtaataaatcttggttctaactggctgccctcagaatatgttgtctatagaatccacctgatagggaattcggccgtttgataatcctttatttttaagtctattgtttgtcctgagtatatttatgatggttttggtttgaggagcgcagtgaaatcatgatggaatggcctagtatgggatgatgctttgatggatggaatgatttgacgaatggaatggttttgcactttgtttggttcaaaaaaatgacaacattgaatgtgaacacaaatacaaaatttgttaaaaaaacgaagcatgaggtgcggagtgttatagcaacgagagttcagttccctgttgtatcatcaaagaggaattgaataaaacttataattttctgtgtcgaacacatgattggagagtggaaacaatgttttctccaatattttgttatatcatgattacaagtacaaaaggagatggaatctgtaagaacatttatttcgagatgagaatctctttcataggatcttatttcttgtagctaagaagcataaatgataaggctcatacatctcggttgctccagtgcctctcccaaactgacgaccatgttggaaagggagagatctggtattttaaataggatgttagaaccagaacaatgtcaatgcaattatacatttttagcttgaattatagccataccttgtctacaagggagtatggtgctcctcaactgagcatattgacaatttcccctatagaaggcctgtccttccggttggtctgaacacagctcagtccaatttcaatgcatgtctttacctgctggaggcaatttgtgtctaacgatgggtacttcagtgatatatgcacaatattggtccgatttcggcgtacctataaacaacgacagcacacaaacttatatataacattattctaaaagaactccttagtatgaaaacagtaaatttgttctaaaactggtacagtcattatttttgccttacattctcaatgaagttcttagcaatgatgtcctctctattggggaagtttttctcccctgttgtgatctcgataattagaagacctaaactgtatatatctgattgagtggagatttcacctcgatataaatattccggtgccatgtatcctctgtataatatcagcatcaatagttggaggattatgtgactaatgcaaatgaaattcaccttgtaggaaaactacaaaacaatagacattggaatgtgtttggtgacttacattgctcccatgacattttgtgtgcaaactctggtttgttcttcacccaagagccttgatagaccaaaatctgcaatttttggcaccatgttgtcatccaatagtatgttgctaggtttaatatccaaatgaataataggtctttctgatcctttgtgtaggaaatgcaaaccctcacaaacccccttaattatattgaagcgtgtgtgccaatcaagtcgacttgattcacctgaagaagcaattatggaaaacaaataacattaggattaatcgtattacttactaattgccaaaaaacacaaggaattttcatgagcccacaacctagtgagagcttgatcttcttacctttttgacttattgtatacttcagtagaacctagagtaggctacatcatgctaatatctaaatcttgtaaacattgcaaacagggaaaatgactggaaatatttaggtattgcattatcataccgaaaaggtgtttgtcaaggcttccattagatatatattcatagcacagcagtttttctactgcctctgtaagaatatattttccattatgctccaccaccttcttttgtatttcataacagtagccaattaacttgactatatttctgtggttgaccttcataagactcccaacctcatttttaaattgattgtcatgaatcggtgatgtttcccgaagcttcttcgcagcaatttctgtcccatctttaagcattccctgttaagtcccccatacaaaattgacatcttttctgtgaacttttgaaaatgctgagaataagggcctgttcagattgtagccaaaataaaccttacaaaattttggtaagatggcaatattgccaaaattttggcaggatttcttatgtatttaccaaatttggcaacaaacattcattttttagcaactttgcaaaaaaaaaaatgtgtggctgaaaatggcatcaaagtgaacaggccctaaaactacaaaaatcttaccttatacactattccaaatgcaccttcaccaacttttcgctcatcagagaactcattagtgatttccttcagaaattgtgatgatagctcaggtgtcggtatttccatttctgattattgagcactaacccaataatagaaaactagagtcacaagcaaaataacacaaagctaagaaaacagagaaaaaaattacaattgtttgagacatagaaatatatgatttctcagtattatgtgaaagctgcttctgagtacccttcatgcttcagtagtcagtatggcttttctgatattgttgctagctggtgtttcgtagttcataaatattagtctcacagatattgaacagaaacaacttttgaatgcactagcattgagtagtcagtatggcttttgtgatatattgttgctaactggtgtttcataattcatattactgttattcaaactaacaagctttcaaattcaaataaaaacaagggtttctcacatactgagtcaggatgagctttcctcaaaacacacacacacatggacatacctaaagaagtaaagaacggtgtaatgtttcttagcctttgaacagaagcagcttttgaatgcactaacctggagaagctttgcagctgcagaggtgctagctgctgctcacacaacaaccaaaggacgcagcagggcagaggagatgaacggatttcttctccagggaagagaaggggggggggggggtgtgaatactgggtaagcaggagctgaaatgaagcatcagcagtacaacttggcaatagttgacttgactccaatattagatggatgtgaaatggtgaatatgatatgcctggtgtattttatgagtatacagacaagttgtttagtcaatggtcaatgatggttccattaagaggctgtgtttagttcatcgcaaagtttggattttggttgaaattggagatgatgtgactgaaaagttgtgtgtatgacaggttaatgtgatggaaaaggactgaagtttagatctaaacacagccagagtttagtggcacttaagttttggatatgatgtcctattgtcgtgacagcacatgctacaattactattttttagggggtggggtggggggtggggttgttgttgttgttatcatgttccatatgcgttaatgaattaaaaaggtgccatgttattttttctaccgaaaacctgaaatgtggagccgattttgatgtataaatttatgaaattttgattataaatagtatgatgaactgtactatatgaactaaataaacttctccctttgttcataaatacacaatgtttgatttattttatagttttaaaaatacaactttggccataattatatattagaatatgtttatataaactagtaaattcatgatatctgacactactttttgtgacgacttcacacgtgtaagctgatgatcttcttatcaattggggatcctaccgagtcattagagaagaagaatggggtccaaaatgaaacacaaggaaaaaaaattgatggtataaagtgaaaagattagttaaggtggtgtttggattcagtgacttactttagtctctgtatttagacactaatttagagtattaaatatagactatttataaaactaattacataaatgaaagctaatttgcgagacaaattttttaagcctaattaatccataattagagaatatttactgtagcatcacataggttaatcatggattaattaggctcaatagattcgtctcgcgaattagtccaagattatggatgggttttattaatatactacatttaatatttataattagtgtccaaatatccgatgtgatagggactaaaagttttagtcccatctaaacagggtataagacgtattccaaattaaaactttggtaaccattctgcaatttactttagaacttcctgatgttcgaagttgtaaaagtttgaccaaatcttatcaaacattgaaatatttataatcaaatggagttgcactaagactaagtatgtatttatagtactttctccatcccataatatgacaatctagtattggatcagaaataatatttcatagtacaacgaattcggatatgctttttatctagattcgttcggatatgctttttatctagattcgttgtactatgaagtactccctccgtcctaaaaaaagagaaaccctaggtttcagtgtccaacgtttgactgtccgtcttatatgaattttttttataattagtattttcattgttgttagatgataaaacatgattaatactttatgcgtgacttgtctttttaatttttttcataattttttaaaacaagacggacggtcaaatgttggtcacggaaacccatgtttgtttttttagaacggagggagtatttcattatattagattgctgtactacgggacggtgggagtaggttttaggggtactacgaaaggcttccagttcagcacagttgctagctgacaaatcaaagggttcttgctccatgaagggagatgttgcaagttgcaacagtgggtttcagactgagcagcacagggaagctcacacgctggggacaccacacaccccacgggccatggttttctagtcttcttctgcagggatgtggattccgggtcaatggccaagccaacctgcgagctcctgctcgagagtagccgtagtaatcagttcccaagggaagtcaacggagtcatcgaggcgacgaggtgggattaatttgtttatggcgcgaggcaaggaaacaaagggcgcgaacgcgtgagaatcttgtgctccgatctagtagtagtagtatcagcttgtttgcgaggacccaagcgaggtcaaaggaggggggaggccgccattggagaggctcgctctgcatcgttgccaggtacgtacgggcgcgacgaatgcttgatcttcttggttgcctaaccatcgatttttttctttgttgatttgttttggttggattgatctgtcgcttatattgcgcccgcagtgtgcttgattgagctgctcgtttccatttctgctgaaatggagatgaaactgtaggaaaaaaaaaaaag

SEQ ID NO: 5409 - DNA, 682 bp, Oryza sativa
gcttgcctttgccgccgccgaatggtgtttccgcctgcacggttggcctttatccccccgatgttgggcgtctacgttatcacagactggcttgctttcgccgctaccgattggtgtcaccgcctacacggctggcctattatgccgccattgttgggcgtctacgtcttcaccgaccggcttgccttcgccgccgccgactggtgtttccgcctgcacggctggcctattatgccaccattgttgggcgtctacgtcttcaccgaccggcttgccttcgccgccgacgactggtgtttccgcctgcacggctggcctttatgccgccgttgttgggcgtctacgtcttcaccgaccggcttgccttcgccgccgccgactgggtgtttccgcctgcacggttggcctttatgccgccgttgttgggcgtctacgtcttcaccgactggcttgccttcgccgctgccgattggtgtttccgcctgcacggctggcctttatgccgccattgttgggcgtctacgtcttcaccgaccggctcgccttcgccgccgccgactggtgtttccgcctgcacggctggcctttatgccgccgttgttggggcgtctacggtcttcaccgaccggccggctcgttcgccgacgactggtgctttcgcctgcacgggtggcctattatg

SEQ ID NO: 5410 - DNA, 351 bp, Oryza sativa
aaacaatgcttccacacgccactagcccactagctctaggtggctccctccttactcttaactattacttccctgcgcgtcgctccaaggcaaggggcgacacgggaggcgattcttcccccccccccccccaccccaccacacctcctcctcccccgcctcaccaccgctagagcagccgccggaaaccgtgcggctgcaaggacggcggctgcggggcctcaccccttctccatggaggccacggaggtcggcacccacgaccagtctggggacgacggtggccgcgaggggggtgagctggagctggcgcgcctcgtcgaggtcgggacgcctgcggcgaggagggat

SEQ ID NO: 5411 - DNA, 1627 bp, Oryza sativa
atagaaaattttaattccttatctattgcatgattagttgtatttttgttttgcatttaggaaattctggtataggatgccgtgattttatgggtctaattgcaacttactgtacaaagtttttttgggaggcattttttaaattagaagtctgcttatgaacattacatctatcagtataatagtttcttattaaataaggaaaataaattttgggaaatgttggaaacatccttaaagtcaaatggtaggtttttttattctctctttttatacaattcagtatcaacacgaccacacatcctaataatttgctggtacttagtggtttttattatttcacgagtgccttcttcgatttgaggtggatgagcaattgctacgagtatgtggttgagttgtttattgtacgtgttgaagtcgaacttgacgggtatgcgcattggttttaattaaatatattattttttgagacaatgattttaaaaatggcataaaaatcatccgaacgtgagaaaggggcatgacattattggaggtcatctgatgattgattaacttgacgttaggaagcgcttttatatgtgattattgtctgtggcgaaagtgacagtcaagggaatggcgttagtaagtagcgtgggaagagggaataaagagagaggataggtgggagagttagcaagcaagacaggtgaatatttctgacaactaatatgtttcttaggctgtatttaattgggtattattattttaatggatatggtgtttattaattaatgtataatctttaatattgtattgttttagaaggtgattagcaaacacatttgcaatgtagatgcaaaatagtagtggaacatggggttctgcatatttgtattgtagatgcaaaagtagatgagaaaaaaatatcccgaacaatgcttctctcacatccacatttcacattcacattaggtgcacgaaaagttgaaagccaaaacaaacctctacgtacttggtaaaatttcctactgtttctatagctaaaactgcttactgcagcgataacactaactaacataactaagaaacagagacacaaagataatagaagttgaatgtagaataagcatatcatctttgttccagataaaatggttaaactctacaggcactctcagtagcttataaataaacaagctactgaaaatagagaatgaccttcagaaacagaaacaaaactccctctcccattgtcacatccattggcatgttcaccccttgcattcttgaacctcttgatcgtccctctccatggttctgctgaacaagaagtcaattaattaagctccatgacatgttaaagctagctcaccgaagccatgtttagaagataccaacatgtcacgtgtgaatcagttagagaccatgatttataatagcaaagcattttgcattgataggatcagtgaatgtgcattgcagaatgccagtatgcaagaaaaaatagggacaaaaaaaccgtactgtactgcttaacaccttccccagaacaaaatgattttagaaagatttaataattatcaaagttagtacatgtgcttcaatgtgtgccttttttgtttcctatatcagtcatttt

SEQ ID NO: 5412 - DNA, 22899 bp, Oryza sativa
  unsure (1)..(22899): unsure at all n locations
tatttgaacatatatcacaaaaagaactcgttgtaattttattgctgaaatatcaccttgtcaagtaagaaatgccgtaaaagtccatggatgacgtgctgcttaatttctcatgctaacaatgttaatagttgatgaaactacatggcgatatttgcaattaaaaactcatatatacatgctgacaaaacttacatggtcaatgcaagtcctcatgttgtcgttttctaactaatggctaacaaaactacactctgcaaacaaaactaacatattttagatgattgccctcatgctgcagtcatctaactaatggctgacaaaactaatatcttactttgcaaacaaaactaacatattttagatgattagaccctcatgctgtaatcatctaactaattaatggctgacaaaactaatatcttactttgcaaacaaaactaacatatattagatgctcaggtcctcatactgcagttatttaactaatggctgacagaaataatttctcagtttacaaacaaaaccagcatattttagatgcttaggtcctcatgttgcagttatttaacttatggctaacaaaactaatttattattttgcttacaaaactaattgctgataaactaacaaaaccaggtaataattgcttacaaaactatgttagtggatgacaacaatagtatatcacttccaacttccaagttaacagaatggatcatgagttcagaacaagacaaaactaatttggtatttaaataaaaaattcgcttgtttccccatctaatgtacaaataaccattattaactagaaaaatatcaaaatggtgttcccccagctgcaaatgttggagtcacatgaacggtaagcatagcatactatggagaccaacattctgaaatacaaaaaaggggctatttgtgtccttgtcggtgaaagtgcatctaggcccctaatgattttaatgattgattacaatgcgattggagaggactaacattttatttaagcaagtgtgaaggttgttatgtcctcaatgagttgcagagtgatgcataccccattgaaagcgacgtcatgatgagttacggcaatgagcaaatggtatattgtgtattttactttctttgcatcttagaaaagccgtactattaaggggggtgatgcattgacatataaggagtgatgtgtgtgctcaaaatcaattttttggaagcatttctccttgcttgtgtgttctggaaattttcggaagttccgaaaatacacagaaccaatttttcgcttctggaaatttttggaagttttcgaaaaagattttcgaaagttttgaaaatgactgtgaaggcaaaaacggctcagtattttttcggaaatgtccgaaactgttttttggaatttccgaaaatgtctgcgagtcaaatatgcttctggaaaatttcggatgtttccgatagtgtttttcggaagttccaaaaatctccagaaggcatttttggttctagatattttcggatatatccaaaaatatttttcagaagttccaaaaattggcattgactttgtgattttctgttctggaaatttttggaagttccgataatgattttcggaagttccgaaaatcgcaattattgtgctccaacgggcagatctggagcagtagctataaataccccctctctccttttgagtgggttgttggtgacattggatattcttgtgtccttggcttgcttctctctctagtcatttaagccttgctttcttgtttcccctctccactcgggtttgattccaatttggtgtgtgtgagagagtgtggattcgagtttgtgtgggtgcttcttgtggtcttcgtgaagatttgtaagcacttgcatcatctccgggagttctttgcatcatcttttactcttggaggttgaggactcctagaggagttctggctaggtgtcgctcctgagccaccgatctacttgtggttggccgggagaagtttgtgaaggccggatctcgcctccgcaaggaaagagatacccttaatggaaggaggagtgctttgtgcaaccttttgaggaaagggttagcaaagaccctgctctttgtgagctcctcaacggagagtagaatcccctcaaggatttgaactccgggaacaacttcgtgtgctacatctccggtgatatttcttcctccatctcctctagctttgcttgtttgtgtcgctataggtctagttgttgtttgtattttgattatcatgtggtaggcatctagatctagaatttacctttgttttcgactgctctgagatttttcggaagttccaaaaattcctgcttccgcatttacttatgttttaaattagcctattcacccccctctctaggcctaattgaccctttcagtcggaaaacaactttgtttatagagagcgaagctgtgcccacactcagtgaatcagtgaatatataatgcagtttctgcctccggggcgaaaacctatcagcactatccgacaacacatgtttttgagtattgtattaatatatcagttattatataaagtgagcgtagctcaactagtaatgttcctagtggtggaactaacccacccgggttcaagttctagacttgatatgggcgtgcacatttacgtttaatcattctttcaatggtaggcgacaaacccgtcggtagcgaggcaccatggtgacttcgttagtctcaaactatgctgactcggtctttcggatgtgctgaaagagttgagtgcgtgcgtgttgtgagcgcttgcaattgtactatgtttctcaaacttagggtcccctccaaatatatactagatgataccccgcgcgttgctgcgggatactatgtgaaaacaaatagtatgatcgaagggaatatattaaaataaagccaatctaccaaaggaattctacagtaattctacagtttgattggaatataatatgtctgccatataagttcaaatgacatttatgttgttcagagagtatatacaatatagcctgtaggaaagaaaaaaaaattgtatggtttgtttgttagagattaaagaaaagtgcttcttgctaatctggtataggaagtgcataggcaagtgaactgataattaggtttcaaaaaaaaaagaactgataattacttgaaggtgtgtcaatccataccgtgagcgagcttgatgataccagctagtgatgttcccttcgatttgctgtaaacattaagaaaacatatattgactctatttataagatgaaaccaagtttttatatcagttagctcatgcaagacgaaggccttagtctgaagggactgaatttgaatcatgtcttccatccaatggtctggtgctggactgaaacgattcaagttctagctgaataaacaacagtgcacatatatagtagattggggtaatgaaaaacggattcgatcccccaaaaaaaaagttaaccatcaaagatggataaggtagtttttacaaaatctctatatatctgaatatataataaaataatgatggtcagcttgacaaattgcaatttcatacattcatatatcgatggaacacaaagtactgaattaccagattgtttgctccgcaaaaggagatggaaccctaaagtactgaattgcttgatcgattgatccagaacgggacaatatatatgcctttccgcgtgatacttcttccacctgcagtaaatttgggcatcataatcataatttacacacagaaaccaacaaataaaatgtcaagtaaatttccacgggcacattacattccgaaccaaacaaacaacagaaacagcaagagaaaattctgataaaacgaaggagcgtaaagtagatacacaaataagaaacggtatgcgaggaaatgagggtgagaggaataaaaatggcacctgccaggtcgccaatgaaacggaagagtgatgatgatgcaggtatatgcccatggaagatgtaatcacatatgtaggagaggatatgaagcaatccattttaatggcaaacgttatcaactatcgaatgaggaggcgagtagaccgggaagcaacgggataggaagctgcgccatacattggtgggcgccggtagtttcctgagcggcggggccgaaccaatgtataggaagcggagtggtggggggaagaaagggtgctgcatggggggtgggaggtggggagtggcggcgattcccttgcccggcggcgcgagaggggagatgcgggagaggagaggagtcggagcgatgcggtggggccattcgcgcgagagagaagtcgttgatgcgggagcgctcgcgcgggggagcaatgcggtggggctggagaagcgagattagatccaacggttaggaaaagaatgatgacgtggaggcaccagaaagcagagaattcagtagtggggatgatttgtataggtatatagatacaggattactcaacacacacacacacacacaaaagaatcacaaacttacccactcatggacaccattaataaataggtagaacaaaatcaacacacctctatcaaattggaaaatgaaaaaataaaatacattcccacgaagcaacaacaaaatcatataaaaaatgttgaaaagtgatcctgcaactccacttgatgtaactctaatatcctatcgatcagtgttatatctgcctgtagccatgttggattggtgagtgaagaacaactttactgtaagcagatgcaagagaaatatgtaatattgagcactgcagttgtctttttagaaataatacttttttaatagggaatcacaaaaatagaggttgtcagactaaaattgcaagtataacaccctatcgaacaaccaatgttcgacaagggtacatattgaacaactataatttgacaagggataaaaacataaaatagaaaaatcactttgcgctactatgcgccactgtagcatgcaggacctatcgaacatccccatttcaatagtccacctctcttccatgtactttttattttttttaagtggactaacaaccttgtcgaacaaccgcagttcaacaggagttcgacaggtacctatggaatggttttagccaatcaacttctatttttgcaattttttattaaaataatattatctctaaaaaagtttccattttttttgtctctatagacgatctggactgcttgacaaagcaaagaacttcattgaggaaaacaacatcaatcatgtggcttttgtttggatggggctactgtcagcttgccgatttcactagcacaaggactatgcaaatttggcttgtaaagatttgcttcacttggagcaatatgatgctggatccaagctatacaaaactgcattttatacattcaacggtgacagatccaaccatttacacattcaaccagtgacagatataaaagaactaatacctgatagtcatagaccgacaccaccggcctcaaatgcgaccataacgatagtgtgcatgacgagagaggaggacaaaaaaaaaaggatggctcatggaggataactagagggtgcgattgcgcatgcaaaggtggagaggaggaacgatggtggctcatggagaaagagcggtggaggtggtggtagggatgaaaacggatcgagtacggtcgaaaactagctctaacatattcgttttcatatttttttctcagaattgaaatcggaatcggaaacccggatacgaaaatggaatcgaatattatcgaatacagacacggagcgaatatgaatcgaaacgaatacggtaatgaataattatcaaaatatcaagacccctcaaaataagcttcttaaaacgaggaagagatatagccattagttttcaaacacaaaacatcagtattttcaaattttatctctatttataagggcaagggggagatagaaaatgttatgtttactttccatacaaatttatgttatcataaaacaaataaattaatgtgtatcactcaaattttcgtaggcacattgaaatttttaaaaattggttgaatattttaaattttgggttgaacatttcaattgaaagtttttaaaaatttgagtggttatttttcagaattgaattttttcatttgtttgtatgtggaccagttaagaaagtttttaaaaatttgagtggttattttttagaattgaattttttcatttgtttctatgtggaccagttaaggacccgcatggaaaaattgattccatacgggtgacttaagaatccatatgcaaaaataaattttgaaattttgaaactaatttatctcactcatatgaactccaaattggatgattcttttccctaaatgtttctaaaatcatgctctatcatgttattgtgttcttatcttctattattttggccatttttctcttgtgactttgttttatcaattaaaaatttgaatttctaaacttcaaataatattttgaagctataattaatttcagctgaaaaagtcatgaacataaaagttgtagagctcatcaagacatacaacttttattttggtcatttcttcatccgataaagtgatagtaacattgttcacaaagtttacttctctcttatagtttatagaaccaaataagatagatgtaaattttatataagatagatgtaaattttatgaacaatgttactatcactttgtcggatgaagaaacaaccaaaataaaagttatagatcttgatgagttataaaactttgttgttgataactttttcagttgaaatcattaatattttaaaatattgtttgaagttgttatattttgaaattcaaattcaaacggttcaaacaaagtcatatagaaaaatgaccaaaataaaagttgtagatgttgatgcgttatacaactttgttattgacaatttttttcatttgaaatcatttactacccgaaaaattatttgaatttcttatattttaaattcaaattttatatagtttaatcaaactcggatggagaaatgaccaaaataaaaatgatagatctcaataagttatacaaatttgtatttgacaacttttttcatatgggttgattttgtgcctttaaattcattttaaagagccacatgttaaaaaaaaaatcgatttttacactgaaaaaaatccaccatttttttcacctcaaccttatcttctctttgactcttcctctcttctctctcacacactttctactctctctctctctctcacttcctctcatccacagggcgcagggcggggcgagtggtggccggccaagggcggtgcaccgcgtggcgggtgaagcatctaggcccccggtgttaattttggtaattaatgacaagcgctaattgtggactaaccgctaattgtgctaattttgttaattttgctaatccaggccgatggggccctctgacagcacttcaatggctagttttctagccgttgcagagtagcacggtctgaccggccacatatctccggtcagaccggcagagcacaaagttgggggatttcgcccccaaaggctagttttgctgggtgggagtataaatactcccccaccagcagcaaggggaccctcttggcatctaattcaattgcatacaccctttgcacctcactcacactcacttgagctttgtgttcatccatctagtgtgttagagggttgattagccaagagtcaagtgcatttgcttccattgtagagctagtgtggcacttgatcatctccacgccgggttattgcttgttactcttggaggttgccgcctcctagacggtttgtggagaagttgcccggtgacctctccgagaagtttgtggagaaggcccggtgctggtttgtaagtggtttggagttcaccaccttcggagtgaaggaagaactaccctagtgatcgaggcttgggtagtcctctccgtgggccagctcccgccttgtccaccccttgacgaagggggtgtgcggtggcttcgtggttgagcggtggagttgggctcgcctcaatggggagtaggaaaccggcgagtttccgaaccttggtgaaaaatctcttgtctccctgtctcatttgattgtcacatttacatttgtgcaatttacatttctagagacaaacttgagatcatatcaccctaggattgctaaacattgacataggagtttgatttactttcctagagatataattgagccactatcaccctaggtttgcaaaacataacttagttgcttagttagagttgaccctcaccaagcctagcaacttaggttagttttgattaggtgtcatttagttttaaatcgtctattcacccccctctagtcgacatctcgatcctatagcaggcggcggcggcggcggcgggcggcggcagcgggcttgactgccgcgacctaggaagcggctgcagcgacggcttcggtgggcggcgacggcttcggatgggcggcagcggcaggcggcgagggcggcggatccggcggcatcgccctcgggaggggccggatccgctgccctaggaggtgttcggcgctcggccccgcgacggccggcggcgggcgggcgcagcagcgcggatctagctagggtttcgggattttttttgttttttttttgctgaaaaatatctccggatatccgatgaaaaattccagatagtttccgaccgatttacgattccgtcggataccacccttactgttcgtttttgtatccgagaaaaaacccgaattcgtttccaaatccgagaaattccggatagttccgaccgaatttttctgaatctgaaaattggtccggacggacggaatctatccgaaccagtttcatccctaggtggtggtggcggtgcgtggagtgatagttaggctgtgtagcacgcaaaacggagcacacataattgtatgattaattaagtattagctatattttttcaaaaatagattaatttgattttttaaacaacttttgtatataaacttttttttttgcaaaaaacgcacaatttaacagtttgaaaagcgtgagtgcggaaaacgaggggaggggttgggaacttgaaggaaagaacacagccttaagggtttattgttgacatgatcgctaaccaagtttgttaattttttatacgtgggcaactagtcattagtcattataaagattataaagaaatagctagatttaaagtagtaaaaatattgagataaaggtgagagtacttgtattaactttttttgtcactttagtgataaattcttaattattaatagtaagtgtgacaaatagtaaaggtggtgtttggatcagggacttaattttagtctctgtatatagacactaatttagagtattaattatagactacttacaaaactaattacataatgaaagctaatttgcgagacaaattttttaagcctaattaatctataattagaaaacgtttactgtagcatcacaaaggctaatcatggattaattaggctcaatagattcatttcgcgaattagtccaagattatatattttattaatagtatacgtttaatatttataattcgtgtcccgatgtgacacggcttagtcccattattctcgagtagaatatgtcccttccttagcggcgtaaagaaagaaattcgtctcctccgctcctagcgccgccgagtcgcggctgaacagaacaagggagggaggggcggcgatctccatctggcgagcagagcaggggaggggatcctcgtgagcatccacatcctctttctgattcatctctctcccatcgggacacttgatatttcttgcgttcttcgttaaccctagcttctcttctagatctggaagaggctcttctttttaatttcagagccttaaccttaatacaagtaacagtttgtttgttccccgatccgcccctgctgctggtacttgggctatttgattcctgcatagtttcagagctagagctagtgttgctctttacagctttgggcggattcgcgatggcggatgaagagtcgtctgacttcaccttttgcaaggttttatttataacttgcctccctattgcttctatgttcagctacttgttatttctacaatcaatcagtcatatttttttttgacttatgtattactttcaattgtgtaataaatctgccgatcttctttgactgatttaatcacctgcttttaagcgcaatcttggttctggagatattttcttgtacaaagttctaccaccacaaattcttggaagaagcaatatgttagggatatattccactaacattatcttcatttttggcgctaatataaacaaataggtagtatctgactaacatgggatggtacaaacaagtgaaaaaaatagatatgaggaaaaggaaaaagggtaagatgtaacataagaaatcagggagactgaatggaagaggaaagaaagattcatctccgctgtatagaaatctcatatagtttgtccttgttgctgctgtaccaagaaatccaccttttgttgttgatatacatgagctttagaatttcctatttcataaaaaaaaagctatgctgatgtagtgagcttaagctaactaggtaagcacagggtacccacttgtgtatatagctccattttcatgaattatttgctactcccattttatctgcttttcttcatggtacttacattttaaatctggaatcatgagtacaagggacatatatctagattgtttgccatcttgaatctaccggatttattaaattttcatggatacttactgtccaaatggtctaaatttaaacttcctatgttgattatataatgaccatattcttttacaaacaattgaaacaaatcttcagtgacttgatatggtaacttgctgatgttattctacttatgtttttgttgtgtagatgtaacaaattctatattcaattttgttttctagatcgattttgagggagatggtggtctggagttccctaaagctatccctgtggcaagtacacctggtgatgctggtgcagataacttaaagactaagaagatcgaaggcaacatgcaggcaaacaattcaattaaagatcaaacatctaattctatatctagtagcatcaatcgtgtatcactcgaagactctaatggaaaagagtcagttcttagcagagagaatacacagtcaaatttatcatctcaaccaaaatcttcaaagaaacctgcagcgcgtgcaaaagttcctttcgagaagggctatagccaaatggattggcttaagctgacccgtacacatcctgatcttgcaggtaaattgtagctgctactgtttcttcatctctgtatgtatgattattactggatggctagtgtacatttgaaaactttcttagttaatgtattgttactgtctgaggcactataatcatgacaactcaggatatcttaatatggtcatagttaccataggaaaaacacaagcttaagagtacacacaatttttggtttcattgttggataggtgaggtcaaatgaatgagtttgcagactagtatgcaccatgttaaatgtcttcaaaaggtcctgaactacattttctactatatcagctttcgtttttcatgtggcattatcaaaactgatgaggtcagaaaagaagagggggggggggtatattttttgggtaatttgtttctagctaatacctcatggacctaagaattggtttgaacttctagctattcataagacaaaatgtcatttaattaattaattgtggtatgaacaaaaatattatgtatttcatcctcagataatccatagtgattttttttctataccattaggattcgtacattatttaagatacaggattcctgcttgtgagatcctttagtcattagtcactggattgcattttagatttggtatgcaaaggtgagaaaaggaaatacaggtgggggatgcacaatttcagcatttaggggaagagcgcgtgaacagtggcaaaatctgaagaagtttgtgattccagcggcattgaacaaagaatgcaaaaagcagtgccaagtaccaatggtgtagactgatgttttcctaatttaaagcataaatgattatctacagatgttgaaatctgaaaatgtaaatgcaattttattatttgtgactggagcatcgcccgtgagctatccaccttttttgaatataactgcaaagggggaaaatatgttggtgtgtcttgcgcctgtctatcagctgtaattcatgaacctgtttatgcttgactgaagcatatgcgtccactgttgttaatatttttattttactccttttttaactgtgtgttacttgtaatgaattgatgtttgctggtgaaataataccgatttcctttcatttggtgtggcatttttatagggctcaaggggcagttaaaccgaaggttgatttctctagaagaagttaaacagcataaaacaggagatagtatttggactgttttgaaaggtcgtgtgtacaacattgctccgtacatgaaatttcatccgggaggtaaccataagttttaacctgatgtggaatacttgtttcagttcttttcgtagctgctgttcaccttcacaatttctgcagacttcagagtgctatatgcttctattttatgtgtaacaagtacttttatgggcatttgcaggagttgatatgcttatgaaggctgctggaaaagactcgaccgctctgttcagtatccttctattattattgttcaaacatacttttaaagttgcctgctgcctgtcgtagaatttcaactgagttttagttagaatcaaaatatgctttgacatgcatgtttgcatgctaactatactcatgcatgctttgttcattatattaggtcgactgttctgtgcttattgtgaccgttgaacttatgtgcaccttgaggctagctagctgtcatatctgcagggaggttttgtccatgaatatataattcttgatatggttccttcactcccctatagacaaatatcatgcatgggtaaattttgaattcctcctggagaagtgccttgttggattcctcgatcccaatgagtagatgcgccattgagcctgaggccagaactccacttcctctttcttgtccgcgacactagtccctgatgcgtatccatcacatggagacagtttaaggaatgtaaacaagtgttttgcttcattgctaaggagatatagatgctgctgaacattttagaaaaaaaagaaaagttagaaacttgatcaccattgttatgtacaaattccttcaccattgattgctgaagaaaacaaagaacatttccatccatatgaatgtaatgtcaagaagatacatgtgttttagatgaagggatactgtggtgctgttttggctctttgcagccaacacatagtgctctgtttctttcacattacaagacgttttgggctcatgcatatattgatatatgtgcttcatatatttatcccatatgagtgtatgaccagatccgagaaacccaagcgcaccatcgtcgtccatccgccaggcgatattcctaacgacgccatccagattccgcacggagatgcgacctctccaccggccggaaagcacgctgttgccgtcgtcgccggtctagggaccgctgttaggatcgacctgatctgatgcgatcgatcccaaaatattcagcgaaattcagaacttggctggaagctacctattaggaatcctaacacggcaaggaattgaaataactgctgaaattaacttgattaacgaaatatatgagtaggccgcaagaacagaaaaatggaataaaaactatgattttgatcttcgatatagttctaaaataacacattggcttatattgagtatatcacgagtaaaagacaaaaagtgacgcctatagtaccgtaaggatacacactgcagtctatctcggtgctcttgagcaacacaatcttcatagaatctcccctccatctgttatatttaaatctcagccatccaaccaatattagcatcctcctctgcttcctcagtattttggaactctaaaactctaaagaatcaagtgctctctatcttcatgtgcctctcaaccacaccccagtcgtgtcggtcttagcctctatgcttcacgactacacctcccatgtatccgtcgttcctcgatgttggtgcctttatcaaccgaccccgccttcccaaaaccaccacttttgctgctcgtcactatcaacctttaaattctaccccttcccttgtcataatgaagttgtaggaggatagcagcagaaggtagcggtgaggtaacaggaggtggcaacggagctgcaaataacaagacaacggtgggagctataggatctggcgcccccttggccagatctgacatcctcccgacaagatctggggcctctccaccaagggagactagttgaggtggctctcaacgataatggtgggcacagtgtggtggcctacagcaacgcaggtgcagtggtgagacaacgttggtgccctcgctatgggtggggactaaccggcgatcggacatgacgtggtccgagagaaggctatccatccgatgaggatgactaacggactggaggtagagcccttgtgggaaggcggcaagaggcgtggggatggctgcgtgctagcagtatgttgctggtgttttgaaggcgatggagctgcaacatcaaggttgagggaaggttggtgccaggcgaaagtcttgtctgatggtagtcaggacacaataattgtgacgctgcaggcaacacgaatcccctcggggtgttgtcgtggttgtaggatcgaaggcatcttagaggggagggggttgaataggattcctaggagacttggctgaatttaaacttaaatttcagaagataaaaactaaccaatatgcctaggtttaagactactgtggcccattgtttaaaattaaagctagaactcctaacagttctagagcaaaataaatattgaaaggaacaagaaactcaacataaagagaagaaagttcaaacaaaagacttggcatgttttaaccgaggtatcagatattcaacaatctctactaatcgtcattggaaatctacacaagagtatagctccctcccaaggccatgaagtccatgggcgctctcatcattgtggttcttctccactcctgaaggtgaaccccgaaaccttcaccatcacgccgagtctcccacaatcatcttgagacatcactggctaggcacgctaagatgccaagagtaacaggaagaagtcttcacttgaagcccttaagaacaaggcctaaacgagtaaagaaaattatcacagatagctgaatggcgctcttggactctcccttaggttgcttagctcaatagagttccaaaaggcactaggtagtctaaggcaagaggtatttatagccttaatcgagctcattagctgtttgctaccattggcaaaaaccagctgaagttacataggatcggacaatctggtactagacggccctttatactttccaatagtaacaaggcatatagccgttgggctataaactgtcgggcaatccagaaacacgccacgttcaaaatcaatatctggtagtagccggacaaacatgtgtccaaattgttcgacaatgtgtcagaatgtcaaacaattgctagatcagcttgattatctatcggataatctggctagttcatttacactgtccgaccaacatatgaccacagttggacaacgaactagccagaaaatccgacactgcaccggattgtccggtcaagttactctagcgacttgaacaagtactatctcggattgttcgacacaacttggactattaaacttgtacatgttcagggttgtaggaagacctgcacactgacaattgtctgaggtttttacccacttgatttgagaggccacaacttagtatgcaccacaccttaaactctagcatttcccaaaaacttcaagctactagttttcaacccctctttatagcagtctttaacttaattctactacatttgtcccaactcctcaaatacattaccgatgtttcagttgcagtagtatgatctcgttgatcttatcttgactgtcttttttgggtataggcaaaacgtccacacttccatcgccggagccctaatctttttttaatacttaacaactgagattagttttcatgattatattgtcattaaccaccaaaacatcacatggggtctagattcttttagaggtgcccctccttccttcaccaatggatttctctatgttaaaatcttatccaagagtccttgagcagcggtggtactctagcgtctcaacctcctatgacaccctgtgtcaattaggatgtgacttgtgtggtccataaaagctatgtgcgcatgtttagtacagcgttgctagtttagcaagggtgaaaccaatatataagggcttgttcctccaaccatagcactttcgggttaaccgttttacatgaagcgaagacgaaagtgtaagtgggtggtatatgtaagtgagcccgctctttagatgagctgggctacacggttctggttgacgggttgttacatctccttggaggcatcgtctttggagatcccctttgcctttccgctttgaactgttggtcctggactgctctggcgctctttgtttgtcatgatggggtgggtatgtgtgcgggaagagtggatcttattctctgcggctctcttcctcctcaacccaagatgtttggtgatcaactgcctagcaaggttgatgttgtttaggcgattgcaattgctcatgtcttcatgttggtgatgggtctgtatgagggacgagcggatctttcttctctctcatgttctccctatgcaatccaattttgggatgttaattgggagcccatgcaccattttagtgttttgactttgtcggtattcagtggagtggctatgttgtaggctagtggtgaccgggtcttacatagcggcagtcagcttgatgctaggtttcttgcgtagcgttgtcagcgcatggttaagctagctgagttttttttttttcctgtcttcttctcttttttttttggaacttctgtcttcttcttttagttttctttgtgattataacctctctcagggctctagtcttatactactttttttctctactatattaataaaacattgcaccatctagtgttgttcattttttaaacaagacaattagtataagacatcgttttccaagattcaatatgatatgtttatgttgtagatttagagtttcctatattgcaacgcatcaatatttttctagtatatattataaatatcaaaattttaatcatatgttgatgttattttttttatcatggacataggttaaaataaatatcaagctgaaatattcccataattcataaatacaaagaaatttgattgcgaggtgattgatgggacatgtaacattgtacaaatgcttataatatatggacatagtgcttataaatttcaaatatttgaactaagttaacaaaatactaaattaaaagtacaatatctttctaatcaatatactcggtggtcagatccttctatttatcgtcaaatttttcttaaagtgaatttggtcaaatagcacagttaaatagatcatatatacaacagcaaataccagttgtttctggtcaattcgcaagataaagttataattcataccgataacaatgtaattctctgcaatctgggtcgtagcaatagcggaagaagagcaacagatttggacacttgcaaaccgacacggtgactggtaacgaaccgcctgcgaaaatcgtctcgacaaacaaaaaaaagattgccgccacccccacccgtgcccctacccacctccggccgatctagggttagggagagggagaggaagggccgatctactgcaggggcgccgctgcccccgccggggtgggggcggatctgggagggaggggaaccgctgccgccctcccccagactccctctagctggatctgggagggaggcgaaccaccgctgccgccacaggtcctcccccctctcccctcggccggatctgggagggagccaagcggccccgagtatcaccgtcgccgtcgccgtttgctgccccgacctgcgtctcgctggtgccgccgccgaccccgcgcctctccgtcgcgtgtggatcccgctgcccctgctcgtcgccagtcgctggttcccccgccgcctgtcgctgtgagggatctgagggagagagaggtgagggagaggagaagtgagggagagaatgctgaggacttagaaaaaaaatcttctccagccttgtctatttatattccacactcatttttgtaggtggaccacataagaggtttgccttcaaaaataaagagtatttttgcaggcggacagcgagatttaacccggtttacatttttgtaggcgatcatttgggcccgaaggttatatccgcctgcgaaaaataaatacgtacccaacgtcggcgcgaaaatgctttttctagtagtggtgatacatctccctagcaggttaggaaggactttaatccattcctaattcctgatcgttgattgctagtaaagttgtatatatatgcatttaatagttaatattacatgtgcatgtaaaatctcatcttcaaactcatcacacgtatgaaaagaaaattatattgttacggttaaaatataatttacccaatttaggctaaaactttacagaggtataataatattagaagtacatgtacattttttaaagtatgcataaataattatattatattttgaaaccgatggagtattttgtatcaaacctttttatccatttaaaatggacacttatcctttcagcaatgttgagatagacaatagtggatttcatgtttgtgatcttatatacagctttcggccttcaccgagaggtgaaaatttctcgtaaacttccacatacaagttttacagtataaattaatttggttcctaatgaagtcttataactttatgcattccaatggtagctaggactttccgggttcgaacagagatgaaaatttcaaataaacttcaaaaagaaaatcatataaattggttgttagattaatgtgctatacccaattaaatcctaataaattccattggcccacattaagtgctatgggtaataacaccaccttgcaaatctgagtgcagaggtctcaacttaaatacggagctagtggagagtctctgttgaccggttgagatggtgcgcggacaaccaggcggggcgaggcgaggcgaggcagacagcagctgctgctgcgctctctcgttttgtaacggacggtaataaacacggagaattgatttcgtatcaatgattccgtcagttacggaattaaacgtcgtgaattgattccgtcggttatggaattaaacgccgtgaattgattccgtattaacgagcgcgtcggttacgaaattaaacaccgcggttgatgactccgaaccgttactctcgcgcctgcatatatatactcccgcagcaacccagaaggacggacgaagttcttcacgactattgcacttcgagttcctcctcctctgttcctgagctgcagaatccttccccggttctgttcacctgcgcgcacaggtgtacgggacgagcaggtgcctccggaactccgtccgcttgagaacttgcacgggtaggcgggcgatcaagttttttggtagcgcttcaagcgcgactgctcttgttcttcgcggctactgctgctgcatcggcgccttcaccaagatgtcaacggagattggagacaataagatgaacgacatcaacggaggcaatactgcctcaaatccagcgatgggacgttctcggggtatactttcattctcccgattctattagaagtttctttgttaatactcttcgcaatggtagcattgcgttactatgtaaatgttgatgcttatttcatattaagcatactcaagttgtatacatttagcactgtcactagatctactaatattgcaaatgtcatgtttattgtcttaatattttggattaaaatatgccgaattatgaccaaatttccaacaatccaaaaacttgatgggtcttttttggtagttggctttgctgcatcactaaaaccacgtgctttcgatggttcaaattataaaagatggaaagcgcgtgcacttttgtggttgacggtgatgcattgtttctttgtctcatggggcaaaccgagtgaaccgcctctctctcctgaggaggaggctaagttcgaggctacggattgcttgttccgtggagcattgatcagtgtgctcgccgataatattgtggatgtgtatatgcacatacctttagggaaggacatgtgggatgctcttgaggtcaagttcggggtttccgacgccggcagcgagctgtatgtcatggagcagttctatgactacaagatggtcgattaccgttctgtagtggaacaggcttatgagattcagatgctggtaaaggaacttgagaacaacaactgcgagttgccggacaagtttgtggctggaggcattattgccaaattgccaccttcttggtcggactttgctacttctctaaaacacaagaggcaaaagttcagtgttactgatctcattggctctttgggtattgaggagaaggtgagggcaaaggacaaccagggcaaaaagatcgagggaggttctagcgctaatttggtgcagaagaagaacactcacgcatcccacaacaacaacaagaaagtcaaacctgacatcaaatccaaggctacaaccaattttaagaagaaaggcaaaggaaaggcaaaaggagattgctttgtgtgtggcaagcctgggcattgggccaaggattgtcctgagcgcaaggacaagaagtctgcaaacatggttattagtgagggcggaggaacattgtggtatgataaatttttagcaacagttctctctgtctgtcactcacctgattggtgggttgatactggtgctaatattcatgtgtgtgcggacatttccctgttttcttcttatcaagtcgggagaggttcctcctagttgaagggaaacggatcacttgcggctgttcatggtgttggtacggtcgatctgaagtttacttcgagaaagatcgtgcagctgaagaacgtgcaacatgtcccttcaataaagaagaatctagttagcggctctctactatgtagagatggttttagacttgtgtttgaatccaataaatgtgtcgtatctaaatatggaacgtttattggaaaaggttatgacagcggaggtttgtttcgcttttccttggatgatatgtttaataaagttgtgaaccatgtaagcgatgatgatgatgagtccaatgtgtggcatttgtgactttgtcatgtgaattttggttgtatgacacgcttagccaatatgagtttaattccaaaattcactttagtcaaaggctctaagtgccatacttgtgttcaatcgaaacaacctcgcaagcctcacaaggcatctgaggcgaggaatttggcaccactaaaacttgttcattccgatctgtgcgaaatgaacgacgtgttgactaaagggggaaagaaatatttcatgacactgatagatgattgcactagattttgctatgtgtacttattgaaaacaaaggatgaagcactgcattactttaagatctataaggctgaggtagaaaaccaactggaaaggaaaatcaaacggttgaggtctggtaggggtggagagtatttttccaatgaatttacttctttctgtgaagagtttggaattattcatgaaaggacacctccctattcaccccagttaaacggggtagccgaaagaaagaactgcactctaactgagatggtgaatgccatgttagacactacaggactttccaaggaatggtggggtgaggcaatattgactgcgtgtcatgtcctgaatagaattcctactaagcataaggaagtaacaccattcgaggaatgggaaagaaagaaattaaatctctctcacctgcgcacatggggctgtttggccaaggtaaatatacctatagccaaaaagcataaatttggaccaaagaccgtagattgtgtgttccttggttatgctatccacagtgtgggacataggttcttaatagtaaattctggagtacccgacatgcgtgttggtacaattactgagttcagagatgccacattttttgagaatgaatttcctgtgaaaaatgcacatagcacttctagtcaagaacctattttatcccctgagcactttatgccgatagaacacattgatcaaacgcttgaggaaaatcctgaggaggataacattgtggcaactcgaaagagtaagagacaaaggactgcaaagtcttttggagatgactatattgtatatcttgtggatgatactccaagaaccattgaagaggcatattcatctcctgatgtgactattggaaaggaaagaagcggtacgcggtgagatggactcaattatgtctaatggtacttgggaagttgtcgagcgtccatatgggtacaagcctgtaggatgcaaatgggttttcaagannnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5413 - DNA, 969 bp, Oryza sativa
acctcacctcttgccattcatctccaccgcatccgaaatctcttctccgaaaagtctcttttgccagccatcgcactccaaaaaaaaaatagtgagttcttcctccaacccctacctccaacgctacttcagctaccgcggcaagccatccttctcatctgcttaaaatcacaacacccgtaacaccatcaccaaaatcaacactgaacactgattaatcgcttctttaagcatctctccaatccctcccttcgctttcccactcacagatctacccttgccaaaccaagcccataaatcattactccatctcacagcctcttatcttaacgctaatataatttgttgttcttctttttacccttttctattattacctttcaacttacagataagtgacaaatcatattttttatgtcgcaggatgtaaaaattcgtctattgcaagatcttggagttattgcacgcaagtcatcttttactaggtaatctaaccatagatccatgtttttacatgcaatctaatatcattatctcctgcgcaaatacaacgacaactgttacccacaatgataaaaaaatgcaaaaaaaatgcagttatacatagcacagctaaacattacacggatatcttattaacttagatattaaaaaatgaaaccaaaataaaaaaaactacccttactttaaaaataaaagcactttttatgtcgtttatatcgaaggataaattaactgagcacttttcttaactcatattccaactgttatttattttcgcccccgacctctttaaatctatctctacattgttttacctataacaacaatggcataacatggtaaacacagattcgcacaaaatccatcctaaacatacatggaaattcatttgggccatcatttatctatgtttactatggttactttttaataatacaaacatatatccattaattagtttattag

SEQ ID NO: 5414 - DNA, 14038 bp, Oryza sativa
  unsure (1)..(14038): unsure at all n locations
tacaatcatgcattcaccaacattctccatggtcaaaattaagacagcaagtcaagactatctggtgagcttaacaagaaatattttatgtcttgtacagtatgctgactttacaagtgctaatacaaattttcaattatacagcctatcccagttgcagttacaaaagcatctaggcttaagcatggacgaactctcaagttaatgactgcacatggcttgaagatccgcgtcaaagtagcagaagcacgtgacaagctgtacatgacaataggatggaaggaattcatacaagaagctggcttaaagatgggagaatctaaatctgttgttttcaggaccttatcaaaatcaagactcaatgtgatcatatttaacaaagaaggatatagtagatgtccaattccagataaagcggccaaggcacttatcaataaccaatcatcttctgcaccaagcttttcaaccaaatcaactgcgcctcgtcatccatcttttaccaacgttgaaggtattaacttcacttttactcactgtattttcagctttatctaactttcttactatgatttgcctttcaggtagagtccacaaaactaaatcacacaaaaacgaacacatccaactcaggttcaagcaccatactggatcaacttctacaggtccaaatactttacttattactttcaatgaaattctttcaatgaaattcatcaatttttttttcttctatagtgagaaaaatgcttatccactttttttcccgcagccaacacaaaacgcattgtcaaagatatgtgctgctataacaaacggatgaagctatcaagtgaagtaaagaactacgttagagatattgcacaattcctagactactcaagcaaattctacattgttactatgaaaaacattcatgaagtaagacagggtggtaagatctttcacttgcaatcaatctactctcttgaaaaataaatatgtgacatgcaatttttatgacagtacttcacaaaataatttccaaagaaatatattcagccactagcacagcgcaagacaacacaaattcaagtacaaattacaagaaacacatcaaccaccatgcttcttcaaaagtcaacagatggatgctacaacctaaaggcaggatatggtcagatttcgcacaaaataattttcaaagaaatatattcagccactagcacagcgtaagacaacacaaattcaagtacaaattacaagaaacacatcaaccaccatgcttcttcaaaagtcaacagatggacactaaaacctaaaggcaggatatggtcagattttgcagcagccaacaagatacaagtgggaagaatctgcatttttcacttccacaagatgaatcagttgcaggcaacagtacatctcctgtgaatgcaatgttcatgccctgcaccagcaacatacttctactgttatgaagcgcataaacatccatctttctaccatcatgagacctactctaagactagcaccgctatgctgattacttagaacctttatatccttgttatgcacagtttgtttcactgtaaatattgcgctcaaggtttcatctctacctactactgtaatgcaatgcttaggaaaaaacctttcctaatgctatattatgtttctaatccttacaccgatgaactgtcatcaccctccatataaactactctgttatattatgtttctaatccttttgtttgttaccttcgtcaactttcactatgctattctattatattaagtcgtgcatnnnnnnnnnnnnnnnnnnnnnnntttcactacccttacaccgatgaacagttcatcaccctccatataaactactctgttatattatgtttctaatccttttattaccttcgtcaactttcctaatgctattctatgtcacttttttttcataatatttactgcactgattgaaccagtaatgccataggattgcaattctatactcagcaaccaagctctctccaagcggcgcgccagggcatgcctagatatctagtgaaagataatgcaccagctaatactctgatacaaccttatacatagagatatcaatgtaagtaaatatatataatgcaaactaaatatatttaaataaggtgatacatatgtataaggggcaaatataatatgtaaaacatgactaagctaagcaaaacatgttaaaactattatatcagataagatcggctgaaactccaattctacccttattggcaatcaagaaacatgctagagctcatggttctaagcatgacttaataggtcaaactcaattgatgcatcataaattatgaagagaaacatggtatctaaacaatcaagctttgaccgattttcagggtagtagataccttagtcgacaaaacaatttagccgatatcgacgacaaaaccatagaaaagttccagccaatacaagtaaatcgaaatatcaacttatattaactacgatatctgataatcagtgattatattaagaacattaacatatctaaaatgacataataacctcgataatgcaaaccattgtgacaagtgttacctcccatcgggagattgaaaccgatgtcctaattcgaagtaagaactcgtcaaaagtagaaaagtaaaaaagggtggcgatgcgctgagagtgtattgaacgatcgtttttgttctacatgattctaggaatatatttatacccgtagtacaaacttgtccatactagacacgactgaaactttcctaagttataaaacatatgaacaagtcctcgtggtggactcttgccaaaaacatctgaagacataaatatttctaattaatagatacaattgcctgtaatggactttaactacgtatgaaaaaagcgttgaaatcatgattcgagaccaactatatccgattcaaactcaaccgatacaacctgctagccgatgcacactttgtttctggaaagattacatccgctccaaatctgcctcggtgttatctttaactttgagcatatcttaccaaattttgttattaacacaacctcaaataattaattttccccgttgcaacccacgagcactttgctagtggttttaaaagaaacaaaattaaaaataaaccaaaaaaagaaagaaaaaccacttataactgcaaaatgggccgcgctacgatgaggagcccattgggttttatgtaaaagcgaattgcagaagagctagggggttttacgtaggaaaaagtatacttggactccctcaactatggtctgagtatgattcatgaccttcaaccacaaaaccggatatattgactcatccaactatcaaaactcatgcaaactatatccctgggtggttttagaagcggttttggctgatgtggtgcccacgtggcggtgttgacccggtcttcgtcccgcgtgttgacgacgtgtcgcttatgtggcattagagtaaaaaaaattgtgggaccgacatatcattcacacaaaaagaaaatagtgggacccacggatatgtgggccccacatgtcatcctcacctctcccccctctcgctctcatcttttccactcctctcaccttccaacactagaggcggggcggcagcgatgtcgacggcgcacgggggaggatctcaccggccgtccacgcgcggggaggagccagccggccgtcccacgagctcgccggccatccgtgcgcaaggggaggagctcgcgggcgtccgcgtgcgggggaggagctcgtcgaccgtccgcctgccgtccgcgcgctggggaggagctcgccggcgttcacgcgcgggtgtggactcgcctgccgtccgcgcgccgggggagaagatcgccggcgtccgcgcgcgggggtggaactcgccggccgtccgcgcgcctggggaggagctcgccgatggtggcggtggggacgaggtggtggggagcagcgacggtcggaagcggtggcggtggcggtgggcaacggtgtagacggtcgggagtgtcagcgcccgtgacggtggggagcagcgcggcgccgttgagacagcttgctgcctcatgtcccgggagctggagctcctgctgtttttgctggccctacgggtgagcggtgactcggtgaggtcgtcgcaggttcggcgacggcagcggcgtggcccgggctgcaggtggggttctaccatgccaagtgccctgtcgcggaggacgtcgtgctgggcgagatgaggaggatcccacgctcgcgccgtctctgcaccggatgcattaccacgactgcttcgtccaggtaattaacaattttaattgcccaggctcaagctacttcctgctcgtccatggcgatcgatcatctgagtgttgattgcaggggtgtgacgtatcgatcatgctgaggtcgaggagcgggaagggggagagggacgcgacgcccaaccggagcatgcgaggctacgacgccatcaatcggatcaaggcgaggctggagagcatctgcccgctcaccgccgccgtcccgaccgccgccaccgctccccactgccgtcccagtcgctgctccgaccaagagaaaggccgaggggagagagataagggagagagagggggaggaagaagggaaggagtcccacaatactcttctttttttttttttgtgtgtgtgaatggcatatgggtcccacatatatttttaattctaatgccacataagcgccacgtagaatagagacttgatcaacaccgccgtgtgaataccacgtcagctaaaaccacctccaaaatcttgtttgcaccggttttaatagttggaggagccgatatacccggttttatggttggaggttataaatcgagggatagttgagggagtcaaagtatacattttccttctatataaagcgaattgttgggcctccgtctcttctccctcgtcctccgtcccctgctcgtcctcttcggcaagccgacaaatctgccgccggcgccgccgcatcctccttcaggccctctcccgcgcgccaagttggcaaggccggtcgtggtgctgccccccgctgatcgaatgtcttctccaagtcgaagaagctctgtgcccctccctcttccagaccccagcagcagcagatcagaaacgagtgccgtgaggagcgaaggagatgccgctgaggagaaatctgaagaacagagaccgggaagaagaagaagaaagaggaagcagcgaggaccgacacgcccgactatcgcgcttcttacggaagaagcgaagcagaggctgctgagggcagaggggcagacttcgcccggaacaactgtctcaccttttgctcctgcaccccgtcgtcctcaatacccgccattcccagaggatggcaatgttgaggatgtgcgcaagtggaacgacgagtgccacgaggtcagtaagatcatcaagaaaattgagaaaggtttgttagtttgcttctgaattttctttttccagtttcgctatttatttatcaatcgtctaagattttgcaaatccccaatttgggttcgggatttagggtttggtaggatcgagcacatgtctatattcatatgtcacttgatccaactttgttactccaatttatgagtattagctgaatacccgcgtgttgcaacagaaatttaaaaataaaatcttataatgcacattttagaggggcttttaactatttgccactcttacggatgttgcttaacgatttgccactaggcccacatgtcatagacacatgagggcccacatgtcatagacacatgagggcccacatgtcattgacaagatgtggcaaatcgttaattgccatgtcacaagagtggcaaatagttaaatttccccattttagaagccctaaataaatttgttttctttcagaacgtgataaagatatccctatcaagactgagcccaaggacccatacaccaccgaggccatacagagctcaagagacaaggtggtggttttgcaggcggcacgcgccattgtcagcatttcgcacatcatggatggtatgatttagtgacaaaataatagcaagattcatccaatctattcctctttagatgattacagcatcatacctatgtttgcagatgggcagaggcgaccacaatgtactggcattattattaaacaatggtctgatgacactgggcatcatcatgctaccatagtgacctattctaggatcgtatgcgaagcgggtagaaaacgtgatcccttacccaaggtacaaaactttcctttcactatagtgcttgcaggctctatgtagcttttcattctgttcttcttatgatgagtagcccctccacatgtatggggtagcttggtttagctacctagagcatgctgcattttaggcgaaaaattttccttgaatggtgcatattcattgtgcaagtgtgtgtttcaatgatggcttaacatccaattatattaatgtttcactattgtttttagtagccctagatgtttcttttgcccttcatgttttagtagtatttcggtacacttgccctacctgttcatttctgaatttttcttcctagccccattgttttgcttatggctatgcttaggccctctttgtttaggcttaggcttattggcttagacttttaagtcagcttattggcttatatgatttataagctagtgaatttaatgtcctaagtttagtggtggagtcatacggatatctcatataagccaaaaaagcttctccaacctagcttttggcttaatagtggcttatggcttcaaaaaagccaaacgaaaaagctgcttgtttgtttaggcttagactttttggcttataagttggcttataagcctaaacaaagagggccttatttgtacggcttattagcaacccaaaaataatttgtaggtaatttttttacatacatgtcgttagcgatttgaaagtatatgttgtaaaataaactatgatgaaaaaactttaaaatcatctccaaaattaagttctaaaaattcaaaatttggattaaaagcatgagcataaatgaaacgatagggccatatcctcacagaggttgtgctgtccttttgattctgcctgcaactgcttgcagattctctttttccttttacattaagcgaatatttgtacctcagttttcatcctatagtgctcttaaacttgttccatggccttgttgtgatatttcaacagtatcaggtcttgttgcctttgccacattacaacatcatcagctcagcttgaccatagctagggtttgtccattctggagtccttgtttttgtggtgcttttatgaccaactgttatttaatcttgaacgttgcatgcggctttgctatttaactatatctgatcaacatccatcttaattttcagctatctgtttgcttaccgaacaagaagactgtcttggatgcggagcttatctacttcaatgatcattatgacattgccctattacatatcaatctagaagttaccatggagctcccatcttttggacgtggcccagagtatggtcaagaagtttttgtgttggctagggatggagaggcatccttgagggctaggcgaggagatatccaatggttagaagaatcagatattttagggcgtgaccactacatgtttctgagctgtgacatccctgaggtaataattttctttctttgtattttattattattgcttaattgcttatttaattctgtagtatttctttgatgcagggtgggaatgaaggaatggtgattgacaatgatggtgtagttagagggatggcaatctattgtagcccctatcctgctgttacttcaatttctactattgtaaaatgcattgacatgtttatgcagttcaagtaagttggctttttcagtcatccaatctatgatcctcacattagaacttaattgatctctatctactgaaataaatggaattatgcttagtgaatcccagaattgaatgtgtgtactggctggtggcattgctgccatcgcttgcatgctagtgtggataagtttcagtattagatgtataaacctggtatgaaatgctaactatgcattggcatgtttatgcagttcaagttggcttttttcagtcatccaatctatgatcctcacattagaacttaattgatctctatatactgaaataaatggtgttatgcttactgaatctcagaattgaatgtgtgtactggctggtggctttgctgccatcccttgcatgctagtgtggataagtttcagtattagatgtataaacctggtatgaaatgctaacttctggtaaacgtcgagttcagtgtaagattaagtacttaagatttaagttctcttggggctgatgtttcttgtaatcaaatctaacatgtggaacgattatgtactagaactaaatcgtattcttacgccatctcttggaatgctgctagaattttaggataacctaatgtatctagtcaatgtgccatttaggataataaaatggtattataagggtggttctaccattgtcctggcatgaaaatgtttgcagttcaattttttttactatcaacttgtcaacttttctcagtcaggttgctcgccccctttttggtattggtgtcagaacaatagcgctgttggatgtgcagcttcaggaggatatcagtgactttggcatcaagggtggtttccttgtagatagggtaattaaggctgttcagtatctgtatgcattgtggatgctattgtaattttttttttttgtctttaggtgtataatcctgtcgccgaggatcttgggataaagcgtggtaatgtaattacttctataaatgggaagggtgctctaacgttacctgaggtgaagagaaacatcagtcaatcttgatgcaaatgccgtcgctaaatgttaaaaatttatgtgcagctggaagattatcttctattacttggctggggttatttggaggacaaactaaattgcattaaagatatcaaggtatgctcaggaggtggattagtgtatagtacaacccttttgggattcattactgtattatggattagaggtattgtggattagagtattgtggatggattagaggtattgtggattagagtattgtggattagagtataggacaatcccaaaatgtcgtgtggattagagtataggacaacgcttttgggattcattactgtctttaaacactaaaatacttataagtcaaagtttggtattagtaattgaaaataaggacaaaaatactaacgcttattcttttttatcagcttagagtttgtgatctcaagagtggtgtggaaatagatgtcacactgcctgttagattctatgataaatctgagagggtaagtccttaacctaatgctgtggttttgagaatactatatttcacttccacaaaaaggaacatttttaggttttgagaatactatatttcacttccacaaaaagggacattttttctaaaatagtattcttttttctggcacacaagaaattacgtttccgtcatgatgaagactgataggataggatgggctcagatgacacctcgtagtgccatggcttctggtaactttttctcccactcttatttccaggtttttctccccttaatagtttaattgcaatagttattcatattgcatcgatcaataatgatttttctcatcatttaattgcagagcagtctggatgttttgcttgtgttctgtcatgctgctgatactagttgcaaggtggggagattgttgtagatttgtcctttggtctatccatcaagcgatataatttggttacacagtagctttaatgtaaaatggggttctgaattcttttttttttctaaatatttttagcagaccagtatttttatccttggttcctgagtgcgaatgacggcagagttagtcgtttattttctcgtttaattttaccacaagtgcagctcacccttcaaataattcatttgatccgaatttaattctatcccgaatatcacaccacttaaattttacaccaattccaattccatccattttatttttctccatctttttctttatctccttgtataatttttccctctcgcattcttatttctttctttttccatcttttctatcattcttccatcctttccctctgtttccgctctctcccctccttgccaggtcgagccgtgcttgtgccaatcccgcgctgagtttgtgctagcccgcgcacgccacacgctcgcacgagacggccgacggatgaatgctgtcacaatatctccttggtccttccacaagactcaacatcggagacaaaaggatcgcatattcaacctcttccaatgcttgcagtcatacattttcaaatttgaccttgaacatttaggcctgtatagcacaatttgttatctgcaaggttttataacattggaatatcatgtaaatgtctggttcatacctcaagagctcccaatatacagctccaaactctggttcaaaagttacagaagctttccaagggaaagagttaaacttcaaactagagattttcaaatggcatgacaaatacttacacgtcaggaacttttgaattctaaaactctgaaatcttcataacaggtaaaacaactcctggttttcgacccaaaaaaaaaaagaacgaaaaaaaaaaataggtactacaactacaagtgaccaatcttcagtctctccatatgtttgcgcctgcacaagggttacgggtaatgcccaacataattttgaattccataacagaagcagacattctcagagtcttgattaagtaatcattaaaaaaaattaaaacaattttcaaatatgaaaccagatgatgacaaattggtctactctctgatggtgagacgcagtagctctctgaactcgaccctcctggtctcaacatgcagcgtcctcttcttgtttggccagtacgtcacccatatcctccccttcatctcccactccaccgtcttgcccgccgccgcggcgggcatcctccagcaaacgctctcgccgtactcatcgccggcgaagatcacgccgccgcccctggtgaacggcctgcccgggttggtgtaccggttcctgaaccatgaccgcggctggagcagctcccgcttgtgcggctcgctggagaacacctccctgccctccgcgccgccgtgcaggaaccagttcagcgccgccgtgttgccgtgcaccgagtgctcgaacttccatggccggagtgtcctcgtcaccgtctcgtgcgccgacatggtgatgccgatggtcgccggtgctgcgctgagcgtcgcgtcgaggcccatctctgtgtcgacctcctgggcggggttgtccgtcgaccggctcactgtcagggagaggatgtccgtctgcaccagcggcgtcagctgcagtgatatccgcgacgggaagtgcttctcgtcggagccgtagccctgcttcgccatcagcgtctccgacaccagctggatcaggtcgcacctgcaaaaccaccagttcttgggtgaacactgttggtgtccaagaatcaatggcgaaatggattagagatgaaccttatgttgtcgacgttgacggtgacgtcgatccagttctccctgaaggtgactctgtagatgaactggatcacggcctccagatgctggtagttcagcgagaactgcagcttctcatctttcgtctgatgagccgggtgctccatgatcatggcgaccactgggcagtacagctccaccttccacagcctgatcgccgagacagcgtaggagaagaccgtgaaaggcgacaccggcgtgccacctgaccggcgagtctctatgatccagttggtgacggcgaggttcagtgaccgcatccactgctcctccatgtctgaccccatggcaagcatcagcttcttcgcagcaccccacatgtcgccgcgtatcagctgcgcactgaccgtgccgatgaggtctcgtcggagggtggacggagcttcgtagatgcagaccatgagtgcaagagtgagtgctgccaggttgaagattttgcctgtatcttcagatacctgaacatttggcagcctgaagggtgacatcttgttggagtaagggccatacctgaggaccccgcagatgatatcgtggaagaaatggatggcaaaatctgagccattaacagatttcaatctggaataatgggagctccagagtgagactggatcatggtgttcagcacagatggagtaagacagattgaaggattgggtttcagagtgccagctgatgatgaggttcagagactggtttgttgatggagagttgcagatttgaagatagtaggattttcccctccagtgcttggggttggggaggcttctggtccagtgccagatgtcaggagcaacggcagaagccatggatgaagaagagctccagctctatgaactccatcattgctgtccaagaaattaaatacagatacaaaaagtgaattagaacacaaaagatggcaaaagtcaacttttttaccaataagaaagcaagttgagaacaactataactctagtttgccaagattgcaaagtatttttcagataatgtgtagattcagtgctctcaaaaccagtacatctttcagtagagggaagcttgcttgctaatggtacacaccctatatatactgtgagctcttgtcccacggtttggaaaagtagctcttttaggaaaggtatgcattggaggaatattttggactgtagataggacaggataagttagcttgatgcttattaaaagggtggcaatatttcatcttacctttttacaatagccaacttgcaagaaaacaaacatgattatgacaagtatttttctgcttattacaggcagtatttccaactccaaagtgaaacttctctctatgacagtataaccagggtttaatcttttggtttgaacgtttctatcggagggtgctgatatatcgaaatttctgaaatttcggtccgaaattttgaacaatttttcgtcaaatttgaacaaaatattgccaaattcataaaaaatgaaaaaaaaaatcagccgaaataatatcatatcggggggagggggtccgatatgaaatttcggtccggaattttgaccactgatgcagcaaataatgtttgtggaattgtgcccaacaaaataatgctctagctcctactcggaagtctgaaaaaggatgactttggagcatctaaaaataggaattaattcttacctttaccatgtgagaatagaaccagatccttcaatacatgcttatccatttccatcagttatccctccatttaagctttttgctgagctgatgattttgctgagttcgtcaggataaaacgatatccctacaactcaaaattgttgggtagctcgccatacatagaactctcacaagtagattgagatggcaatatgtcaattcagtggatactacttcatctgtttcatattaaaagattttctagcattgcccacattcatatatatgttaatgaatctagacatatatatgtgtttagattcattaacatctatatgaatatggacaatgctaggaagtcttataatatgaaatggagggagtagtaaattgcattcagtaagtgcagctaacaaaagttatttgctacttgctagatagtattataaagcatgtaaatgtaaacatcattgacctcactagttgccatttcagaagaaaactattctaattcaatgaacaattttaagttgttctagcttgttccagtaatcaaaagaagcactctcacacaacacaggaccaatatgtagctattggcatattgacctaactaaattccaattcgtagagtcgcttcatggcaaactgcaatgcttatctgcctatgacaaaaggcataatatccacacttttcttttcgttttagtataagggc

SEQ ID NO: 5415 - DNA, 66118 bp, Oryza sativa
tatatcaactgagttaacatacaaatataagcataaaccaaaccacatagctcagctatgcaataagtaatcataactcgacagaaagattaatagaacaaaattgcttcatactccagaaaacaaactgaacacgcgcagttctggagataactatatttgtgggctacctttacagaggagcatatcaacagcaatgagacaaacttacatcagacatcctaagtaaatgtaaccgcatttaatttgtatcagatagcacattcatcgcctccaaaacttgataataaaaatgtgtatcagaaagcacattcatcgcctccaaaacttgataattaaggttgtttactggaccagattcagatttcagccttctaagatcaagtcacttcttggcgacctgtaagatctatctgcatatgacaaactgcatgagatacaccatgttcttttcatttttagaataagggaagtccctttccattgtaagatctacatttttagtataggggcagtcgttttccattgtaagatctacatttttagtacaagggcaatcatatgcccaaaatatcagtcagaaactcagagcattcaactcaagtattttaactacagtttcatcaagttcagtaataatttattggttgacggaatcagggaaatgggtactagtgattgcatcaaaattcacaataagacaacaatagtccaacagataaatttatgaaaactgtcaagactacttcgatggtgaacatgcgaatccaagcatcacagttcacaatttgatggtcaggccaggcacaccaacctgtctattatgataagaaaacagatgcactatgtctgtaccagtatatcaactggattaacctatagttacaagtttacaaccacaaagcacatagatatgcaataagtaataataataactcgacaaaaacaatgacagaacaataatgcttcatactccatcaactaaccacaatcatacagttgtcataggttgataatcctaatatatagagcatataaacagcaagttggcatacttacttcagtgagtaaatgtaagacacagttaatttgtataagaaagcacaatcacgtttcaagaacttgatggtaaaagttgttcactgaagcagattcagattctagccttctagatcaaatcacttctgggtaaattgtaaggattatcaacctatgccccccaaatcttaatgaaattggtcagtggttgcccggcaaaaaaagattatcaacctatgacaactgtatgattgtcatatctacatttgaagaacacgttcccaagttacgagccagactcagagcattcaactaaacagaatttcagctcttgcttcacaatttcagtaatttattggtctaccaaatttgggtactagtgctacatgaaagttaacagcaagtccccaattgtccaacataccaatttatgaaaactgtcactccaacatagctggtgaactctgaacatgtgaatctcagtttcagagttcacagttcaacacacgtctacctctatatccagtatatatatatatttctttttctgaatgaaccagcacaagaatgtgcttatttcattgatagagaagaatttgattgcaacccctatgggagcaagaatagctgtacacagtaacattatatcagctgagtattaatatataattacaaccataaactgcatatctcagctcagcaataagtaactcgataagaaagaaagaaaaagagtaaatggaacaggcttgattcatatatagttgacatcccacaaaacaaactaattaaccacaaagcatttctgaatctgattatgcttgccgactagtaccttacatatagagtaggtcaacagcgacggcacatacttacatcagacatcccagataaacgtaaaccgcgattaaatttgcacaattagagcactcaatccctcatcacctcgataacctaattctaaaaaaagctgttcacccaactaggatctccactacgattacgatttgcggccaatgaactcatcacttcatcctgaacctggcaactcccatggggacagaccacccgtacatctggacatagttgcgaacgacttccgcggttgcacagcacatgacgagcagaggcaagacgtacctagggacgaccgtcgggtcgtcgcggcagaggatggtgtggaccagcgcgccgaggcacagggccaccgcgacggcggccgccacgaagttgttcctgaacagcctgtacctggcggcggcgtaggcgtcggcgccgggggctcgcttcggctccgccgccgccgccacccgacgcgccggcaactgtgcatccacatccgcacccgcatcctccgccctcgtcgtcttcttcttctccatcgggaatcggcccaggcggcctacctagctagggctagggtttatcggtctggccgatggcgggttgagtagggatcacttccttggcgcaacgctgcggggatgtggcggcgccgccgccgacgacgacgaggagattcggggaagggcgccgccgccgcggcgaaaccaaagcgtgtgcctcgtgaactcgggattggggtcgaagggttttagaaagcggaacggatgacaggtgggacccactagttttgggcggtgagtcgttcacgaatcgaatcacgagcattcgcctgtcgcgaacgtctccgatccgaccgatgttgtattgcggtggcaaaccgccaaaaattggaagaggctcatctgacgtaaagtcagatggacatccttactatcgtgtgggcatatgaagatgggtatcacccgtcagcgacccaggtcaggtccctctgacggtacgttagaggagctccgtccacggaattagcataccgtcacctaatccattttagaaaaatcaaactcgatatttttttaactaatctataactaatataaatattcgtatttttcgggtcatcacatctaattttcgtccgtacacaatccgatttggttagcaatagggatagaaaaaattgcaaaaaaaaaaatatcgacggccgctgacatcaccaccgccgaccaccgctgccggagggagaagagaggcggcggctcccagcggtggcggcgatcgcgggcggatccggcagcggcggctctacccgcggacgccacagacgccgttgtcgccgtcgacgctgccgtagggacggccgtcgccgagggagcgcggaccccgacgatgtcgccgcgctccccgccgtcactcgcaccgtgctgatgagacaggagggagaggggagagggagctgtccgccgtcgccgctgcaccccgccgtcgcccacgccgtgccggtgagacgggagggagaggggaagagggagcggcgccaccggaggggaggggaggggaagcggcatcggtggggagaggcggagggggagaggcggcgttgggggcgggggaggcggccggttcggctggggggaggggaccatcggaggggagcgggaaaggcggcgtcgggggcgggggaggcggccggctcggctgtgggggagggggcgcatgaggggaggggaggggaggggaagcggcgccggagggagacggggaggaggagaggcagcgttgggggtggctcggctgggtggagggggagggttagggtttttaacgatttggaattgatctgagccgttcatcaaaacgaacggctcatatcgatcgagcgttgggccgcacgcgggccggcagatcagcaagcgagataaagagtatagggataaaaattagacttttgtcgcttgcgggctgaagaagaaagtgggctgaaaaaggcccatagagataaaagaatttttatttagatttttatttaaataaatgctaaaatgatgtttgtattatcaaaattagcaattaagctacgaaaatttcaatgagtgtaattaataatatagaaaattgaataaacattaaatccaaccataacattttatttctcacacttactttaattagaaattaatttaattatataactaactacttaaaaaatatccaaatatttccaaccagaacattttatttctcgcacttactttacgtataaattaatttagttatatacctacctacttaaaaaatacccaaatatttcagaaaaatacccaaatacagcatacagtaggttacatatacttgcatctgcttatgttaattcaatctatcatttgcagccaaatgtttcctcggctatgtgacctgcaaattaaactcaactcatctttctcaccaggtaagattgcctacacattacgtaccaacaaagcttttatatataacatgctttacaaaacgtgaactctttcagtagagaattatgtgtgcccttcttacgtacgtacgatgctattttgctgaaaatctgcccaatgttggctgaacacttcatgagctagaaccatgatgatgccaatgcagtcattgtccctgagtccctcatcctgaaaaggtcgcactcctcaaacaaatattgctagataggagtaggctccttggatgtgtgacaacccctatcctgagccattgatttaacatatgaacttaggggtaagattaatcaaacaactgtcgctttttaaagatgtttgcaaacaacatatgtgcatatttataatcaaaccatcacatatatatctgcatgccttacatggttcagcactctttgctgaagacaacttctctcaggacacggaacgggcaagttcacagatcaatcaaacaatcacaattcacaaaagccacagcaacagaggcttccattacagaatccacaatccagatggatacgaactccatacaccagaatagcagaaagttactttttttattatttatatttatatagttggttataggattacattggaaatctattactgattgatcgatataatctgacagttaaactctgacaaagctaacagttgctcaatatatataattataaacatcctatggctaaaactctgtaaaactactccggccaacggcggcgagctctagccgatccaactccaactccggccggccgtccgtcgtcttctccaccccgatgacctgcaaacaactctaaacacaagaagcagcaaaagaaaatacaatctgtagtaaaatatttgaagctgaattcagaaatggtgaacctaattggcggcgacggctgggagcggcggcaggaaagccccgacgatgctgtggcggcggcggcggcggcgctcgtcctccccttcttctccccccactgcttccgccgccgtcctcttcctgctgcggctcacgctccgatgcagcgcctgctccatggcgccgcagaaccacccgaacctgtcgctgcggacgaacaggcggtagtccacggcgcgcaggaagcgccgctcgagcccggccatctcccccgcgtggatcgccgcgtcggagctcgtctcgaacacggaggtccacctcgtcgggagcatgtcgctggtgttcccgaacttggcgcccacgaagaccgctgcggcgacgaggcggtgcgccgtggacgggtcgacgcggatcccggcctccaccgcggcggcgctccccaagaaccgggtgaggtagatcccggcgaggacgtagcacgtggcctggagccggatgtcgtggcggacgctctccagccggacgaaggcgtggatccgctccaggaactccccgatcgcgacggtgggcgtcgcgccgccgcggaaggcgcggacgaggtcggactcggcgggccgtgtggcggcggcggcgtggcgggcggcgtcggcctccacgatcgcggcgaggagggagagggatcgagggatcccccgctcgtcgtcgcggaggacggggtggtcgccgtcgtccgagacctccacggtggtggtggcggcggcggccatggcggagggagagggaatcgcgaatcgcgagagggggattagggtttcgcgaaaatcgcaagagggggattagggtttcgagggagagagggggattaggagaggcgtacgtatacgggtatcttgatacgtattatacacagcggatggggcaccccgcgtgtagcgtacgccgtacgcgtaccttttttttttcttttttgcccttcctttctttttttttttcggaagctttgggcctagctagcgatttgggcttgcctgtaaaaaatcaggcctttcttcttttttttttctggataatacagaagtccctcttaaaagacaggattccacaatataagaacttaacgagtcttaataaatataagtaccaaaatatatactagtttcgtgaattttaatatttttcaacttcagggatatctcttttcatgaaaaattccaaaacatgcattcttaatttttcaaaacttgttcgggtcacgatttcttttgttctcatctctctcatcccatcacacagatgttatttcttagcaaccaagcagttctgagaaacacaaagtgttgtcacggcatattagcctgatgataatagagaccaaaaatgtgcactctgcatgctgcttatttttcttccaaacataaaaagttaagaacatatgaaaattgattggatagcatgatccattgcgtcactgcgtgacactggtaatatacatataacttacaccaacaaaagatcattatcacataatcctagatcttggcatcacatatattacaccctgaacaacaaaggcagtaaatacatctcatctcaatgccttcgttcccacttcccagattggacatattctgcagttgaatcctgcattgtggttctttgccatttggatcatcagtcaatgtgagaagagagccctaatgagcccgtagcccgcaaaaccaaggccgaagagaaggaaaccgtagtccccccagcgtcgccacggactcatcgaggaacccacaatgctcagatggaagatcgtaggcagcacgaaggagagcagcgcgcaaaccgtgctcccgacaaaggagatgaaggacccgaacgcaggtatgaaggatgccaccacagacaggatagttaccatgacgatgcggcttgagtgcaggcccacccattcagccccgcgaaccttgtgcgagagcttcgggaaacatccacttgattggaatctttcctcgacaatctcgtggattgggtgcatcatgactggaaatgtgaataccagtgctatgcaaagaccaacctgtcagcagattttcaaactgtcaggatccattacatacctaaatcagtgctaattgctattttttaagtccaatttgatgaaagtgacccaaatattttaatttccaaacagcagatctcaggcaaaatctgtcaggtagttcatgatcttatattcatatctccaaatataaaataatgaagtctcaagttgcaaccgcacaaagtacatgctgacatttacttcaaaagaaacaacatcaaataaattatgactagtgcactaaccttaacggcagcagaagaccaactattgggaagattaagtgttatgatgtctttagtggcctccccataggctaagtaaccacaaactccaaaacatgcatagacaattatgataccgacaactgcttgagaaagtacccagcggaattttctccgttctgccattgatgattctagtgccaaagtcatactgaatccttcgaagcagaagaccgcaactccaaaagtgaatggtatcgcccaaagtccattgaaagcacttctattcgcaaatgggtgatcaaaaagctgaagatcctctttgataacaattgccatagcaagaacattgcagacgtctgcaaatatgctgaatggggagagagaagatagtgaacggatgaatgatagagcgatttgcataggcaggagaatggcaaagatgaaggcagctggtgacatcaactggctgaagacagaatgaagattttggccaatgaatattagataagctacagatccacctgcttgggaaacaaggatgaggatttctgtcaagcatcgacctatagtgccaaaacacttttcacccaaatcaccatatgtatagtgaccatggtaggtttcttcagattctttctcttccaatttatctctgcagtcaaccttcatgttgaaaaagaaaagcaagtaattttcgtaagaagatgaagcaggtaataaagttatgaaactagcgtttacaattacagatcctgtttaattcacttatgttaaaccaaattcaacacaaggtagaaagaacattgtagacttacgcatcctgtttataatttattgatgttacaatcaaaattctaccaggcaatgttaagcaagactgaaaggaacattatagacactttgatttcacattaaaaaacccagttgaactagatcaacatgctaaacgaaaatcaaataatacataagtataatagaatatggagagagaagaatcatgatgataagacatacatatactggcgccccttactttggttttgaggtcctccaatttctactgaatcactatgaataggagatacttctgtgtttattggaaccaaatttgcgatgtcaaatgaaacaaaaattgggcatagtaacctcatctaaaaatgcatgctaatccaaaaccagagtacgcgctgattgactgcgacagctagcactataattgcaacaaccaacaattattatactttcagttccagagtttttgattgattacagcacaacaccatttccctcccccacccaaaaaaaaacagagagagagattcgattaacaaacagagacaaacagaatcaagcaaaaaggggaagaagtctactgaagtagtagtagtggtggtggtggtggtggtggtgaggcaactcacgaggaggagcatgcagtagagcgtggcgcatccggcggcggcgacgccgagcgagccggcgacccagccggcggtgcggaacgcgtaggggaggccgagcaccccggtccccacgatggacaccaccacgttccccagcgtttgcgccgacgtcgcccggccccttccccgcgccgccttccctccaccacctcctcctccccacgcgccgccagaagcggcgccgccccctccatccctctcgccgcgcttggcttccggagtcactccactccctcgctcgcagttggcgcacgacgaggtggagctagccggggttggtggctgaaatggaagggagaggagacggcggcggcggcggtgtgtggattggtgcgagggaatcggcggcgacgacgacgacgagaggattccagggagggagttagcccggcccacgtggggatttttgccggtttgggatagctgtcagtcagtccagccgctaagctgtaaagtgccttatcgtttcagctatgctcgtgcttataacattctgtaaattttaaattttaaaactcaaaatttaaagtttattttatagtattttttcatattttattttacaatatgtattttaaatagctaacgacgtttatataaagttttatgggagtagcatattcatgacgtcatattttttttaaaaaaatagtcagcatatatttacattgtaagtacctaaattacatatgtaaatttagtgtatttataatgtaagattcaaaattatgtatgtaagtctcaaaattacatagtaattacatgtgtaagtagtgtgtatgtaagtctcaaaattacatgtgtaagtggtgtgtaagtgggatagaagtagggtgtaactacagcgtaaatttgtataaagaatagaatgcatgcgtgtaaaaccatcataagtttgaaacaatgaagatgctaagttttaattaaggggctgtctagagatcatttgacagaaaacccccatagaaatcttgtaaattttagaccatctgattgctttaagattcgtgcaaccaaccaatccctaaagcaccgcctcctctcccgtttcctcctcacgcggtcacgccgccgctctccctagcgcgagcgcgcgccgcctccgccgccgccccagcgtaccgccgcccggcctcgccggctggccggcctcctccccctcccccctcgcctcgtcatcttcctcgtctccggtgactcctcgccgccagatctggcaccgtcggccaccacaagacacaaactcgctatgcccccgccaccaacaccggcccaccggcctcctccatccccgcagctccggcgccaccgatgcctcgccggccgcccgttccgccgcccaccaccaggccgccgcctcccacgaccatccctctaagctcggcgaactcccccttcttccccctcccctccccaccccagaaccctaattcgtcggccttcgccagagtttgggttgtcgccggcgtcgaagaagaaaaggaagagttcgtcggagttggagaagaagcagctagagcacgaatcgcgaagcacatctagtgaaccaaaatttgcaagatttagaggtatgttttttgtcgactgatgtttagcaattccatttaattaatcatgttatcacagccgcaacgtcagttgccacggcaatatgcacgaacaggatcacactggcacgggacaacgaaatcgaacactgaccgtgacggaggagaaattgtgttgacacaattctagcgattccgaagttttatttgtatttttttaagctaatatgcagtgcgaatggcatgataaacataagtgaaacgatgataatgttatttttatcatttgtggatgatattccatctctctggtgaagggagcgaagaatattcaaagcatggtgtgaacttatagtaactttaggctgctttcgtttgtgttgattggaaaccttccccctctagcatgaaaaagagatcaactcattagcatataattaattaagtattagctaaaactaacttgaaaaatatattaatatgattttttaaaagtaactttgctatataaattttttgaaaaaaaatatatcattcaatagtttaaaaagcgtacacgggaaaaacgagagagatgagatgaaaacacacacaaaatgtatgggagtatgtttgtaagccctggttcgttttgttgtcaatttttagccttaataaatattgatgattatcaagttttaatagaaatcaacaaaccaaatatattattaccgttgtcaccctactaaaatttcaaaaatttccacccttaaaagctagtaaagaaccatgccaagatttgataaggttaatatcaaaatatgccaaattttagtatcgtcagattttgacggggatggttaagtttctataacaaaacaaacaagctctatacaatgaatacttagcatcatatatgtacgagcgcacccctaaaaaaaaaatcacccctcatatatgtacgagcgccaaaacccgttctctcgtatttattttgatatagtaactaattaatcactctgtcttgtagaatttctgactatgtaggtgaaatatatacatagttaaaaatatgggctacagacatattaggcctaggccaaaaaatatgccttcgacaccctttaaaggatgaggcatgtatcatgctcccgagtaataaatcttccgggggatatagaccaagtgtagcttatatgaatagcttctgatctgagcgattatcctttatgggatactccaaaatagatataacaattgaatcccgactagcgcaagtattcggttgataacccttacggggaataataaatagtccagtctttgagcatagaaaatagacccatgatcaagaattcatgttgcatgtatccggaacaagtctaaattgaatgtatcatacttgtgtttgagctagtaagcccctaagcatatagattgtccttctgtcgtagtcacaattgtccattgatggtagctgacgcagttggcatagagacaagacgaccaatatagagataatattgcccactagaggtggcaaaaatattggtggtagtgaagatagtgataccaatcaaaagtgatgaaattgcacagccatggaggtgaagaaaccagtcggcagcagtcaggtcagctagcagtgaagatgaaggcgcccaacaacaatgacagagcagtcggtggcgacgaaagcaagccgacgatgaagacgtagacgcgcatcaacggtgatggcgaaatccaccaatgatgaagatgaagaaaatagtcggcgacggcaaacgcatccaacggtaatgatgattagcgacaacagagatagccggctatgatgacgaagttgcctatcaacggcagcagagtaggctatgttgaagaggcttgacaggatgttgatgaagatgacgatgtcggcgatccagtcaatagcggtgtaacagccgatgaaaatgacgaagacgctcatcagtgtttgcatagtaggtcaaccatgaaggtgaaataataagtcggcgaagacataatcatccattagcaacaacagaaatgtcaggccgatgaagtagaggagctggtgatgatgtcagtgataaaaatccatcaaactgctaagaagatatcgaagctcgagtagtttccttggtgcgagcgtgtgcatagcaaagattgatgcaatgccccttgatttataaagatagcagtagaatttggtgttatagcttttgcagaagcttcacttggaggaaaatagatgatgtcgtccaactcattgaatctgagttaattgattgaactccaaacttccgaacatatagattaaatcttgaacttgatacttgagatttttggagtagattatgacagcgttgagaagccaaaattgccagtaaaataattggaattgctgagactgctttggagcgaggacgaagctgatgactcccgaagtagattccatagaattcgttggttgattaattgattgcttcatgttgacataacatctgtcgaattttgagtcttgtatttgtgtagcccccgactctttggttagttgggaaataactgaagtcgagaactgtagcttgtcgtcgagtagccattgcttgagtgaagatgcgtattgaagatgtccgagtagaattcatggtgacaaagttgcatagccgtgacgaagtgagcacgagtcggcggcaacagaagaaaaccggtggcgaagacgtgtagtcgtgaagatagatactccagtcggcagccgtagaagtgagagcactagtcagcagcagacgagacgaccggcagtgaaaacgataaggtcaaccaacactggcagaatcatgcagtcatggaagtgaggaaaccaatcagcagcagacgtagacagcttgcattgaaaatgatgacgcctattagcagtggcggcggcgacgtggccagccgtgaagacaatagcaccagttggcgtcatacgaggcggccggtcggtgaatatgtagacgtccaacaacggcggcataataggccagtcgtgaaggcggagacaccagtcagcagcggcgaaggcaaaccggtggtgaagacgtagacgcccaacaacggcggcataataggccagtcgtgcaagcggagacactattcggcggcggcaaaggcaagccggcggtgaagacgtagacgcccaacaacgatggtgtgaccaaccaaccgtatagacgaagacactagtcggcggcggacgaagcggccggtcgaagaagacgtagacgcccaataacagcggcataataggccagctgtgcaggcggagacaccagtcggcagcggcgaaggcaagccggtggtgaagacgtagacgcccaacaacggtggtgtgaccaaccaaccgtgtaggcgaagacaccagtcggcggcggcgaaggcaagccggcggtgatgttctgactgatccattcctggagcgtaggggataagcttaaagccatgaatcccttttatgcatatctggatctggatcctacagaacaatcatataggatgagtactatctgatgtaaatataatactcgaggaaaattcaggtattttaaaatgtttataaatatatatttctcctcttgtcaattttgatttcctcgagcaaatgactccttacgtttaaacactctgcccgactagtcatagcccccaagcactggaagtcgtcattagtgaaacaaagtttcacggatcggagtttactacttaggtacttttgcaattgttaagagcagaaaatagattcatcttatctctatgcttttgatttattccgaataatacttagcacattgcgttactcggtccattcaacgagcccccgggtgctaggaatcagcccaaaggcaactatccatcgacaaaccaaacggaaagcataggaagatagaactccataactcgataggcacttttgtactcagattatatcacaagcaatcaagataaatattatgaaattcgttgaaaaaatgcgatataacatatgtagcccccgactcgctactcaatagagaaccaattgatgtagtgaggcagaggaaaaggaaaatatcatataaagaaaaaaacaataatgacttagctttgtaatattccccttggtgatggcagaggtgaccaatgtgggaacaaagtcatccatcaataacaatgaagacaccagtcggcagcgacgaaggcggtcgatggtgaaagcgaagatgcccaccaacggcggcataataggccagccgtgaagaagatagcatcagttggcgtcataacaggccagctgtgcaggcggaaacaccagtcggtggtgtacgaggcagccggtcggtgatgatgtagacgcccaacaacggcggcataataggccagccgtgcaggaggaaacaccagtcgtcggcggacgaggcggccggtcggtgaagacgtagacgcccaacaacggcggcataataggccagccgtgcaggcggagacaccagtcggcggcggcgaaggcaagctggtcggtgaagacgtgaacacccatgaacggcagcataataggccagccgtgcaggcgaaaacaacagttggcggctgcggaggcaggccggcggtgaagtcgtagacgcccaccagcagcggcataataggccagccatgtacgcggagacaccagtcggcggcggcgaaggcaagccggtcggtgaagacgtgaacacccatgaacggcggcataataggccagccgtgcaggcgaaaaaacagttggcggctgcggaggcaggccggcggtgaagtcgtagatgcccaccaacggcggcataataggccagccatgtacgtggagacaccagtcggcggcggcgaaggcaagccggtcggtgaagacgtgaatgcccaagaacggcggcataataggccagccgtgcaggcgaaaacaccagtcggcggctgcggaggcaggccggcggcgaagtcgtaggcgcccaacagcggcgacataatgggctagccgtgtaggcggaaacaccagtcggcagtggtgaaggcaagccggtctgtgaagacgtgaacgcctatgaacggcggcataataggccagccgtataggcggagacaccagtcggcgacagacgaggcggcctgttggtgagacccccgagcatgtggcgggatgccccggatgcacgcgccacgggtgtagtcgggccgcgtcagccacgcaatggatgaagcccccgggcatgcggcgccgttccccgagtgtacgtgcaaacaaaaaggggaaacaatttcagcagcatcaatgaattaaatacatatgtatatacgtagatgcaaagtcaaataatgcatggagtgtttgcttgctcccagataatcattggtcatgtcatgcatgtagaccaatagttagttgcatgccttggattacatgcaaccaagacggacggcctgatcatgccagaccacgcgaaatcgcgcgaggtcgtgtgcggcggctgtcagccggtggtctcgcgcgtcctcagcgtggacggctgcttgacgtacagcggcttgcagcggttccaattcatgctcctgccgtgcgcgcgtacagatcgcagaaccgagattggatcaaatccaactcggtggcttcagacgatatgggaaacggactcggggcgacgaagtgccacggccccgttcacgcgtggtcacaggcccagaaaaatacatgcatgtaaacagatagattaatctggttaacatcaggagtatatatgcatggtgcatgcacgattaattaaattaacgatgcgtgtgttgatcggcggatcaactcatgcgtgtaatttctcctggtaaagtgtgggcggctgctcccatgcccgtggtggcgacgtccgtcggcgctgcttcggcgtttgactcgcgagtgaataaaacctctatgtacgagggcgccgctaacagctgcactttgatctcggccgaccatcacatgaagagcaagaaaacaccataagagcaaatcacaattagaaattaatctgataaaacttagattggaacgaccaacccgattaaagatttgggccattgaaatcaataagattgatctcgacgtttcttcctaaagttgaatccatcatacttcttgataggaaactcgacgcactcctacctggcgcgccaactgtcgaaacatgaattcggcaataataaaaagggtagcgcatgagacctaaaagtggatggatacagagacaaggatttagacaggttcaggccctctcaatgagaggtaataccttactcctgtttggggatttgaatccgccgagtgtagtatagatctgacgatctagttgtctcatgctccctagagggcctctgcccaccttatataggatagggggcatgattacaagatagaaaccttaaccaatacggtatcggttttctaaatctactttacaatcttatcaaaccagggctttaggccgttccataatatacagggaaacgtaatacctaagtcatgatccgttacatatttcatagatataagttatcccctataactagtcggataaccacgccgtgtgagtatggggtacccataatctccacacaactcaactgttcacatacacaactcaacaccctaaataaacagagaaggggcatcgacaaaaaaaaaagaaagatttttttaacactggccatgagctagtgatgagtgagtgtgagcgagaatgaccacacgcactgattgctcccatctatgccgatggcgcctgccgacacacatcacatgatgctgcatccggcgttagggacctcgtagcattgctgctgttggtagtacggctgctagttgccgtagtaccatccctggtggtcgtacgacgccgtcaccgaggccactccgtagtacacaccgaccatcggcttgttgccaccggcgcacgagccgcagcggcacgcgccgccgccgccgtagccgtagccgcaaccgtcgccgtagtatgaggactacttgtacaccgggttgccgggttgtagctgtagcatcacaggaagtcagcgggcgccggcgagatagacggcacaacgacgcaagccggcgggcgccggctagatggacagcacgacgacgccttgcacagctggcacgggtggcaccatcatcatcggcggcgcgatcagctagccgcgtggcggctcgaggctagcctgctgtccgccatgggcaaaccgatggaccttgctaggagtgagcatcggaagaaaactgggagaagggagaagaagataataagggcaaaattgtcattttatgtggtttctatttcatcattagggtggatattatattttaatgcgtctggtgtcctacagcaaattatcacacttttgaagtgtcttcggacaaattcacgtctttatggtgtcttctagctaattacattttttttaagtgtcatgtagcaaattttgccttatattttaatacggatataatagatgtacatgacatgttcactccatcaattgcattttcccgtagttttgtgaaattgtgtcgtcgcataatgttatttgtgatgcagtacaatacgaaccattgacgatgtttttaggccatgaataatgtgagggagtatgccatttttcttttcccttgtaatcaacaaggctggcctgaaagtttttgataaagagcaagtttattttgtagtcaacaaggttgatccggaaaaatcgcaaataatttgataaattgcaagtttttagttttattttatcatgggagtataaaagtataaatagactttaccaaaacacacatcaaaggcatgccaaataggcaaatataggtccaaccctgaatgtgggggccaagcgcgtgatcaggccccttggcttttatgggttgctgcggaatactcttttccctgtgtttgttgcggatgacaagttggcgcaagtacgctaggtactcaagtcacacacgcatgcacctgcctcgccgattcttctgcccggtttatttcccacccaaaaaaatttcattctcttccatcaaatatttggacacatgcatggagtattaaattaaatataggtaaaaaaattaattacatagattgcgtgtaaattacgatacaaatattctaagcctaattgctccatgatttgacaatgtggtgctacagtaaacatttgctaatgacggattaattaggtttaataaattcatctcgcagtttacaggcggaatctgtaatttgttttgttattagtctacgtttaatacttcaaatgtgtgtccaaatatgtgtccgtatgtccgatgtgacacgccaaaacttttcacccctagatctaaccgcaaccttttttgcgccacacctcctgctcacgctagaaatcagaccccgatttaaaaattttcaggtctcagtactttcatttgttccacaaactttaatcttaaaatcacaaaaacttccaatttgaaaatgtaaacttccatcctaaaccgcaaaaactttcaaatcaagatataaaaacttcatctcaaataaaaaaaatcttttaattgaactccagaacttcatctctagatcacaaaactttcagttgaaagatataaaacttgcatctaaaagaacaaaacttttagtttcaaatatgaaaattgtcagggttatggataccacatacctaatagtagtcgactacatctcggcaagacccaccacataccatgtcttaaacggaaactgacttcagatatggagggagttccggacaaggaaagacaaccagagttctacatggaaacgacaaggactactcgaattttatccatattggtttctctagttctacttggacaaggagacacctatgggtataaatacaaggccccctaggaagagaggagaagaatcaacatacacagaacaatagatcaagacgcaatatcaacatacaagccagcatacgccaagacaagacgccggatatcgacttcagggataagcacggctagtcccatacggtgtctccggatactgtcaggagaaacaaaagcgctatctctgatctcgccgggcacggagtcgatgaggaagactaccctgttgtcgactatgagtcagaacttcagaccgccatatcgacaacagttagataggctaccccaaatattgtattggtgtgattatgataaataagaacaatgaccggctgcggctaacaggatgtagggttattatttgacaattcaggggcccgaacctgtataaaaatcctcgtctccgtctcttttacctcagtctcacgtatatcctagcaccaacgattcccatactatgcaaataccggaatcgcgacatcaaacgtcgacagtggcgcgccaggtaggggatcttttggtgcttcaaggtttcgacgagatgggtttaaaagatggattcttcaacaacaagctactcgacgactttgactgtggggagatctaacccgactggagtacgtcccccgacggaatcggaaccatcgtcgtcgaggagagctactgtgtcggcagcatccaagagcaatgcaataccgattcctccacgtgtgcggcatcgacctgtgcgaggaatcggctggctgagtcgagaactcgacatcaatctccaccagcaaaacgagcaccggggagctagatccaatccggcgtggatctgttcgatcattggtgtaaattctcacgtttgcactaggatccaatctctaggcagcaccctggttgtttgttccgatgacgtggcaaacggatcaattaaagaaccaaaatacaaggtgcttagacgggggacagtaccatgcacgcagaagcatatcaaggagttgctgttcctcaccaagcatgcacagtaaggtatttagtagattgatttcgtaaattaatctactaatttcgtagatatatccggcatataaatatataatttatcgtacctacttttccgatctatacaatattgtcagatcaataatttattatgtttacctagagcgtgtttttatacaatatttattgtgcgagtgtttccgatattaggctgactacggtctaatactgggggctcgctctattttcttctgtataaatcatgcttgtttacggcctacataatccctgatatttaatctgctcgttatatcctgataatattagaagattcatgcagttttctgagtacatactcgatattctctgctatatatcttgccttctagaaaatattttttaggaacaattgagcactcgagtaggttgtggtcgaatacaccccattatcgagaacattctcgacaaatgcggaattgtcgcacccaacctaccaacgaagaccgacgacctatctcatagcgccgaccatggctgggctataaattctcgtgaacgttgtcggcttgatcacccgacatgattacgagctgacatccagatatgctataagttaggtatgtgagtcatgctcgccacatgagatgcacatgtaacaaaccaactttagcacccctataggtgattaagagactcctactcctggttctcaaaccagtagaacgtagtgatttctctcgccttacttctagtggtcgagttacgactactacctggttctcgaccagcagtgtagcgattctcccactatttccactttaagtggtcgaattacgactactacctggtcctcgaccggtagtgtagcgattctcccactatttccactttaagtggtcgagttacgactactacctggttctccaccagcggtgtagcgattctcccactatttccactttaagtggtcgagtgacgactactacctggttctcgactagcagtgtagcgattctcccactaattcccctttaagtggtcgagttacgactactacctggttctccaccagtggtgtagcgattctcccactatttccattttaagtggtcgagttactactactacctggtccccgaccagaggtgtagcgattctcccactacctctactccaacaaagttgatatcaggtacacaatatcgccaagtgttttacccagagatcccttaccacgatgacacctagcgttgaaacctatcctactgtccctttacgccgtcttgacaaggcttccaaggaacctaagggaacttcggctggggacgcccagagccgataaggccttgtcggatcctgtagagacaaaagaccatgtaagatctggtcgtgtaatagttctcgccgtgcgtattaaccaagccatgtaatcggaaattgagttttccaacttcacggctgagggctaggatcagtgcttgttcaaccaaggcaggtcaagggtccaagagccttatcctccgagaaagattctccgacaacaaggctaggggctagggagagtgtatgactcaacaaactgactgttcgaagtcagtaaaagagaagacgctcgtatacaaaacattggtcggtaaatttaattcattttcagttttccatacatattataacatgttaccctttgagcattcgctcgggggctatttctatctaatgttcttttctgagtgttgatttcaggaaaattctattcgacattgtcgaagacttcacgtctctatggttctacaccaagatcgactaaggcgagtacgacaaatgttgacaaggcttcgtcgaagattctacgccttcttgatcgctcgagaacggttggtggatctcgacaaggaattcggaatgaagagatggtgtacccgccgagataaaatttcttgacttcaatccaaattctcgattatagcaaaacgggagacttagtcgtatgctctgtactttcttggttgacgtcggagattgactcagacaaaccttttaggtgtccgcacgaggctgataaaggaagtctaacattatctctgaactcaccgagatcgatcacgtgagctcgataacagttactccaaggtctgcggctgagaatatgaatttcatttgcattgaagtcgggggctactgtcagggttatggataccacatacctaatagtagtcgactacatctcggcaggacccaccacataccatgtcttatacggaaactgacttcagatacggagggagttccggataaggaaagacaaccaaagttctacatggaaacgacaaggattactcggattgtattcatattggtttccctagttctacttcgacaaggggacacctatgggtataaatacaaggccccctaggaggagaggagaagaatcaacatacacagaacaatatatccagacgcaagatcaacatacaagccaacatacgccaagaaaagacgcctgatatcgacttcagggataagcatggctagtcccttacggtgtctccggatactgtcaggagagacgaaagcgctatctttgatctcgccgggcatggattcgatgaggaagactaccctgttgtcgactatgagtcagaacttcagaccgccatatcgacaacagttagataggctaccccaaatattgtactggtgtgattatgatgaataagaacaatgaccggcttcggccaacaggatgtagggttattacctgacaattcaggggcccgaacctgtataaaaatcctcgtctccgtctcttttaccttagtctcgcgtatatcctagcaccaacgatccccatactatgcaaataccggaatcgcgacatcaaacgtcgacaaaaatgtcatctcaaacaaattcgattcataaaacctaaatctttcataccgaaatcattcttctccttgtaagaactggacggttgacatcttccggagcagtacgaacttgatgcgccacatggtggcaatggagtgatggctgaaatcgctacccacatgctagattttgaggagctagaggtgccgccacttggacggagaaagcagatggggagggatggagggcggcaggagacagggatggccagatgccggtgagatggaaagggatggagggtggctggagatggtgaaggactgttgggcgccagagcaagagattgatggaccacggcgagccgccttatcaatcgtcaaatggaaatagcggaactagggaagaggaacaagtgttttgaccaagtttttccacctctaacacttatgtgtcggataggccggagtgtgcgatgcgggcgcatatgcgcgagatatcattcctgttgtttttttttccgtgggcatatttcttcttgttttgggcttccctctaaccccttcccttctcttggagcgggctagaaattgaatggtgaaagcatctagggcctaggtatatggtcccttttttcaaattgttttagaatgtgtttcaaatttattcacagaaagtttatatgcacaaatttacatgtataaaggttttatgcgtatatgtaaaaagtagctatgtataaagtgtataaacgtttccttgtatagaatttatgcttataaactatctttgtatcaagtctatatatctaggaatacattttctatatataaatttctacatatttttacatatagatatagatccatagataaacatgtacaaagtttcggcacacaatgtttttttttacaaattatctacgtatagagtctatgggtagattaatttgttgggttgggtcaatacactgatacaatgctcattggattcaaggcctggagaaaaaggaaatacatctgaattaaacatgggactacatgaattttcttgttatacatattggaccaactatggctgcgtttagttcctgaaaaaagttgaaagtttagggaaagttaaaagtttggaaaaaaagttaaaagtttatgtgtgtagaaaagttttggatgtgatgtgatggaaagttggaagttgggggtgaactaaacacagcctacatcggtgcatacggaaaacggggcggcccattaacacgtgattaattaagtatttactaattttttttcaaaaatagattaatttgatttttttaagcaacttttgtataaaaactttttacaaaagccataccgtttagcagtttgaaaagcatgcgcacgaaaaacgagagagagggactgggaaaaatggcatccgaacacaccagttactggtacttgctgcgcacgtgcttggtaagcggatgtgatcgtggacggggctgcctacgtattagacccccgcccaaaaaaaaaatatagtagtttagttcacaccaaaattagaagtttgattgaaattgaaatatgtgacagaaaagttagaaatttatgtgtgtaagaaagttttgatgtgatggaaaagttgagagtttgaagaaaaaatttgaaagtaaactcagcctaggtgctgaacatttgccaactatagatcacgcaaatctgtcgggacaaaagaacttttcgtttttggtagtgttcttgtcctcggttgtcgcacaacatgatggtgtgcgtggagttgttggagtggtttagcttgtgggctcagcctatttatttcttggcaaaatttgctatagggcatcgaaaaaacgtgtaattagcttgtggacactgcaagaaccagaatttgctaacaggtataaaaaaatgtgtaattagctcctggacactcggagccttattttattattttatgtgaatttggagagagaaacactaaataaagacaactttgcccttgggtctcgacctggatagtgacaaaacattgggttggccagcggcggcgacggagccgaacacgtgcagcgcttgtgttctgtccctgtgatgggtccaagcggcggcggccatcgccgggatgctccgcgttatggccggcgtgcgtggcctcgtcgccgccgacgacccctttggcgtggagctaacggacgtgttgactgacgacaccgacgccgacgacaatgcgcttgtgttgtccctgtgatgggtccgagcggcggcggccatcgctgggatgctccgcgctgtggccggcgtgcgtgggctcgtcgccgccgccgacccctttggcgtggagctaatgcacgtgttgattaacgacactgacatcgatgacaatgtccggcgaccggagaacacggtgcccggcgcgtgggcgacggtggagagttgtgacatcacggagctgctcctcgccagcctcaacgccggtgtcccgttctcctgccgtgtcaatggcagctgcttcgcaattgcaagggagaggatcaaacaacaatttgcatatagagatggagagatcacaaaaaaaaaggaggggacattttgatcgggagggagagagcacatgcatatactcgtgaattccctttcgcatatggcgctgagctaactctttccagccggctcggcggcacgatagcgtggcggtgctcgtcgccagcgaccagagttgtggagattatggtaccccatacccacacggcatggttatccgactagttataggggataacttatatctatggaatatggaacagatcatgacttgggtattacgtttccctgtatattatggaacggcctaaagtcctggtttgataagattgcaaagtagatttaggaaaccgataccgtgttggttaaggtttctatcttgtaatcctgccccccatcctatataaggtgggcaggaggccctctagggggcatgagacatatgatcgtcagatctatactacacccggcggattcaaatccccaaacaggagtagggtattacctctcattgagagagcctgaacctgtctaaatcctttgtctccgcattcatccacttttaggtctcgtgcgctaccccccttttcatattgccgaaaatttgttttgacagttggcgcgccaggtaggggttgcgtcgaattacctgtcgaaaagtgcgatggaatcaacttcagaagaagcccggagatcaatctcatcaatttcgacggctcaaatctttaatcgggtttatcgttccaatctaatttttattagattgatttttaatcgttgtttgatttcctgatattttgatgcatttcatatactcgatgagatcgagacacggccatcatcgtcgcctgctcgggtgcccttgccgtgtccgagtgctcctctcttcctttccttgcagttggacgtgttgctggagtagcacatgccgccaggagcaaattaaacacacgcatctgttgatttattaatcaacacgtatatgcagactggaattaatctactaattgctttctattgcatgtacacatgtgccgttcgattcctgtttccatgtatgacggttgatgtgctccgccggctacctccgatgatggcgtcataccgaaagaacatcgagttagcagttagctgccggggcttatacatgttgcatggcgcgtcgccggctatcactcacgatccagcctcactgctcgacttgagtttttcgtttcaatttgttatcaataatcaatatatattagattgatttctaatctcagattaatttcttgctattttttgttgttgttcgcatataattacgcggcactactgaggcgaacgatgttggtcatggactcaaggcatctcagctttccggtcaatcggccgcgagtccactccgccggcttgtcctcgccaccgccattgctgatatcaacaacgacttcaccgccggcttgcctccatcgccgccgactggtgtctccgcctacacggctggcctattatgccgccgttgttgggcgtttacgacttcaccaccggcttgccaccgtcacggccgactggtgtctccgcctacacggctggcctattatgccgccgttgttgggcgtctacgacttcacagtcggcttgcctccgtagccgccgactagtgatctcgcctatacggttggttggtcacaccgctgttcatgggcgtccacgtcttcaccgactggcctacttccgtcgccgccgactggtgtcctcgcctatacgattggttggtcacaccgccgttcttgggcatccacgtcttcaccgaccggccgccacgtctgccgccgactggtgctttcgccttcacagctggcctattatgccgctgttgatgggcgtctacgtcatcaccaccggcctgcctctgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcattacaccgccggcctgcctccgtcgccgccgactggtgtccccgcctatatggtcggttggtcacaccaccgttgatgggcatcgccatctacaccgctggcctgcctccgttgccgccgactggtgttctcgcttataaggttggtcggtcacaccaccgttcatgggcgtccacgtcttcaccaactggcatgcctttgccgccgccaactggagtctctacctacatggctggcctattatgccgccgttggtgggcatcttcgctttcaccatcgaccgctttcgtcgccgccgactggtgtcttcattgttattgatggacaactttgttcccacattggccacctctgccatcaccaaggggaatattacaaagctaagtcatcgttaaatttctttatatgatattttccttttcctctgcctcactacatcaactggttcgccgttgactagtgagtcgggggctacagatgttatatcatattttttaataattttcataatatttatcttgattgcttgcgacataatctaagtacaaaagtgcctatcgagttatggagttctatcttcctatgctttccgtttggtttgccgatggatagttgcctttgggccgattcctagcacccgggggctcgttggatggactgagtaacgcaaggtgctaagtattactcggaagaaatcaaaagcatagagataatataatttattttctgctcttaacaattgcaaaagtacccgagtagtaaactcatgtcactcatatgcatgtttgggaagtgcctaggccgactcccggtgcttgggggctatgactagtcggacagagcgtttaaacgtaatgagtcatctgctcggggaaatcaaaattgacaggaggagaaatacatatttataaatattttaaaatacttgcatttttctcgagtattatatttacatcagatactactcatcctatatgtttgttctgcaggatccaaatccagatatgcataaaagggattcatggctttaagcttatctcttacgctctaggaatggatcagtcagaacatcaccatcggcttgccttcgccgccaccgactggtgtctctgcctgcatggctggcttattatgccgccgttgttgggcgtctacgccttcatcgaccggcttgccttcgtcaccgccgactcgtgtttccgcctgcacggctggcctattatgccgccgttgttgggcatctacgtcttcaccgaccggccgcctcgtccgccgccgactggtgtttccgcctgcacggctggcctactatgccgccgttgttgggcgtctacgacttcatcaccggcatgcctccgtcgcagccgactggtgtcctcgcctatacggttggttggtcacaccaccgttcatgggcgtccacgtcttcaccgaccggtttccctttgccaccgactggtgtcttcgcctatacggttgtttggtcacaccaccgttgttgggcatctacgtcttcaccgaccggcttgccttcgccgccaccgactggtgtctccgcctgcacggctggcctattatgccgccgttgttgggcgtctacgtcttcaccgaccggccgcctcgtccgccgacaactggtgtttcctcctgcacggctggcctattatgccgccgttgttgggcgtctacgtcatcaccgaccggctgcctcgtacaccaccgactggtgtttccgcctgcacagctggcctgttatgacgccaactgatgctatcttcttcacggctggctacgtcgccgtcaccgctaatagccgtcatcatcttcaacgcaaactgtctacgtctgccgccgactggtgcttttatcttcacaactgcgcgtcttcactaccggtttgcttctgttgccgctgactcgtgttcacttcatcacggcaatgcaactttgtcatcatggtagagcgacttcatctttattatcttcggcaccggcaaactctattgttgctacttcgcaagttttgctacttcaccaaccacgacgtctttgtgcacctcgacatcttggcatgcgatgccgtgttattttactacaacaagtggctctccaatattcaggatttctacttggacatctttaacacatatcttcaatcaagcaatgactactcgacgacaagaagctataattctcgactctatgttcagttgtttctcaactaaccaaagagtcgggggctacacaaatacatggctcaaaattcgacaagctttatgtcaagatgaattaatcaattaatcagccaacgagtcaactctgggagtcatcaattttgtcttcgcttcagaacagacatttaatttcagcgactccaattattacactagcaattttggcttctccacgccgccacaatctacttcaaaattttccagtatcaagtttgagattttatctacatgaccaggagtttggagttatcaaccaattaacacagattaaacgagttggacaacagcatcaactctcctccaagtgaagcatctacaacagttataacattaagttttacattcatcctctttgatggattattgtcactaacatcatcaccagcacctctgcttcatcaaccctgacatctccgctgttgctaatggatgattatgtcttcaccgacttattatttcaccttcacggttgacctactatgcaaatgctgatgagcgtcttcgtcattatcattggttgctacactgctattgactggatcaccgacatcgtcatcttcatcatgtcggttgcgtttgtcgtcgtcgactattttcttcatcttcataattggtggatttcgtcatcgcctttgatctgcctcgtctgtcaccgactaattatttcgctgccatggctacacaactttatcgctgggcgccttcatcttcattgttagttgatctgtctaccgccgactggtttctttgcctccatggctatgcgacttcagtatttttgattggtatcactatcttcactaccaccaatatttttgccacctctagtgggcaatattatctctatattggtcatcttgtctccaactgcgtcaactaccatcaatggaccattgtgactacgacagaaggacaggctatatgatcaggggtttactagttcaaacacaagtatcataccttcaatttggacttgttccggatacatgcaacatgaattcatgatcatgggtctattttctatgctcaaatactagactatttattattccctgtaagggttatcaaccgaataattattccaatcgggattcaattattatatctattttgaagtatcccataagggataatcactcagatcagatgctattcatatgagctacacttggtctatatcaccggaagatttattactcgggagcatgttacatgcgtcatcctttaaagggtgtcgaaggcatattttttggcctagacctaatatgtctgcagcccatattttcaggtgtggcctgtcacgttcttttagggacttaggcactttttgcttaggccaaagtgcgcatgatcaagtgtccaataccttaaaatccttttataccgcagttacttaactttttaggagttggtacaatgcatcttaaaaggtgtcaaacagtaaagctttatatagctgccccgctgacttttttacatagtcatggcgctgtttgggtttataaagcaattgattgaatataatatcattgcttttttgccacgtaagtgtgcatttttattgaccaatattatggcttaggctgattatatatcttggtcattttccaggcggttggtaaatcctttatgagtttatttactcggattttatatcacatatgccatatatttccatgtgtggtgaaaccatgtgtcttctagggatttaagcatatctgttaaagcagtgtgcgcatggtgtgtgcccaatactttggaaatttctttattcacaacatcaagctcttctttatagctgttttgttatgtgaattttcaaagatgttgtcaactttaggttgctcgcatcaatttttataaagcagttggtatatcacttggattatgttatttgggggattcacaccgcacatgctatatattgatatcaagtcacttggttgattacaattatcaaaaccactcagttggttggattatttattccttgattatatgcttagtttgttcagctaatcacatagtcgggggctacacctattaagtgcatctattcgatgcacctgactttatttttcagccctccacagtcttcatatttggtaaaagtactcgggagaccatggcaaagatgattgaagcactcggctttggagtaatctagttcgagagaagattatattttcgactgtgaaggtctcaggggctactgtggagattatgggtatcccatacccacacggtatggttatccgactagttataggggataacttatatctatggaatatgtaacagatcatgacttgggtattacgtttccctgtatattatggaacggcctaaagtcctggtttgataagattgcaaagtagatttaggaaaccgataccgtgttggttaaggtttctatcttgtaatcctgccccccatcctatataaggtgggcaggaggccctctagtgggtatgagacatatgatcgtcagatctatactacacccggtggattcaaatccccaaacaggagtagggtattatctctcattgagagggcctgaacctgtctaaatcctttgtctccgcatccatccacttttaggtctcgtgcgctacccccttttcatattgccgaaaatttgtttcgacaagagtgcttctcggttcccgtcgacaagagcatgcctcctcctcggccgcggccacaggccggagcagctccacctgcatcagcccacggcggccaccggcggagcttgtcggcttcacggacttccacgcgcggtcgatgcgcagcatctcgagctccacggcctcctacttcctgtcgtccttgtcactgtcgtcttcctcatcttccggcatggcggcgcagttgggggaaggcagcggcgcgcgcgtgcgtcgggttgccgccggcggcggcggcggcatgcgcaacgttggctggcggcggtggcgcggatgtgcatgcgatggcatgcgttggcggcctgcgtgggcgcggcagcgggcagcgcagagcgggctcgcctttctccccctctgcccaatgcgctcgtcgcgtcggccgccgcgcggaggaggtggcagcggtgctctggccggtgtgagggcaggggcaaaatcgtactttcaccagtgtttctctctccaagttcacaggaaataataaaataaggccccgagtgtccagaagctaattacacattttttgtgatatccgacagcaaattctcgttcttgcggtgtccacgagctaattacacattttttcgacctgtagcaaattttgccttatttctttatgggccacaaagagaggcgacgaattggagttgtacaatttttttctgtgtgttgtttgaatttgtatggaactgaaactagtacaacacaactttgcataggtatttctagcatgtacttttgtattttgtttgttccatagggatatgtgttttccttttatatcttcttaatttttttgatatatttaacaattcaactttaaccaaaattattgtctaaaaaatataatttaggtatgaagtatttttttaccctaaatagaaagttattgagacaaaaattttatgcatataagtttactattttcttgtacaaagcttacgtgtataaagttttttattttcttgaataaaaattatgtgtggcaagtttaaaatttaaattgatacttatgtaagaaaataatatattttatttagaaaagcaagttaattcaaatataaccaagactttaggagtgcatagcctactatgctttgtgatactaatcacatgctagttacgtaggactcgttaattaccttagactaatcacatggaagcagtgaatccgtaaacacgtcatactcaaaatcgcactcagaagttggaacgcgtagaaaaatacacattggcctgaacgcctgatcagaacttgctagggtcctgccaacgttcgcgtattacatattgttatgctaaaaacccttggaagatcaaatttgacaattacgtcctttaaaccttctctaccgttgattcataatcaacggatgcgggtaagaaccgaaccttggaatcacacacggccacgtggcgcgttttaaacatgcgtaaactttgcttctaggtttagccacgtggcccagtgagttagtagggcttgcaccctgaaatcggtattctagatagcctactatggctgtgtttagttcctgaaaaacaattgcaagtttgaggaaaattggtagtttgaaaaaaagttgtgagtttatgtgtgtaggaaagttttggatataatctgatgtgatggaaagttaaaagttgggagtgaactaaacacggcgtatgcttgagtgatactactaatcacgcactagttacgagtaggaattgtgttaattaccttagactaatcacatggaagcagtgactccgtaaacacatcgcactcgaaatcgcactcgaaatcgcactcggaagtcggaacgcgtagaaaaatacacatgagcctggtcagaacttgctcaggtcccgcgaacggtcatgtattacaaccagttgttatgcttaaaaccagttgtttttcctttaatcaatcatgcttcttcaccctcttgattactgataaagctccctcactgccgaattaacaatcaagccaaaatttctgatgtcactgctttggtggtttggtgtcctagtttgtaaccctcttatatatactaaggctgcgttcttttaggagagataggggagatttcactcgttttccgcgcgcacgcttttcaaactactaaacggtatgtttttttgcaaaaattttctatagaaaagttgctttaaaaaatcacattaatccatttttaaagtttaaaatagttaatattcaattaatcatgtactaatgactcacctcgttttgcgtatcttcccaatcttcactatctcattctcctcaaacacagcctaagtcaaatgttcggagcctaagtcaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatctgccggatgtgtattgatctgacgatcaggttgtctcctgcccctagaggggctccctgcccttcttatataggttggggggcaggggtacaagatagaaaccttaaccaatacggtatcggtttcctaaatctactttacaatcttatcaaaccaggactttaggccgttccataatattcagggaaacgtaatacccaagtcatgatctgttacatatttcatatatataagttatcccctataactagtcggataaccatgccgtgtgggtatggggtacccataatctccacagtagcccctgagaccttcacagtcggaaagataatcttctctcgaactagattactccaaagccgagtgcttcaatcatcttcgccatgatctcccgagtactttttccaaatcagaagactgtggagggctgaaaaaataaagtcagatgcatcgactagatgcacctaataggtgtaacccccgactatgtggttaattgaacaaaccaaacatataatcaaggaataaataatctaaccaaccgagtggttttgataattgtagtcaaccaagcgacttaatattaatatgtagcatatgcggtgtgaatccctgaataatatgatccaagtgatataccgactgctttgtaaaatatgatgagtgtaacctaaagttggttacatcattgaaaattcacatagcaaaacagctataaagaagcttatatattgtgaataaagaaatttccaaagtattgggcatacgccatgcgcacactgctttaacagatgtgcttaagtccctaaaagacacatggtttcaccacacccggaaatatatggcatatgtggtataaaatccaagtaaataaactcataaaggatttaccaaccgcctgaaaaatgaccacaatatataatcagcctaagccataatattggtcaataaaaatacacacttacgtggcgaaaagcaatgatattgtatctaatcaattgcttaaaaacccaaacagcaccttgacttatatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcgtgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaataactgacgcagtcggcatggagatgaaatgaccaacatgaagacgaaattgctcatcagaagtaacggaagatgtcagtggtagtaaagatgccaccaatcaaatgtaatgaagttgcataaccatggaggtgaagaaaccagtcggcaacagtcaggtcagctagcagtgaagatgtaggcgcccaacaacaacgaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgagaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcgtggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcggcggcagcataatcagtcggcgacggaagatgatgatgtccatcagtagtggtagctgtataaaccagacgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataataggccagccgtgtaggcggaagcaccagtcggcggcggacgaggcggccggtcggtgaagacgtagacgcccaacaatggtggcataataggccagccgtgcaggcggaaacaccagtcggcggcggcgaaggcaagccggtcggtgaagacgtagacgcccaacaatggcggcataataggccagccgtgtaggcggtgacaccaatcagcggcggcgaaagcaaaccagtggtgaaaatgtagacgcctgacaacggtgttgtgaccaaccaaccgtataggcgaagacaccagtcggcggcgacgacggcgagccggtggtgatgttctgactgatccattcctggagcgtaagagataagcttaaagccatgaatccattttatgcatatctggatttggatcctgcagaacaaacatataggatgagtagtatctgatgtaaatataatactcgagaaaaattcaagcagtttataaatacgtatttcttctcttgttaattttgatttccccgagcagatgactcattacgtttaaacactctgcccgactagtcatagccacctagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgtttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacatccaacaacggcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcagaaacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccatgaacggtggtgtgaccaaccaaccgtataggcgaggacaccagtcggcggcgacggaggcaggccggcgatgaagtcgtagacgcccaacagcggtggcataataggccagccgtgtaggcggaggcaccactcggcggcgacggaggcaagccggcggtgaagtcgtagacgcccatgaacggtggtgtgaccaaccaaccgtataggcggggacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaaatagcaagaaattaatctgagattagaaatcaatctaatatatattgataacaaattgaaacgaaaaactcaagtcgagcagtgaggctggatcatgagtgatagccggcgacgtgccatgcaacatgtataagccccggcaactaacagctaactcgatgttctttcggcatgatgccatcatcggaggtagccggcggagcccatcaaccatcatacatgcaaacaggaatcgaatcctggcggcctgtgccactcctgcaacacgtccatctgcaaggaaaggaagagaggagcactcggacacggcaagggcacccaagtaggcgacgatgatggccgtgtttcgatctcatccagtatatgaaattcgtcaaaatatcaggaaatcaaacaatgattaaaaattaatctaatagagattaaattggaacggtagacccgattgaagatttagatttgagccatcgaaattgatgagattgatctcggggtttcttctgaagttgattccatcgcacttttcgacaggtaattcgacgcaccccctacctggcgcgccaactgtcgaaacatgaattcggcaataataaaacggggtagcgcacgagacctaaaagtggatggatgtggagacaaaggatttagacaggttcaggccctctcaatgagaggtaataccctactcctgtttggggatttgaatctgccgggtgtgtattgatctgacgatcaggttgtctcctgcccctagaggggctccctgccctccttatataggttggggggcagggttacaagatagaaaccttaaccaatacggtatcggtttcctaaatctactttacaatcttatcaaaccaggactttaggccgttccataatattcagggaaacgtaatacccaagtcatgatctgttacatatttcatatatatataagttatcccctataactagtcggataaccataccgtgtgggtatggggtacccataatctccacacataggaacttatgaagattttggcaaacgtttggaacagattattctgcgaattattgtcgcagtgaagaaaaaagtttactactgtaggctgagagagatggatctgcttctaaccaccatcagtgagaattaatgtgggacacagaagaagtgactggatgtctggatcaaaggagtttttgcctttgtgactttgatctgcttgtgggctctaaattatgttacatgactctccgtagttaaatgatcttattttctttctttctttcttatttcagttttgtctactgtaatttctcttacgcaattttcgcttacgattgtaaaattatagtcacgagaaagtagttttgacataaatttgacaatatcaattttatggcaaaacataaatattacttcctccgtttcacaatgactttcacaatgtaagtcattctagcattttctatattaatattgatgttaatgaatctagatattctatattctatattcatattgatgttaatgtgggaaatgctaggatgatttacattgtgaaacggagggagtactatgtgcgttgtaaaatataataatttctggttatatatttggacaagggtttatctaaattatggtactatattttaaaacgaatatagtattaaataaatcattaactaaaatgtaaaattaaacggtcagaatacgcataatattttgagcggggagagtatagaatatagagtcactcaatttaactacaagtgtactctttatccaatttgacagtaacatagatataactcataaataacaaataaatgagtgaaatgctaaatggcattcgatagattaattattgggccaaaatcttacagattcatgctctggtattagctttttctccgggtccgccggctccaatgacaccgacaaaggtggtggagttagggatgtaggatcccgggttgggttagagattgggggaggtgggggcgaggaaagagcgggagagagccaatccagttccaacaatgcacttctcgaaccgagaaagtcaagcttagatggatagccatgggtggcggtgggcagtggatatgggcgagcgatgagccacaagcggctgcgttgaagccgtaaggatggaggagggaggtgatccagcgttggtagcagggacaaagcaagcttgtggttagaaggctagacagcgagaggaaggggatcgagcgaatgagcaatcccatagtggctgggagtgaggagggaggggtgatatggtttagattgtgttacacgaatcttacaataatcatacggtccaaaactcgcatgttttctgagggggttttatgtcaaatgcttgatggacagtccaaataaaaataaggaatattaaataaccatcctaaatgtcacccaaaatttgagattttccttgtaaagaagttttgttgccaatatcccccctcccacccctcctaattcatggtttgatattccttcccaaattaccgatgttcgcgtgttgagtgtcatgagtagggatgaaaacgatacgaaaatggacgaaaaccacctttattgtttttgttttcatattttttttggaatcaaaaacctcgaatacgaaaacgaaatcaaatattgtcgaaaccgaaaacggaccggcaatgatacagtaacgaaaatttatcgaaatacaaaaacccctcaaactaagttttaaactatgtcaaatccaattctcaagtctcaaatttcaacattacatctcaaaacacaattatgtcaagttcaattctcaagtttgaattgggtgtattgggttgggctaaattgagtgacttaggaattacgatgctgaattgggttgggctggggaggaattatagactatggtaagggccttcataattctggaaattccgagaaaatttctggaaaatttccgaccgattccgagttccgacggaaactgcccttatggtattcgattctatttctaagaaaatatttccgaattcgattccgtttccgaaaaattccgaccgacagattccgtttacatccctagtcatgagtgggaatgccatgaccgtattacgtaggcccggtgatatcaaataaaggtgaattaattaggagggagtatttacatccaatcattttatagggtggaatctcaaccttacagcgatatttacgatggtattttacaattttcccataaattaatgtaaattgcacatatgcacccacttgcatgcctaatcatgcggaagggaaaactaaaattaaacgtccacgtttttcccagtgtggtactctcttcgtccaaaagtcaagacctattttgtttttttgttttttttttcaaaagtctaagactcatttataggactaaactaaaatgattggaatccaagaagctatcttaatccttgttagttacatgcatgtgtatagtttattaattttgtcacatgattaatgatttaattttgtcaaaagaaatactccatatggagggagcgagtactaataaccagtagcgcacacgaggaagctaattaacctgacgccaccacctctctttccctctctctcttccattcaccgacaatctaactaaaaatgaatccgatggccccgatgctgccggcgccggcgcccatggcggcggggccgacggagccggtggtggtggttggcccgcagtactgcgcgccgtacgtggtgccgctgacggtgaccaagaagtccatcagcctcaccgacggcgacttcaccgtcaccgacgccaacgacaacgtcgtcctcaacgtcaagggcaccctcttcagcgtccgccaccgccgcgtcctccacgacgccgtcggccaaccactcctctccatgcaagagaaggtaattaattaagtatttctttctttttttcttttgatttgtctagacctagtagacttgatcggggattcaggaggggaatccaagaaatcaagtactcgagggaatccaagaaatccaaggagtagtattttcaagtacaccaacagctagagagaggatttcgtcttgatctgatttcgtgttttttttaatatgttaatcacatggtcaacgcgtttcatggagattgattggatgagaaggtttttatattccttgaattttttcttcttccttttgagaatgatacaaaggtggtcaaattcgctgagaagagagagctcgtggaaattaggatcgaattaattagaatttcgtgtcttcgtaaaggcgcctggattatggatcgtttggcaatcgatgccgtcttggtgaactgaatctttctttctgcctaattaatcactgtcacaatttcaattggaacgttgactattttcgtgattcttgtgatcttgacctgttctttagatgttgaaatccacacaaggcattcaattcttgcacatttttagtattttacaaaagcaaacatttcagcaagttgagaatgatccccaattgaatatccacctaagaacagcaaaattttcagatacttagcatgcacaacagatgggaagtatacagaggggacagcgcacattcgtgcgataagctcttcaccgtgaagaagtcctcaatgctccagttgatgaagacggagatggatatcttcttggccgggaataccgcggagcaagtctgcgatttcaagatcaagggcagctactgtgacagatcatctgccttctaccttggcaaatcaaacacaatcatagctcaagtaagtttactgcctatgtctctcatcacattgtggaggttcagaacaaaactttaatagatttgttatgcatgtcctaatacctgcagatgaaccgtaagcacaccgctgcaagtgtggtgctggggagggacgtattcagcatcaccgtgttcccgcaagtcgactacgtgttcatcgcggctcttgttgcgattctggatgatgttcacagggacagaaaggagtgatgaactggaagcactctcatcccaagcacccttttaaatttcactttcatatctgtcaaattacctctgttctaggtattgctatctggttgaggatgtgtgtaaatttttctttgaattatgtttattttcgctggtgttccatgatttgtaattaccttcaagattgatcgatgttgtataactgcttacagcagtgaatgttttctgtttaaagatcaggttgcagagccaagtgttgctgatcaaaattcagttgaatataggccatttgcagcatggtttctgtaggtcaatcataattaaattgtgtagaggggaaaaacaggcatatggtggcgtttcattccaaaaatttaatctgatttggggttttataatgccaaatgatcttatttcagttatctaaataatgaaatgtgtttgaaagtgacatggatattattttccccaatcagctgccctgatcaggaaaaacatgagtattgaaaagtctgacttctactttgtctttttattttgtctttccaatcatcaacaaatggaaaagcttccgacttaagctttttctttctatcacctactcctttgtcccattttaattgcaaccatgagtttccgtgctcaactttgatcatccgtcttatttgaatttttttttataattagtatttttatttttataagattataaaacatgaataatactttatgtgtgacttgtgttctcaaatttttacaaaaaaatttaaataagacggacggtcaaaattgggcacggaaaattatggctgcacttatattgggacggagggagtaaaagttttgagtgatcttccggtactttctactgatagtattatattgtcagtagaaatgatatgatctattcgttattaaagataaattagtaatttattaatatattcattaggggtaactttgtcatttatatttttcttcccggctagataactttattttagtttatttttttagctttcaagataagccaacaagcaaatgatgagaaatcctatttttttagcttgaagtttcttgtttccctgtactatacattgattggtttgataatgtacaatgacaagaagttcctaagatatactagacacataaaagaagttcaaagaatatgcccaaatgaaagcaaaaataatcatgttcaaatctcagttctgtgtaaattatgcactcgatgtttcataaacttctttgcaaaacctgcaaactttttcttttgcccctgaaatccagactgggaactgcaaaccctgcatcaccctgaccactctagcttgcctaccacaatttctctctctctctctctctctctctctctctctctctgaaataaacagcttaatttctcctggttgtgcagataaaccgcaagtttagcgatctttcagacatgatattcgttgggagcaagttcagtgtgaccgtgttcccgcatgtcgactacgttttcgtcatggcacttgttgtcatcttggatgagatcgcgagggatatacgacgaggagcagtgatccagatcagcacgagccagagaccaggccgatcgacaaggtgaaaaagaggggaaaaaaaagaactctgaagatcaaaagcttccttgcaggtgatcctgctgtaattttatctgaacatgcatggaaattttgcatctaactaagttctgcattcagatgaaattagttagatatagtagttagatgcatgaaagaatgatcaccctgctcttgtgtgtcaatgggcacaccaaatgttgcattttgctaatcctttttctgaacaaccatgtgtggaaatcgatcgaagcttctttgaagctagagattgaccagaaattctaacctgcttgtactgattcttaatgaattcccaaacatattacttttgactctttgatcaacacaacaggggaaagtttcagatttcaacaagccaaatattcttaagatctcatcgatccatgtacatcaaggttcaagtttgtcctattaaaaaaagtttatggacttctatattattaaagtctctttttttcccctgtgagagagatccactacactatgataagaattgactgcaatagtatggttatataggggaagcatcttcagtaaatcatcgagctgttgttggcactcctaattaagtgacttcatctgttcaggtatgaaacaactcgaacaaaaaataatttatggagaactataaaaacaaatcacgattctatacatgatattatggagtatttgttatccatgtggttcccagataattaattaaaaccccacagattcacaaggatgcacatccagtcatggaagacatgcatgtcctgcaaaataaacaacctgaactcatcattataatgatacctgtcgcccatgcaagatctgaactctggaaagggatatatccaacctgaaactttaaatttccaccactaaatataacataggtgagcacaatgatggatatgattagatgtgaggagctatcagaggtgcacatttattatgccatccagaataacattgtgaaaagtactttggtcatttgtttcctctattttttttccaatttggcagagtaatgttattattttcaaaggtgcacattgtttgtatctgcagttgatgatattttctaacctgctagttcctaatctagcttaagacatacttcttcagaactccagtgtggatttctttaaaacaaatgaaaacaacttgtctttaacaaccatggttctgacatatatctgaaggaaaattccagccctggacttgatgtcatgttccacaataaaacaagtattaccaaaggtcatacataaacaatccacataaatgttgcaaatagtaggtggtgttagcaaaagttaagtgtctggacctatgcgtgtgcttatcaaattgtccttttcctttttgagaaaccaccataacgctagaattctctaaatgaagggaacatattccatggagaccattgtgtgggctctaaatttgatcgttttgttcaattaacaaatattttttccttaaaacaataaatattaatgtttttattgcacatatagggagctcttttagtctttaccaaccatggatagagatttagtaataaacattatgacgcttgatagattcttgatcttcttggtttttttttttattttttaaagttagttctcaacccatgttagaacctcttaatagttactccctccgtcccataaaaagccaacctagaattggatggaatgtttcctaatccaacgaatttggataggactagaaaacatcccatccaatactaggttggtttttttttggatagagagagtatggttgtgcatatcctggatccagagatcgggaatttgtatatgacattaaaaaatatgttcttagttaatgaactatctaaatacatgaaagacctgtttggcaggacttcagcactaactgcatcaagagctgtagctcaatcaaatagttcagcttcacctaaaaaaaatgaagtggattagaatgataaaaaaagaactagaggggtgtagcacggttcaggcccatccacagtttcactctaggagtcgaagctttagcaaataggaccgaaaagtccaaacgactcttatacagaaacaattattcatcccccaaattaacaaccaaacactgcatgaaatctaccagaaactcagaagaaggaaaagactaatccaacctagaaaatatgaaaaatttccagcacaaacaccacactatactcttgtgacagctacaaaagtacacttaattaattaatcaacaaccttgatttgatgaacagtaccaattcaatttgatcaccagtgaactttgcccgctccgaagcacggcacggcgcgccgcggcggcgatcgccggacgacgacgacgtcgtcgacggccacgccgccgtcctgcccgagccagcgccggcgatacgtcgtcttccccggcgacggcggcagccaccgctgtcgccgcctgaagctcgtcagccagctcatccatcctcccgacgacgcccaagaacacgacgacgacgacgtcgacagcctcctcctgcacttcttggccttcgacggcggcggcggctgatcggagttgcacgacgaccactggtacgagtacgacggcggcggcgagatcggcggcatggcgtagccgccgtcggcggcggacgccggcacgacggtgctcttgggcgtgccgggcttggactcccagacgaacggcacggtgccggcggcgccgaggctgtagtacacccggaacgacgacgccccgcccgcggcgccgcgatccgccgccgccgacgacgacgacatgatcctcgagctcatcagcaactgcggcttccctcctcctccttctcccttaccaccactcgagctcattaagacacagattaattcagagatatgatcactgagacaaatcaaaccaaaccagagacaaattttcaagccaattaattaaagagagagagatttgcaatttgcaaagggaaaagtgtatgcgtttgctaattagaaggtacactgctcaaaatgaatttgatggagctagctgtttgtgaaattgtgattgagtgagtgagagaggtgtatatatatgggagctttgattgagatggctttttttttctttgtcaatggtggcaattagctagctacctagctagtatctagcttgaggatgaagaatggtggagcacaaaggtagctagctagctactgatgatgtgtgttggcaattaagttttgagcttaagtgataatgaccatgatgatttaattaacagtacaatgatgtagtttaagtagtactagtactagtactagctatagtgtgtacaaactgcaaagttgtgtagtaaagaagaagatggtgtgcatgcaagtactagctaggtgctgtgttaggttgaagatcaggagaaaaaaggggatgagaatgagatagaaggatgtgttggcagccttgtggaggtagcttctcttgtgttcataaccgttttctacgatatatttaactagtgattatctgctcatctcttttatgaaaatcatgttaatacggagttagaacatactccctatactccctccagtttttaatatattgtaccactgactttttaagataagtacgttttatcattcattttattaaaaattatgtaattattatttattttgttataacttgatgtatcattaaagattttttaagcattacttatattgttttatgttaaaaattggataaggcgaatgattaaatgtttgtctaaacaatggtatatattaaaaatagaaatgagtatatatttaagcacaccacaaaaaaaaagaaaggatctcatgactgaaatatatcttgtttaattaattaacttccttcatatttggttggaataaattgaaatataaatcatcttctaaaaatacctccaaagatctccctttttccagaaatgagagcaaagatccttgaagtagataaataatccctttgtttgctagtgttactctgagatcacatcaatatctctgaattaaaatactcagcgcgattaatttgataattgcctccatgattgtgtcatctaacctagctacagaaaaggctgcaaagtactctgcaacatgaaaagaaaaattaaatacaaggactacattcacaaacgtatatctaatcataatcctatatgcttaacaaactgcctaccggtgcgtgcgtatttaattacacatgtttgtttccccacgaagaaaagaatttatgtaccctgcaacacgatagatggatgagaaaaaaggcagacaccgaattgaactcgtaaccacttatcatttcatagatcagcatcttgcacacattcattggttcatgcagatgaaataccagtacaaaaatctaaggttgctttactttatgtttctttgttcttctttaagaccttttgcaaaagcaggtctctgctgcaacagtttgattatagggcatctgaattcagaagaataatgtttggttgcttcgcatatatgctggtcacatgatcatatctaggccttttaactcaccaattaaaactgttgaaagggtagcaattcagtgattctgagagaaattgcatggtgtatgattgacagtaagttattgcagtggttacagggtcatttccctgaactttcgagcaatcgaactgtgttgaaaagttcaaagaaatgtgttgttagaaaggcatgtgcagtgcatgcatagtgctgtcaataaaatttcttttcgaaacatatctatcagtaataaatttaccaatattgaaaattgattaaaatttatcaatcaaactgatacttataaaagtatgtcgacaatgacgataactgaaactactcttggcatcacatgaaacattctattgagctaatataatgcaagaactgttttttattttttgagaacgcgaaaaactttgcacttcaacatattagaatagtgcaagaactgttgttaaaggtttcaaattgaccaggtttcattagcttcatttaagaacaaaaaagagttcagctagtccaagtttatgactctgctttttcggatcagtccagcacaaaaatcaaagctataattaagctggtgcagtgtcatccatctcatctcccctgaaactttcagacagtcatcaggtcattgatttgttcataatgtctctgctaattaagcacacacgttagccacttttgtcagtacttatctgtagccttgtacgattagaatgtgacggtgaatgtacatctgacgatggaagtgaaggtacaatgtgaggacaagagaaagtgtatggatgtaattgacccagctcatgtgatttttagtcaaacaagcacaaagattttttgtcgtggattaggttaactaacttttagtacttagcttgcaagttactgtcttcctttggattaagacttagctaagcttgctgcagattctaggaacaatactccattcgagcgatgtgtatgacgagtgtttaatttcttcaaataattaattatgcagtacaattttgcaaactctagaaaatcaataaggcattgccgttccaaatgttacaagagttgtagaacaacaactttgttcggtcataaattaatggtatcacatatagtcgtatatatggcaccattaaattatcttttttttaatcacgggaggtaaaattatgatgattatcactggcatgctttctaagctctcaaacagaacgattttcaaaaggaacacttttaaaatcaaccttttaactttctaatatttaatttatttgtttatgcccttaaataattatcacaaactcagtttcatcgatcacccatcagctttaaacaaaatatgccattaaatttctttgaaatatattgcgacttatttaatcgtttcctctgtcttggttaaatgtttggaaacaaaagaacatctgaagaaaaagaggacctcacacacaaataaaccgacctgctatctaatcatctgcagcaatcatctaatcatgctgtcacttacaaatatgtgcatgcatgaataaatccccattgacgcttggaatcaacggttgttagggcgtccttgttgtggctgttcaggaagctaagctgctgcaggcagacgataaaaagcagtttgcaggtttgatagattgccgtcgtccagccatcgctgtaccgtaaaacacgtaggcgacggccgatgcgacgcgtgaaaatgcttcgtgctgaattattcagacgtgggatagtatctatctgtcattagctctgcatatatatgcagtgaattcagacatggatatgtctgcaattataggcttttttttccgactgcggcttataaaccgacacacacgatatccaagtgaaaacgacgaaaaaaaaagtaataatttggttttaggttcagaatggattacactgtaatattcatcgtccccgaattgctaaatatatttcagtaatatgtagatccaccagtggcggatccagaaaatcgatttgttggtgtcataacgtgtctatcggtgtcatagtatgctaattatacttatatcatggtgttataacatatggattagcagttttgttacaggttttactgaaagtcgtcggtgcctaacactgtagatccgcccctgagatccactgaaaattagtcagtttggcattgccaattaagtttgcaataactaaaaattatctttctgtctttcaactgccctacacttgttctttaatgtagtgcgtttatatacaattaacatgatactatacacaatagtgttatactcttagaattaataatcaaaatttctatttcagtttagataacatagatattccattatagtactctgtatgacatatttctgttccatacatcagtggacatcgttagaaggggatagcgatttgtcccacaaaagctcgagttttttactattcatcttccctatcttaaaaaggtcaatgatatgaaccatttttactatcttaaaaaaatatgaaaatctatagttttaccctgtatatgcatatgcagtgtgaatcttaaggtctggaatattacctaccaaatatttggtgcatgtgtgaattatttccaattaataatggttgtatttttgggggcagaaataagctacagaccagctatattttgatccatcgatttggtgtgtgagtcgtcggtgtctgtcgatcgaattagatccttgtccttattattgaacaagttaacatcgttttggtaggtgtgattaaattgattaatgcatgcacctcctggggtggcaactgtgtgctgctgtttgccatttctgttgtgggggaagaacaggttgccaccaaaccactcagttctcacactgtgggtcatgtactagaagagtacacgtgtgacactggaaagtgggcccagactattaggctaattaactttgatgtcatgggagtttggtttggtaatggtactggagtactatgaaattgttgctaaaaaatacatttatgtactgcacggtagatgtggagaaattgttgcgaataaatgtggttggctatagcatactccctccatactcgtaaaggaagtcgttttggacagcaacacggtctccaaaacacaactttgacttcttgtttctataaaaatatttattaaaaagtgatatatatgtatacttttatgaaaatatttttcaagacgaatctattcatataatttttacattttcaaactcaacaacttgagagttattcatgatttatattcccaaggtttgacttaaatattgtcataaacgactttctttacgagtacggatggagtatttgtgtcatcagagacttaggtttgcgttcgtttcgtttcaacttctcagtttttttccggattatttaccgaaatattgaaaaagattatatttgatttgctctatgcttcaaaaaatacattttttaaaaaaaaatcttctactgtattgtttattaatgtttagacgaacaaattatttgttaaacctatctatcaaaatatttaatgtatctctataatcaaagtatataatccacagtagcatgtggtatctagcaatctacataaaacgggaaagggagatgggtaggaatatggcccggtttgacaccaattgttttccataaacgtgatagttaacatcattatctacttctttcctcaaacaaattaattttggtaggtgtgatgaaatttcaggcaagatgctacatgtatgtgctggcattagtcatttgtaccggcttgaattctagaagtaatgcacttggaagaatatagattcatcttaatttagagatttggacactggttgggaagtcatcagacgcgagaaaccttatatcattctttgccaagtatgtgggcagttacgaaaagccctaaatcgtacacgtgtgatatgttggctagtccatttctggcttaaatgccatttggaaattgattaatcccttatgtttgtcatggtccctttttatatttaaatatttaaccatataaaaatagtgtattatgatattatattgttatacatagctttccatcgtttaccttttagattataagttgttgctagaatttgattattaatttagggttgacttttaggatttttatttttaagtattgtcttttagatcataaggacatacatatatataaattttacccgcatgttaatttttttcgttgctgatattatattaggccaaacgatggtggtctcaagatgggtcctacacgtggccaattaatttttttcacaatgtttatgagtcggggaagaatcgcctcccgtgtcgccccttgccttggagcgacgcgcagggaagtaatagttaagagtaaggagggagacacctagagctagtgggctagtggcgtgtggaagcattgtttggttccaagaatcaaactatccataatgagttattcatcgtggtcattgcgctattttgaattaggaatgctatacatcggtacaccatccgccatcgcgacgggatcggcgcgatacctacgaagatcccgtcgccgtgcgctcccctgcaaggcaccgcagtacgcatgcaccctcctccacacgggcgcagacatgcagaagccattgtgtgatgcgcggtggaaatactccatcacgtgtacgtcctttgtatggggcccatatgtacatgaatcaatctgattgctagtactattcaggtgcatgcataagaatactaaaatattgttacagtagcatagttactaaccgaccaggagagtcaaatacacacatttatattggtcgtgcgtgtagcatggcaacatactccctccatcccgaaaaaatgtctaagactggatatgacatattttagtacagtaaatctggacagtggtatctccagatttgtagtactataatgtgtcacatctaatactaggttagttttttatgggacggagagagtatgcaacaacattgagccatatgtattatgtttagggttacacaccaaagctaggagtcactcaaactctttacaatcgtctactagcaagacaaaagaaaacccggtggacagaaatcctggtcgtgatacaattgtttgaaacaccttcctgtgtgctactatgttcgccgaacgacgaacccatcttgcattacattatgtgattccgcaaagcaggaacagtagttttttttttagagcacactggttgtacaaaatgcaggaaagtgaaaaacgtagaaattaaatgcagcacattttaaattcctacatactacacctataagatatgcagattatacagatgcgagctgtgggatggaaatcctgccgattattggtcgagatccgtcggcgtaccatctgcaataagtcaaatttaaatataaaatcgcactacataggtagtagtacatttataatggagaaaaggagtaattaagaaaacaaaagaaaaaggtggcacacacagtcagtggcgaaaaaggaaaaatgattgaaaaaaaatggagttgtgcgcttgtcacctttagttcgaggctagcccaatcgatgtttggtgaaacagtaagattagatataataatgtatatattccacaagaatatatgcagtggtgaatccatattatgatgtcgggccggttgatcccatagcgttttcacaatcacctttgagaatcttttgttttattttccatataaatccattcaaatttgcataaatgatcccactgaaatattcagtaatgataattgatccaagatataaattttctagctccgccactgaagatatgaacttcctcttgcaaccgttttttattattaaataatttggattgaaacttttatctggttaccggttttccaaatggatcacatttttttttcttcaaaactctagatgcgagagtgtggcatctcaccactattagttcagtctgcattggcaaggaagtttctctaatccaaacagttttacattctaatgaaacaaccaaatggagactaatagagttcgataagaaaaggagggcgaatagacaaatatacacaaaaagtagtatatttaaccaatcgtctctacttattagcctcgaagccaagcatgcattctacccacaaagatgacgatcgtttcaaataaccacatgccatttttgaagaactttcaccatgatgtcattttggaaccacatgtcaatttgatccagttaaaactgctcatttgtgctaaaaatccctcggaggtgttttgttttgtacttcctccatattttaatgtataacgccggtgactttttgtccaatgtttgattattcgtcttattcaaaaaatttatgtaattatcatttattttattgtaatttgattcataatcaaatgttctttaagcatgacataaatattttcatatttacacaaaaattttaaataaaacgaatggtcaaacgttggtcgaaaagtcaacgacgtcatacattaaaatatggagggtactggctgacatgtggccatgtcacgaatggttgacgatgatgaacacataaaagaagaagggacatgtacgtcggtcaatagtgtaaaatcaaaggagtttttgattactattctgtgatgaacaattgggcattggagattattggttttgttatttggaatttattcacgaagtggttttggagatgattggatttcacaggtgatcgcaggtttattatttcatgtgaccggtcagactgggctctggtagccggtcggaccggcggtgattgagcggtcggaccggccagcccacggtctgaccgaccgacactgtgtcggtttcggtttcgggttgtttatttggatatccgagtttatttcatgattatgacttttagatggatactatacgtatgtaatactattatttgctgctaatgagtcaagttggagatagcttggtctcggaatatggtttctttgtttgttccatgtgtaggtgactcgatgtctcgggagagtatttgcggtgatggaccgggagtcgacttggggataagacgacgtccgtggtggtcagagatcatgtgggatactaaggctagagttgatgcacgtggttgatggagattccatatggcatacgatggagttattgtgtgcatatgggatgcggagtcgaatttggaaggagtccaaatttggtacgattggttatgtaaagtttctttcttgtactagagggtttcctaaggtgtttaggactcctagtatgagtatggttcgtggctttaggctgcctacctcatgtataaatagagggggagcgtgaggcttcccggtatcgctttagagagcaattgagttgagttttgagttagggtttcgagtttagtcagaaatttttgtaaggagtgttgttggtgcactttgtaaacacagagagaatcaataaagtcgtcatccactttaagagttcttcgatttgtgtttaccggatttcggcggtttaaccggcgatctaccgatggtcagaccggcgggtacacggtggtcagaccggcagcggcgacaggcgcggcaggctgttcgaccaatcgatctacatcggtcagaccgacgttcatcaggtggtcagaccggtgcaactacttcagtcagaccgcgatccatcgatttcgaggataacttttatttccgctaaaagttttcggtttttgggtataccaaccattcacccccctctggttggcttagttcttgtgattcgatcctacaagtggtatcagagccttgttttcttctttagatttttatcgatatagagtttttgccatggctactcccgctaggttttcaactaagcctcatgttttcgatggaacagatttttctcattggtgtagtaggatgcaatcttacattatggctgaagattatgatatttggagaaaagtttctaatgcttatgtgattcctgaagctattaatactactgctgaaaaaactgcttttgaacaaaattgcaaagctcgtaacattcttttgagtggtatttctcgttcggattatgatcgtattgctcatcttcaaactgctcatgagatttgggttgctttgagtaattttcatcaaggaacaaataacattaaagagcttcgtcgagatcttttcaaaaaggagtatattaaatttgagatgaaacctgaagaagctttggatgactatctttctcggtttaataaaattttgagtgatcttagatctgttgattctttttatgatgctaattatccacaatctgagatttctcgtcacttttttaatggtctcgacatgtctatttgggagatgaaagttacatctattcaggagtctgttaacatgtctactttgactttggattcactttatacaaaattgaaaacacatgagatgaatgttctttctcgaaaagctaattctaagtctagtgcgttggtttcttcttcttcctctttggatgttgatgcttcttcatctaagtcctcttttcttgctgtttttaatgccacatccgatgatcaactcgaacaaatcgaggaggaggatttggctttggttgctaacagaattgctcgagctatgaataatgccaggaacaggaaaagaggtggtccaaatcgttgctttgaatgtggttcaattgatcatcttcgttcgcattgtcctaagcttgggagaggcaaaagagaagacaaagatagtgagaagaccaacaacaacaagcccaacaacaacaagtcgaagggttcttaccaagggaggaagatggagaatcttaggaaggcttttcaacaagtttgcgccgtcttcgagccactaagtgatatagatggtgaaagtggagatgatgataagggaaataacgtctccgatgtttgcttcatggcgcgtggtaaatctgatatagagtatgaagataatgaggtgagtgcttttgaggaagctattaatattttgagtgcaaaaaataagaagtgtgagaagatgtatagaaaacaggaatttatcattaaatctcttaaatttgaaattgataggttaaaatctcttattcctaatgatgatgattgtgaaaattgtgaggttttaatgaatgagatttcaaaaattagagatgttaatgctgcacatgatttgaaaaatagatcttctcttgcttgtagttttgttttgcatacacgcactttggatgagttgtttttaaccaaaaaattgttgcaaaaatatcaaattgcttttcatgctagtttgatgtttaacatgatttcggctaaaaagttaaaacaacctcatgatgttttggattgctcaacatgtaatttgaataagatgaaactaaaagatgctttaggtcgtgttgagtacatggaagatattgtgaaaaacaatgaagtgctttcttgccctaaatgtcgtaaaagcaaaggtgtcatggtagattgtgaaaattgtgctaatttggaaaaagagatttcttacttgaaaaattctttgctaagattttctgatggtaaaaagaacctcaacatgattttggatcaatcaaaggttagcacacataaccgtggtttaggttttaatccttatgctcataattctagacatcctcctgttgtgttaggtgctggtgctagaagtggtgagattttggttaaacctgatactaacaaaactgtgtttaaatctgctggtatcatgtctactatgagtgcatcttcttcaaaatccaatgttgtgcatggaaaatctcctgttgttgcttgtgttgctaaatcttctaatgctatcaatgtgtctaatcatcgtgaaaaatatacttgttctttttgtggcaaagatggacatattgttggtttttgtttcagattagctcataaacagaaaaaggagagagaaattgcttttgcaaaatcaaagtggcaaaaatcgggttttccctcgaggaaaccggtcaaaccgcagtgggtcccgcggtcagaccggctgaataccctcggtcagaccagccactgtacctcgatcagaccggcctcagaggaatttttctgaaaattctaaaattgattttgcacgtggatatatgcctattggatcttctggtcgtgtgtctcagtactggatttctaaatttttattatcatctaaccccagtactgagggttcgacttctgcttgtgtgtaggctttggtggcaaagaaggagaacgtgtggatcgtggattccggttgttcgcggcatatgaccggtgataaaaattggttctcctccctaaagaaggcatccaagactgaatcgattatctttggtgatgctgctacaagtgccgttctcgctacaggtttggttaaagtaaataaaaaatttgaattaaagaatgtagctttggttgaggacttaaaatacaatttgctttcagtttcacaaattgttgatgaaaattttgaggttcactttaagaaaactggaagtaaagtttttgattcttgtggtgattctgtgttgaatatttctcgctatggaagagtgtttaaagctgattttgaaaatcctgtttcacctgtgataacatgtttggttgctaagtttgataaacatgtgatgttttggcatcgtagacttggacatgttggttttgattatctcactaggttaagtggtttggatcttgttcgtggtttgcctaaacttaagaaagatcttgatttggtttgtacaccgtgtcgtaatgctaagatggtttctacttcacatgctcctattgtttctgtgatgacagatgcaccgggacagctattacatatggacactgttggtccagctagagtgcaatctgttggaggaaagtggtatgtgttggttattgttgacgatttttctcgatattcttgggttttctttatggcaactaaggacgaagcttttcaacactttcgtggtttgtttcttcgattggatcttgaatttcctggttctttgaaaagaattcgaagtgataatggtggtgaatttaaaaatgcttcttttgaacaattttgcaacgaaagaggtcttgaacatgaattttcttttcctcgtgttcctcaacaaaatggtgttgttgaaaggaaaaatcgtgttttggttgagatggctagaacgatgttggatgagtataaaactccaagaaaattttgggctgaggcgattaacattgcttgttatatttcaaatcgagttttcttgagatctaaacttagaaaaacttcttatgaacttcgatttggtcatcaacccaaagtttcacatttgcgtgtttttggttgtaagtgctttgtcttgaaatctggaaatttggataagtttgaggcacgttctaccgatggattgtttcttggttaccccgcacatactcgtggctatcgtgtacttattttggggactaacaaaatcgtggagacttgcgaggtttcttttgatgaggctagtccaggtactagacccgatattgcaagtacactgtcacaggttcagggggaggatggttgtatttttgaagacgagagcgacgatgactatgacgacgaggttggctcggccggtcagaccgagcgctaggccggtcagaccgccggcacacctccggttagaccggctcatgaggagcggtcagaccggccagggtcgtcgggttcgggtactgctgatgctgatcgagatggtcctccggagattactactttgaccagtactaatacagaacgtggatcaacttcagaagtcacggctcctttgcacattcaacgacgacatccgcttgaacaaattattggtcatataggtgagcggactacaaggtctaaggtaacgactcatgatgtttgtgcaaattctgcatttgttgcttattttgaacctcaaggtacttttgtgcatcaaacgaagtatacgaaggatcttttgagacggttcaagatggagaattgcaagccaatttcaacaccaattggttctacagctgtgttggatcctgatgaagatggtgaaactgttgatcaaaaggagtatagaagtatgattggatctttattgtatctaactgcttctaggccagacatacaatttgctatgtgtttgtgtgcgcgctttcaagcttctcctcgtgcttgacatcgtcaagcggtcaagcgaataatgaggtatttgaatcatgcacttgagtttggaatttggtattctacttcatctactatatgcttaagtggatattctggtgctgattttgaggttgtagaattgatagaaaaagtactagtggaacatgtcattttcttggtacatcattgattgcatggtcttctaggaaacaatctagtgttgctcaatcaactgctgaatctgaatatgttgctgctgctagttgttgttcacagattctttggcttttatctactttgaaacattatggtcttacttttgagaaagtacctctcttttgtgataatactagtgctattaatattgctaagaatcctgttcaacactcacgcacaaagaacattgatattcgttttcactttttgagggatcatgttgagaagtgagatgttgagttgcagtttttggacaccaagttgcaaattgctgatattttcactaaacctttggattctaatcgctttacttttcttcgtggtgaattgggcataattcattcttttggcatggtttgagggggagtttgtacctcatggttttagcaagcaataatatgacaatgataaaaattgagaaaagagagcttttgtttatgcatatggtattttcttgtgcatgctagcaatactttgaaggtttatttgtctctagcatagcttgtatgtattctagtcttttcatgatatttagattttgcttttaagggagatgatgcatgacacttaaattctttacttgaattaagaaaatatgcaatgttgatgctagcatatggtttgatttataaatgctctatatatatgctttattgacttgttattccttaaatagctttaattgctcattgtgaaaaagagaataaaaatatgaaaaaaatgaatactgaatccttggaaacagtcttgacgacaaggacgtattcgatatgagcaaaataatgggtgccgaatccctggaaacagtcttgacgacagggacgtacccggaataaaagagaaaaatatgagaaaaaggctcaagaaaagaaaaagttgaaaaattctcttggttattttgtgctaaaggttatttgagaaagagtgataaatgcaatagatatatgtgtttcgtgtttattcttcaacctatgtgcttgttaagatgttgcattataaatcatttaaaatcatgaattctgattgttgattcaagcttaattgtaaaatctttggttcatggttatactttaatgcatgcttgttatgatatagatgggttcatcttctttttattgcaacacatgacatgatatgctatatgtatgctgagctcttgaacattaatgaacctaattcctatgcttgatgaaatcattgtcaaaagggggagaagtaatgtgaaaatttttggatttttggagaaccaaggaaaaatttttttgaaaagttgttgagaagagcatgtttttggttcaattgggaatttctttcttttaaaaagggggagaagttttcttttggatttttgagcacgatgtgtacaattgtacgaagtgtgctttttaccacttttgtttttatttttccaaacaccaaaacatttttatgaatttgccaatgtgttcatcaagggggagattgtaaaatcaaagaagtttttgattactattatgtgatgaacaattgggcattggagattattggttttgttatttggaattttttcacgaagtggttttggagatgattggatttcacaggtgatcgcaggtttattatttcatgtgaccggtcagaccgggctctggtagccggtcggaccggcggtgattgagcggtcggaccggccagcccacggtctgaccggccgacacagtgtcagtttcggtttcgggttgtttatttggatatccgagtttatttcatgattatgacttttagatagatactatacgtatgtaatactattgtttgttgctaatgagtcaagttggagatagcttggtctcggaatatggtttctttgtttgttccatgtgtaggtgactcgatgtctcgggagagtatttgcggtgatggaccaggagtcggcttggg

SEQ ID NO: 5416 - DNA, 3813 bp, Oryza sativa
tatgggatgcggagtcgaatttggaaggagtccaaatttggtacgattggttatgtaaagtttctttcttatactagagggtttcctaaggtgtttaggactcctagtatgagtttggttcgtggctttaggctgcctacctcatgtataaatagagggggagcgtgaggcttcccggtatcgctttagagagcaattaagttgagtttttagttagggttttgagtttagtcgaaatttttgtaaggagagctgttggtgcactttctaaacacagagagaatcaataaagtcgtcatccactttaagagttcttcgatttgtgtttaccgggtttcggcggtctaaccggcgatctaccggcggttagactggcggcaagcggcggtcagaccggcgggtacacggcggtcagaccggcagcggcgacaggcgcggcaggcattctcagtggttcgactgatcgatctacatcggtcagaccgacgttcatcaggcggtcagaccggtgcaactacttcggtcaaaccgcgatccatcgatttcgagggtaacttttatttccgataaaaattttcggtttttgggtataccaaccattcaccccccctctggttggctagttcttatgattcgatcctacaaatagccgtggcatatgaaggccacctccgtaactatttacacttcaggttacaatatccggtttcatactttgggaattaaagtagtggtttctttcctcatggacgtgacgtaatagtcatggttcacgggttagggtcatgttctagctagtacaataatgcaactaaactactcattgatgattgatgtttcttaaaataaaaaagaagaagagaaaagttgctttggtgatcattatattccatcgagcctaaccatctagccatttatgcctgcctttggaagctggtgctccataaagccaagggcaagaacaccttttgcaaaccaacaccctcaacacctcttgttcccttgcctatgacataactatggagattgtaacaggagcaataaacactctgctcctcaaatttgcgaagctgctggttggggagtacaagctgcagaagggcgtgaagaaggagatcgagtccctccaggaggagtacgttggtaagcttgggtgcggcactccacaaggtatccgaggtgcccgtcgatcagatcgacgagcaggttaagatttgggtgagagatgttagggagctgtcctacgacatcgaggattctatcgataccttcatggtgagtgccggtaaggatgggcaccccgttgccaagttgttcagcttcaaggggatgattgacaggactaacaacttattcaagaaggttgtggctcaccatcagattgcaagggagataaaggacatcaagaaacttcttgaggatgcgagtaagcgccgcgagaggtacaagattgatgatgctgtcattgcacgaagatcggagagtattgatcctcggctaggtgctatgtacaaaaaggagacggagctagtcggtctcgatgggccaaagaatgtgctagtgaagacactcatggaggaagatggaaaattgaggaaacaccgagatataatttcgattgttggatttgaggcctcggcaagacaacgattgccaacgcattgcttcatgagctcagagtaaagtttgattgccatttctttgcattggtgtccaacaaatctgatatcaggaatattctaaagagtatactccatcaacttgacaacaaagccaacatatttgaaggactagcagacttccaacttataaataaaattagagaaatcctgcagaataagaggtacatttatgtatataacttttcaattattcacattgatttatcatgaacatatttatttcatttttaagttgccaacatgaaacattcatttaaattttgtacactatttttacctatgcattttcaatttgctagcatacctaatgactgattacatgtcttagttactccaattgtttccttgacgttgaactgttagtgtaatatcatctcgacgaaccaaacataacaaatcatgtaagaggtaaaaaaatagattaaactagaccaaacctaataatacaattactcctaaacgatgaggaattaaccaatggaactttacaaaattctttcttagcgtactagaaagttttttaggtttattatcttgaaaaaaatggtgctaagcgaaaaaagaaaaagaaaatgaagacactaagaaaaagcaacaagacacttctggatgcttaaacttgttctttattgaattaagtaatttgttcacaaggtgtatccgcaacacccaaaaccgctcaaaatacactctcccccacccccctccccccccaaagaacaattcaacccagtttgaacagttgtttttgcaaagttaagtgattagaatccaaaacatttactttttaactaagcatgcacccacttagaaaaataaaaattagttcccacataaaaaacatattattaggatgccaacatgaaaaccaccattaccaggttgaaggggtattctaaccaattttaatagttaagggtataagttgtccagtatcgtagttgacattgatttcttaacttctagacttggcaaatagttaaggtgggttaaatacttaaatggacttcactctttataaaatttagcacccaccatgttaagataaatttagatatcgcctagtctcaaacttctactatgacctaatacatgaatattgtaggcagatttgaatttttttttttgtgaaagagatttaatggtttcatttacaagttacaaatcttagtaccatttgatatattgtactctctgtttcaggttataagatattttgactttactgcttcaagtttgactaagtttatagaaaaaaaatagtaatatatttgactcaagataaatttattataaaaatatattttattattaatttaataaaaactaatttggtaatgtaaatattactgtctataaacttagtcaaacttgaagcggtttgactttgatcaaagtcaaaacgtcttataacctgaaacggatagagtggtcaaatggtgaagtttgactcccggaggccaaaactattgggggaatgttggaaacatccatcaactttacaataagatacaattcaaccctacttttgcaaaaaccattcgattttcaaccatggcagatggcaagaatttagagtgatttcaaagatgaagtgacctgctgatcctaagcaatgtcttaagcgaaaattataaagtggtttcaaagacattaattgtcaggctataaatgggctgtggctagaaacaactctccttttagaaggcaaagacaggtagtgtttaaactaactaaacccatttttagggtccaatttgacttaatttttttacctactaaattgatttaggatcggaaaactctaaattgtttttacacaaaagaataaaggacatgctctattcaaagcataaaaactccaaattagtaaatgtcttcaagcaaatttcacaaaaaattaagacgcacattggagtactaaaaaaactacataagttgggagcggagagtaattaagtttgagggactattgaacaaattaccacaagtttttttgggtgaaaaactttcaaatgtaactatagccattaattcgtcattagtaaatatttactgtagcaccatattgtcaaatcatggaacaattaggcttaaaagattcgtctcacaattttacacgcaatatgtg

SEQ ID NO: 5417 - DNA, 14390 bp, Oryza sativa
aaaacgcacactacctccataaaacttgtacataagttttatagaaaacataatatagttacaatgtaattacactacaattatattagagttacatttgaaagtttttcacccaaaatgttacgacaattttttttatcaattctcaagtttaatgtggtcatatttttttaaaaaaaatagttgtaagcattatttttgggccaactatactttaggaagcatctttttctaaattttaggtgatctactaattctaaacaattcaaaaacatgcttgtcaatgtccatcagcagcatatcacctaaaacaactctaaattcattcaaaggataaaaagttaacggttatgataattcagggttcaatggtttttgttggttctgacgcttcgggttatttcttcgactttcatggaatttcaaggttgtaaaatatagattaagctttctatagtatcatatatttctgaatctaacagatacctttccatgggagctctttccatggagtcatttgacacaattactatctagctttactgacatgtgttttatacttcttacgactagattcttgtgtgtaattgatgatatatgggaagagtcagctgggatgttatcaagcttgctttgctagatggtgatcatggaagcaaaataatcacaaccacccgaaaaatggctgttgcagaacgtgtcggtggtgctgtttatgaactaaaacctctttcttatgacgactcctacaagttgctcagcaagagagtatttgacactgaagacaggttcgctccggaattgagtgaagtcaccagaagtattttaaataaatgtggtggtttaccattagctataattactatagcaagtttattagccagtaaaccgatgcaaattcaggaatgggagaaggtaaataattctataggctttggacttggaaataccttgatgtggacaacatgaggaaaatactgagtcttagttactatgacctacctccacatctgaagacttgcttattgtatctaagcaaatatcccgaggatgcgattatcgcgaaggatattttgatttggagttggatagcagagggttttattaccaacgagggagaacatgggagaagcttacaggagattggagaaaattacttcaatgagctcctgaataaaagccttatccaaccagtagatattggccgcatttgtgaaaacgatggtcaggtgcatgcttgtcaagtacatgacatggtgcttgagttcacaaatcagttatctgctgaagaaggatttgttgcagcaatgccattagatagtgaaaaagaaggtatactggtaccgtctgttcaaaagaaagttcgccgactatcttacaattacagagacaacgattcctttcttcatggaacatactataccaccaatacatatgccacagcagaagctagagagagcttgtccagagtgaggtcttttactgtcttcaacagtgtcaaatccataccacctctaatgatctttcgtgttcttcgtgtgttacgactggatgattgttcgaatctagaggacaatcatctcaatgatctcgcaaagttgcatcacctaaggttcctgcggctagggaatatcagtaaactccccgagtgtattgggaatctgcaggttctacagactttggacataagagatactcgctcagtgattcagttaccaccttcttttgtcagattacgacagttagtccggctgattgctcacaaagttagtctggcagatggtttgaccctagggaatatgacatctctacaagagctgacatgcgccggtctcactgaaaacttactgcaagaggtgtgtgatctaacaggccttaggattctgaatcttatgctttcttcagaagaggattgtgagatcttcagggatgcctttgccgacagcctaagtaggcacaaaagtttgcagaacctcacactagatccccaggcctttacggcctagatttcatgcaacaagttccttgctgtctccaaaggtttatgagcagtggcccattctataggggattccctcgatgggttaattcctcactctcctgcctcaccatcttatccatcaatctgaacaattatatggagcaggagtaccttgtgactctcgcagagcttccctctctacagtttctcaggatatttgcatctaatgtagtggaagtgatagatgttgaacgtaagaagagaaggctcattgttcacagaggcacatgtgcattccgttgtctacaagaatttcacttttactgtcatagaatgtgcctctcttttgaaccaagggctatgcaagagcttcaaaggatttgccttcagttttcggtgtgggagactattgatgtctacggtgaaattgattttggactggtgaacctcccttctctccggaatatttttgtggacttggatagatttgaaacctcaggagaggagattcaggaagctgaagccgctatcaggaaggcagctaatgatcatcacaatcatccatcccttgattttgtttctgtgtatgctgacttatctcgtcacgtgtatacagtagttaaaggaatattaagacaagattgatctgcatcaaatctacgtcattccttcccatacatgctttcagcatgtattgggttttgatttgattgttttactaaccatttttcttacccgcttcagatttgctatacttccattgattgacattgcctttcatgattataaaaacttgatgcactcctgacgccttgttctggaatatacatatgtctctctcgtttgtgtgcagagggtaagcaaatgtcattggtgatagaccagccctattctgttcctcaaatcaaacaaattaagtgtaagacgaaatgattatgttctgttctggcatgacacatggttaggggcgtgcctctcaaacataggcaccgttacatttttgacatatgcaataaattcttaatagagaaaagaactgttgcagctttggtgtttgggagatttggcttcagaaggtctcatttcttggatcaaggattagcgttttcaacctccttgatctgttaagctggagagaactatcagctatttgatctgattgaaaattgttggccaaatcctgttgaggacagatgcaaaatgggctcttcggaaaagggctaagggctcttttcgaacgcaagaattttacatgatttttggaggatttagttcaaatcctataaaaaaatcatccatttcaaaagagggtggcacatgtttttatgcgcatgagaagcagggagaaggagagattctggaggagctaagataacaatgaaaatcaagatgtacatgtggcaagcctactgggacagaccctgcaatgcagctggagaataggatctggtaaggaggagatggagaaaatacaagtcacaattttcgtttgctcgcaaaactgcacaaacttatattgttttggggtgtgatttgtgcttttgatatacagctggtgggaccacatcctgttcttgtttccttctttttgtttgaatgatgcaatatttgcttccagtgaaagtgggatatccttgatccaaaagaaaagggccaagtgactaccaatacatagagtttttatgatattcgagagatatttgtacatcttagaaatgccaaaaatatttgcaatatctccaagaagcatattaatacaagagtggcttgtgtatttttaatatctccaatgagcatattctatttgttagggctttggctttttaacttatactggatgcaaccccgcatgttgctgggggatatctagttaagaatggcagttaaaaatgacaaactaactgtgctaaaagtattgaaaatatattgaaattgaataactaggaaattgatttcccatcaggaacagagcagttttgcaacatagaaaatacacagtgctaatgtgctacttgatttcactatcataaaaactagtactattctgataagcattgtagaacaaaacagaaatcatgctttgctctaaaaaaaattgaaagtatttaggtgcataccgttgagtcgttgacggatgagcacacgcatcaaaaactgatgagtgggggagacaaacatcacacagcagggctggtggatctccaatctgattgaattttacatagtaggaaaaaaacaggattaagataaatgaacaaggacataggatgatttagcatggaaaaggggatttgaaaaggacgaaacagcaaacctgtgtgcttcatggagtgactgaagctgaaaggcaggaatctgcagaagaagaagacgtaaaaaaacaccggcgtatccaagacagacggattccagtggcaggaggaggctcgttgttagaggtcggggagaagggtacctccgaccggagctgcgcatggacgagatgtggcggtcgccgtcgccgtcggcgagcttcgcgggagaggggagccgtcgtcccgtcccggtcgagcgaactgagtcgccgccggcgaggagctagcgtcgtcctgagccgcggttgggctgggcacggcgtacgggagaacattgatgggccgaggcggggagagtccagtcactcgggccagaaatataggcctgacgaattttttttcatttttaaatttttattttttaatatttacggactatccaaaatatttatagaaatggccccttccgcccaattggaggagggcaaggtgtgcgcattttgcactgaggtcccttgccactctctgcaagggctgcaagggggcaaatgcaattttcaccccgccaaaaatgcatttttctagtttttttttcattttatccgtccctcacgttaccctgccgagggcggcagggtctacttctgtaaatattttcgccggtacaatatttctataaatattaaaaaataaaaatttaaaaatgaaaaaaattataggcttgactatccttcaattgttcttttttcctgacatggctcgttgacttagttttaacttactgagtcagtatatgggacccatgtgttaattactcttctctccctctctttcttctctctttctcatcttatgcttggtagttggcagtgtgaggtggccagcgagagtcccctcaaccccaccggccgcgaagagaggtagctcgaggaacctattgggaaatgatagaaaacgcagcaagccccaaggggaaaacggaaaacggcacccgcaggtgtcgccattgctgacccaaaggctaggcctttgcccattgttctactcacccacgctaaagagtgcatgctagattcagcaaaaccaccagctaatctccttcgacgtgcaaccaccgcgtcgcaggccgaccatcaaagaagaatctcaaccctcgtcgcgcttcaaatccatccacgtggttgggttggagaggaagaggatgatagagaagaatggatcccttctccctgcactagcctgtccagcgtagccatcttatggcggcaagccgccgccgcaagaggacatacgcctggaaggaagctcgccacaggtttcaacaccccctcatagcgcaaccatcgccgccgcctcgaccaagctgcccgtcgcctcgtcctctcaccacggcagcctccgtcctcctcaccgcagccatcacctcgccgaccgccgccgaccatcgggagcgtcaccaccgctatcaggcaccaccaccgcccccggccgctccaccttgtgtcgtgcagtcatctgccgtcatcggctgagccttgcgcacgagccaccgcggcttctacgctcgtcggcctcctttaccggccgtcgtccaccgccaaaagtcgctgcctccgcctcccgtcgtcgctgcttgagcggcttgcaccggtcagatccgcgcgcagaggtaccagatccacccacggggggaccggatctggccgcggtggcgtcggatacgacgcctccacgctgcgtcgtcaacctctgctctgtgcgccagcccgccttccacgtgcagagacgggggtgccaccgagatttggcctcacgcgccgtcatcccggctggccgctcggttctccagcggtggcgaggggagggagaggaggagagaggggaggcggcggcgctaggctttccccccagcggcccgcgcatgggcgacgcggggtcgagacacgtccatactatggcgcttaatatttttgtgttcatgataaatgggttcacatatattttttttaattccaatgccacataagcgtcacattaacaccacgtgaaacgaagaccatgtcaacactgccacataggggtcacgtcagcaaaaacaccctccaagacctcgagggagttaaattacacctgttttaatagttgggggttaagatatcggtatcgtggttcagggaaacaaatcagatccggtcactagttaagggagtaaaagtaaacttattcgtagtgaagcccagaagcgggagatcaaggcccatctaggcccgacacgagagagccatataaaccccaccattctcccacccgcctcttccccacctgccctcctcgcgaaaaccctaaccctcctcctcctccgccgccgccgctctcccaaggtggcggcgctgcccttcccccttgttcttcttccttgcatctgcttccctcccgttttgcttctaattgtatttctctttcgtttccgcagatccctcccgtcgtcgtcgctgtcggcccctcgggtctttctagcgcaggagacatggcgtaagtttccccccgcaccgaaatctcggcgcccccactcgcttcatagttgatatatttttttctgttggtctggctgctgatggatggcgcctgagaaatgggttgtgctcctagcggttttgcgggatcatgcccttgctgttcgtgttctgtttttttgttttggaattgtgagggtcgcggcttgttttgacgaattgattcaagaacccggcgagtcttcagcttgtctgtaatgttgtgcgattggaaagctgtcatgctcatgtggctcgtattttagcgaaagcgtgagctgccatggatgggattgaaatttatgctttaggaattctttagttatgcctgtaatatagttttgcaagcagatttctggttcatactcagaaaaagaccaaacttctggggacgaatctagacatgtgcttctccgtattcatttccagaagttgtatttttgggacggagggtgtacatggtaatattaagcagatagaacatacggccagatagaaagaaggcttaatgcttgctgaattagtttttgttcgttaagcgagttgttctggctgagtgggggcatattattagttctcctttctacatttgtcctcgaattgttttgttttgcttgaattcggaaaaacctagctttgtgcacgtcattgctaatacagtgggaaattgacttttgcttatgtttactaactattttgagaatgcagcaccatatattgtcaaattacttggaactcaattatctaaagagcatttccagtagaacaaaactaaaaggaaaacgtgttgctaccttgtttactaagattaagcatccatgcagggaagagactccagttgaggccccacctgccccggttcttggagagccgatggacctgatgactgctctgcagcttgtgatgaagaagtcaagcgctcatgatgggctcgtgaaggggctccgtgaggcggccaaggccattgagaagcatgccgctcagctttgcgtgcttgctgaggactgtgaccagcctgattatgtcaagttggtcaaggcactctgcgctgagcacaatgttcacctcgttaccgtgcctagtgctaaaactcttggcgagtgggcaggggtgagatacattactcttctattagctataccttgtcaattgttatactgtgttaatctgatgtctaggctgccggataagattttttgatttagccttctgctaatgactacagttttaccagctcagtgtaaaatgtgctatttaattttgtaatcctttatctaaattttaatttcattttgttgttgatatcgttctgcatctctcctttctgcatatcttctgatttaacaatatcacaacaaacgttgtttgcagctttgcaagattgattctgagggcaaggcgaggaaggtcgtaggctgctcctgcgtcgttgtcaaggtagataattgattacccaccatactacttcaaatatctttttgccatcttcggcatttggtaatgttggcttgttctttctcatttaccaggacttcggtgaagagtcagagggcctcaacatagtccaggactatgtcaagtcccactagatatagcgttcccgatatccagaacttgtgcttgacattgtgtactttcctttatattttgcttggttctgtggcttgctaggagataagaaaatttttgtggtgtgagccaaggggatatgagcaatttggacctctgaactttatgtttactgtgctggatcagctgtttatttatctgaaatcatcatgagctgaggatctgtttgccccttattttcagtttggttttattgttcggtgaggtctgcatggtatttgatattacagcaaggaaattttcaccaactgtgcataggtgtaccatgtttggacaactaagcaggactgcgtgatcacgctgagatgagagaatcttacgattttcatggaaacaagtacgtttgcaaagacgattttatttctccgaagacaatttgatacaccatgcgactaatttatcaaattgtctttggatttcgatcgtctagggcttacagtttttcctttttgagctcaaatgcgagctgccagccccattgaagtaatctcgaaattcatttgaattttgacacaaaccaaacggtttgcgtggagatctgaattgtttctggcttaaatgcgaaccgcaatgacatcaattttgaaatttatttgaaaattgtcacaaatcgaacggtttgtggacatccgaattttcggcaaaaaaaatcgagcgaatctgaatatgtgaaatactcccttcgtacttgtaaagaaagttgtttaggacaatatttaagtcaaaccttacaaatataaattataaattactttcaagttgttgtgtttaaaaatgtaaaaactatatgactagatttatcttgaaaagtactttcataaaagtatacacatattattttttaataaatatttttatagaaataagaagtaaaagttgtgttttgaataatgtctctgctgtccaaaactactcccttcgcgagtacggagggagtatcttccccttagcacgaatctcgatgaaatctagcgagagggaaaggcgggaacggataagatagcaaatctcccgagccgcgaaaacttcttctccgacgccgatccatggccgccgccgccgccgccaccttcctcccccacacgcccaccccgcgccgccgcctcgccgtcgctgtccactcaccgacccgccgccgtctctccctcgtgttctccggccctcccgacggcgccctgtcggtggcggcggcggaggagaaggccgacgccggtgaggaggcggcggcggcggtgtcggccccgcggggcggcggaggaggaggagggaaggagcggcgccgcgtggtgcggaaagcgtgggagaagctcgtccggtggtcccggtcctggcggcggcgcaaccggagcgacgtggtcgagacgacgcgcaaggtggtggtgctcggagggggctcgttcgggacggccatggcggcgcaggtggcggccaagaaggccgacctccaggtctccatgctgctccgggacgacctcgtctgccgatccatcaaccacagccacatcaactggtgggtacagctccaatctctcattgccccccatttcttgattcatttgagaaataatatcatatcattctaattctggtgattagatttcttgctgaatctaactttcagcttcttcaatttgtctcagtaaatatttacgagaccacaggttaccagaaaatatcactgcaacaactagtgctagtgatgctttagcaggagcagatttctgcttccatgctgtcccagttcaggtattcagaacagttcattacaaatcattgttcagtgcaatgggggttcccttccctcttgtgactcttgaggtttctttttgtggcagttcagttcatcatttctcgagggtatttcaacacatgttgatccgaagttgccgttcatatcgcttagcaaagggcttgaacttaacacccttcggacaatgtctcaaatcatccctcaagcgctggggaatccccgccaaccgtttattgttctgtcaggaccttcttttgcaatcgaactgatgaacaaattgccaacaggtttagtaagatcatttcttgacaagtttaatcttctctatgtcatactccctctagcttgtttaggatgcaatgtcaattggcaccacttcatgttttttttttctgttttgcttgtgtttaataattgtgaggatgcccagctctggtactttctataaagaacatggaatgtttttatttgcaatgaaggaaggaacctcatagttattaaactttacatggcagctatggtggtggcatccaaggacaaaaagttggcagctgctgttcagcagctgttggcctcaccgaatttgaggataagcacatcaaagtaaatattactaaccattggccatatataaatgctgatcactatgtaaccgagaattcttttatgtatagaccaagaactgtttcttctcttctgtaaggatttaggaattcagacaagcaacatgggctatcacttagtttagtaaaaataatgtacattgaatttaactatgcattcatgagaaagaatacttgaatgtgacttgtgatgcttcagtgatgttacaggtgtagaaattgctggcgcacttaagaatgttcttgcaatagcagcaggtatagtagaaggcatgcatcttggaaataactgtatggcggcccttgttgctcaaggctgttcagaaatacgctggttagcaacaaaggtgtgagatacttttatcatcagaatgtaatctttgaaggatcaacttatgaagttcactgattccttctttttttttccaaacaatccgaagatgggagcaaagccaacaaccctttctggtttatctggctcaggtgacatcatgcttacatgttttgtcaatctttcacgaaatagaaatgtgggactgcgtcttggttctggtgaaaaacttgacgaaatcatgaattctatgaatcaggtctggagcattcctgctattgaatcaacttttggatgaatgttgccaccatacatagttttaatatattcatctcactgtataggttgctgaaggtgtatcaactgctggggctgtcatcgcattggctcagaagtaccatgtaaaaatgccagtcttgacagcagttgcacggataattgacaatgaactaaccccaaagaaggctgttatggagttaatgaatcttccacaggtcatacatttaacttcatgtttgattctgttcttcatgataaactactttatcctgcaaacatagccatcaaaatacttgcattttaatataacatagaaatgacttcacgtttaatatagttaagatctctttcagatccctctttgatttcgctggctggtaattaacatttggtcatcagttacaaagtaaatgtcaagcatgcatgttgtataaaccatgtgaagcgtatctcttgcaatgtcttcaagttttgctcaaggtcctttaatagttatatcccatcgataacattttcataatacaaaagaaattaacaccttttggcttttgtagaataggtatttgcatttgtgattacactttgtaagtaagtgtaaaaacacattttcaattatttatctccatcatactaatggttgatccagcagcctacaattaatctggatggaaattgatcttgcatgttttttattaaaaaaaatcaacaattacactagcagccagattctggactgctacttgcttttagcaaccgtgctccattatttcctcttgagtcataaacctgttagtatggaatgacaatttctgtaactttggtttacaggttgaggaagtataacagcaatctaatggaatgatttaactgactctgccggccgcctgctgcactcaaattaaactaataatatgctccaaaatgggcttctccgtgtttgattatctacatattcagaagatgttctcttctctctcttaatccacttgagctttcagatatgaaaatgttatttttacacgagaaaacgaaggcgtgtgtacgctcgtatgcacagatagagagaggatatagtttatagcaccagaaagaaataggacaaggtcgttgtccgaaagaagaccacagttttgtttctgatctttttagaatcatttgatctataaatatgattctttcttatttttcttctgtatcgaaaacatgcagtgaattttcttcaattttacaggtgcaatatcttagcgaaaacattttattcattcaacgaaaacttgctcatggagaactagaaaacattgaaattaatgaatgaggaaatcacgttatcattatctgatataggagtatttcttatgcattgtgtgttatgtgttgcatacaaaattacaacaacatttcatttatgttctttacataccaaatgttgcttataagagttatacttacaaaagtcacacctcatttttctaaacatctttcctattttctatcatgagctccaataaatttgcatggaacagtgccgaccatagtcttgcactcttgcccttccccgtatgagccttaccaggaaatgagccaagagcattgccttttttttttaattgtaatccaaaactacaaagaaacttcctcttgaaatttcattcatgttccttacttacaaaacactgctacagtaacaaaagacatacctcgaatttccccttttgtcaccaaatcttaagataccctgcaactttgctcaaatagagacaacaagcaacccaactgaacaatgaaacacaagcattgcttacacagagaaggaaaaaaaaagatgcagtgacacatggcaaagcagccaaaaagaaacgaagtgtgactaacaaaataccaaaaagaaaagaaaaggagagaaatctttctctttttacgaaagagaagaagaaaaaaaaaacctgaagcagagggctggcggcccgggcccacaccacctggataccgaaacgccctcgggacgatcccagccgtcggatcccgccttatccgcccacgtgtgcgtatcggattcacccaaccccctcctataaatatcccgcccccccctcctccaccccaccttttcctcctcctcgaggctcgagctgccaccgccattggagcgccacgccacgacacgcgccaccgccgcagaggagagagagagagaaaatccggaggcaggcggcttggtgtgggttgatgggcgcggcgggggcgatggagagggagctcctggaggcgttcgaggcggcgaggaaggcggcggacgcggtcggggaggcggcggcggcggccggggccggggaaggggagtcgccggaggccgcgcgctgcgtcgacgcgctgcggaggctgcgcggggctcgcgtcaccaccgccgccctcgtctccactcaggtgagccacgccgcgccgcccccctgtttgttgttaaaacaccgagcgcgggggccgtaagtagactggggattgtagggaatctgctctggttgttgttccgacggtttgggagatctctcggcgaggtgtcttgccgaggaaggggaatgtgggttcctgggaagcgattttagggttgtttttgtggcttcagattcaaattgttcgtattcgcatggataggattttcgcgtgatagttttattgctgtatatgcgtgcggggtgggggttgttagatgtggaaaggttggggattatgaacattaggatgcttgttttaccctgcttgcaaatctaaggaatatttagaatattcagattggttgatttggtagctattgtacggacgcttcattgaggggtgttggttgggttagatttggataaggggttgcagcaatgctatactggtatactataatgataattgggatttccgtgatgtctaaacatcaagcatgggtctactatactggtatgctg

SEQ ID NO: 5418 - DNA, 1579 bp, Oryza sativa
  unsure (1)..(1579): unsure at all n locations
ttggacccaggcccttggcttgggccccgggacagaattttctccgtcttggcataaatttggcccatatccaaggtttgttctaagaggtggccccaccttgtagtacgtatatggcataatgggacgcttatgcagtataatcggtgcttatacgacttaagaggtacaagattggggaacccgctccttgtatgcggcctagtatacctttttctagaacattgctcaaattacaatagggcggcctgggccttggcccatttctgggtatgcccttacacgtgcagacgtacctcgtaacacaaatgcctcttttttggggggtttggccctgggggtatctcatgtccaagtcattcttttctattgaaaagtaaaatataaaaagtatcgatggcgaaaggataccattggatagttcgtagaaagatgtgggttgtctcctgattttgtcataaaataactttcttattgtccactaaaagatgagatgaaattttggattctttccatcgcttcatcaccagcaaacaaaagttcaacaaatttgaagctatgttactctaacagtagatgacagcagttgctgagcatttacttgttgactatcctgcgttcctgcttgctgacacataatctttaggattatttccatgtcttcataaccagtaaacaaaagttgattctgaagcactggtgctctagcggtagatgacgtccttgcaggacagcagttgcttagtgttaccggttgactacgctgcattattgcttgctcacacataatcttgcttaccatttttagcaagcacccagtgtttagcttatattgctctatttattaccatgtccagttatgtaagatatgtaattccacctattttccttcctgttttgctcagcatggctagcatgcaaatgttttccttcataatggtacggtgtttttcttcatgacagcatcatatcttcccagagggaccttgcgtttgatatctagttattaatgtggaaagctaaaaaacttgtacatatgcatgtggtgtttgggtaatacaactctctttatgtcatatactaagttactaatacttacacaatactcttgtttgctgatctgtaaaatcattccataagatacacttatggagtaccatttttcatgaactgaaataccttcagtaatttaaggtttttatagaatttcaaaagcgaattgaatttttaatcccaactcttagtgctgagctgttgctttccatgttctgaaaactgggtgtctaggcttttattttccttttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5419 - DNA, 754 bp, Oryza sativa
tgtccatcagtagtggtagctgtataaaccagacgtagaggtaagggcactagtcagcagcagacgagacgaccggcgatgaatatgtagatgcccaacaacagcggcataatacgccaatcaacactggcagaatcatgcagccatggaagtgaagaaaccagtcggcagccatggcaaacgtaggcagcttgtgttgaagatactgatgcctattagtagtgacagcgatgtagccagccgtgaagaagatagcatcagttggcgttataacaggccagccgtgctagcggtgacatcagtcagtggcggatgcggcggccggccggtgaagacgtagacgcccaacaacggcagcataataggccagccgtgcaggcggaaacaccagtcggcggcggtcgaggtggccggtcggtgacgacgtagacgcccaacaacggcggcataataggccagccgtgtaggcggaagcaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaatggcggcataaaggccagccgtgcaggcggaaacaccagtcggcagcggcgaaggcaagccagtcggtgaagacgtagacgcccaacaacggcggcataaaggccaaccgttcaagcggaaacaccagtcggcggc

SEQ ID NO: 5420 - DNA, 4817 bp, Oryza sativa
cggtcggtccagccctttggcccggctaggcctcggcacccgggaagcccgtcacggtgcccttaaagcgggcaccggagccagggcggccgcgtttccggtgtcggcgcaggcccagatggtagtgcaaagggagctggcagcggtgggtcgtctttctcgttgccggtcggcaccctcacccttcctagagctcctccccttctttgcggggagtttctaggctggattgaggggccagcttgtcagcgggggaagctcaggctgccgaagcaatgccacctagtccagtgttctccttcggccagatctagcgaagaggccggcgggtggtggaacggaagggtcctgggccagctctcagcgatggtggtttgatgaagtcgaccgacggcggggcgtcggtgcggtgtggtggcagtcttgttgttggcaggattggatgctggctggcggatgggcgtcggtcgggtgtggcggaagccatgtgtcctcggtcggattgggcgacggaccacggcggtaggggttccgagcgagagcttagcccaatttctttgggacaaaagtgactacaccttcgggtgtggtaactctcctgagggcattgttgaggtacccctcctcccgcggcaaggagctctgggtgaaaacctagtccagttttttggacggatgatgacggcgtctttcggcgttacgaccctcgtgaaggcgtcgtttttgagtcttcgtgtcatggtggtgttgttggcccggtggcgatcggtctagcatagtgatggtcggttcgatgcttagcttctctctctgtagcgtgtgtttggtcggttggcacatggtttggagcgtgctctggtgcacatccttcctcgacagccagccgtcgatgtaaaactttccttgtaacatttttctccctatcttaattatattgaatgacctcctttggtcattccggcaaaaaaaaaaaaactattacttccccatcctaaaatatagcaacctaatattggatttaatataacctattactataaatctaaatgggatatacttaggttcgtagtttgagattatatctaatccggtactaggttattattatattttagaatagatgaagtattagatagtctttgcctctccttaccgtcaatcctccctacttacccattggcattcagctgtcagcacagcttagcatccttgaagtgaaagtaggtggctccaaatcagccggacagcgacttcaactgataaggtacatttgtgaaaattacaccaagactaccaactgattgacctttagcctcacatactctacatgcagtaatcaagtattaactgtattatgtgtctaattatggatttatgttaatgtaaaaaactgcgtggtcaagttatgcctgattgacttaaaaaaaagtctgaattgataatagcacttatatttatgacaacgaatacatacgctgaagctagctcaaactgaattctacactagataaattattttcatgaaatgtgcattaagcttagcagatgaacaaaaaccacctctactgaaggttggatggatcatggctggagtgattaatcaagactgttgcaggagtcaaacggaggatgatatcagactgattacaagtttctttgtgtggtccagttcctggattattagttacccttcaagcaaatggcattcaaatcaaacgggaaccattttcagatagctcaatctttttgcatcgtatattgacgtcgcattcacctttttattccatgatttgacagaatgagtgtttctgtttctattgttacaagattcaggcattccgcacacatcgtggataattatttatcaacacactataagtttacaactcgatgacaattggtgagcttgtcagatcaacaatcctagccatttcgccgcctccttttctcccaagacgacgagcaattggggtaaccaagtttatcacatctttctcaaggaagagaggagcagggccactctcatctgacgatgaactcctcccaacatatggaaatggagacgaaatctgtcctgacacaccgtctagtattcttccaccctcatcatcactggacaaacccgacgaacatcgaggcgatgttgccgatccgtccgattcccttgtcgtctcatgaattccactccatgacatgtaaccaagctcatcagtggaacattcagcatcactaactgcagaggctgcagttctggtttcatgttccaatggttgtgcttcaaacaatgggttgtcttcttgtcccatccactcatcatgttccgatgattcgtccaatcctcttgcttctgctgctccaaacacactccaatcgatcggagcgaaatcgtcgtaatccgattcattgcctgcatttctaatttcttcttcaggcaattgaaccaaaccatgctctgaaactgaaagttcgtctcttgcaggcgcatgcgcatcatcaggttcttgatgattcttcttcggaggcggctcgtcgacgttgttatcctcctcagaggaaacaccatcggtgcagtactggagatcctccagcgagcagacggccgtcttcatgtggcccggcagcggcgggcagccggcggcgaacttggtgttcttggtggagaagaagttcaccgtcaggttcagactgaacaaacacaatattcagcaacaacaacaacaaaaaaacattcagctacagtttggttgcattcagttcagagacagccatgatcgcgaagaacaaagtaaggaaaacttacttctcccaggaggggaggttgagcatggtgtaggcgagcttgaccttgctgccgacgccgccgagcgacttgaagctcgcggcggccttgcgcacggccagcgattccgtcgggtgctgccacgcccactcgaactgaaatcacaccataagattttaatttgagcaagaaaacattggcaaagacaagaacaagaacaagaacagctacacctatctccatgattgatctcccccaaaagacaaatgattggattggatcggattttggctggattacctggagggcggcgacgttggtggggaagccgtagatgcagaggaccatctcccatggccggccgcgcttggtctgccacgcgccgcaccggatctcgccgttgtgctgccggatccgccgccgcgggttcaccgtgaacctgccatgccagccatccaatcccacgtcaatcgcaagaagaagaagaaggaagaaatccgcggcggcggaatcgcgagacgagacgaggacccgcgtcggatgtcgtacccgatgtaggtggagcccttgcggcgcgggcagagggaccggagcaggtagcagcagaagaacctccctcctcctcttccgccgcggccgccttcctccgccgccgccgccttgcgtggcctcttcttacccttggccgcctccgccgcccctcctcctccgcggcaggcttcctcctgcccgtccacggcctctgccgccgccttgcgtggcctcctctttccattggccgccgccgccgccgccattccgccggtgtgatgtgatgtggtgtgatttgctccgctctcgttgattttgaccgttggaatctgtctgggggaaaggggaaagagccgttggcggatgcggggggcaggacacttgtccatatatgggccgggccgtgttaagttgggcttacgaggtttcggccctgatcgaaatgttttcttgtgggacaaaaagttttattcgtattgcaccctcctttttttctgataaaaaacaccgttaacttccaaacacatgtttaactatttgtctaatttagaaagtttatgcaaatgtataagtgtcgacgagtgatactcgcggaccggatgagttgagtattagagtacgttggaacgagagtttacgtagtatgacatcaagtagacaaaagataaagattatactggctcagaccccttgtcaggtaatagccttaatccagtttatatgggattgatgatgatgagaacagattacaaaggaagtagacgaaacagatggtaccgatgggatcgtagtcgatgagcttgacgagatctcctggcgacttggctccgcgtactccggcatcgtaaactatgatgggtgtgttggcggtgaaattcgatgccttacactcctccctgggggtctctttaataccgtggatcatgttgaccccctaagaaagatctaagaatatttgatctgataatctgatacagtataacagaaatcatatcccctccaagtaagactttggaaatcgcttatcgcttaattcgtagagatattttccataacttaggacggattcctaacggcgtacatatataaagacgatccgtgtacgtgaaagtataccttatcggtatattccataagtcgtaggatagaaggtataccttatccataaccctgacaataaggtataagtagaaaaactcacaacaaaattaataattaattataattacatatttttttaataaaataaatagtcaaatatgtgataacaaagtaaatggtgtcatctattaaaaaagaagatataattactttagcagctgtgatatcgggcgtacctcaacatactcatccaagccccttctcacaaaaaaaaagaaaaaaaaagaaaaatactactcctcgaaacttgtaaaacaaaacaacttattcgtacctgattaattaaatattagttcaagaagatttgaaaaatatattaatataatattttaaaacaactttctta

SEQ ID NO: 5421 - DNA, 1044 bp, Oryza sativa
  unsure (1)..(1044): unsure at all n locations
aaaggcatcaaggttgtagcgatgaacgagcagaaagaccctatttcttcctcagcattggtactacctccgttcaaagggaaaattggaaccatgctattatattttgtaaattttgagatataccatccttacccacatgtcattgacttatgtgggtcctatatgtcattgagatatcaatggcatatctcaaactttaaaaaattataatggcatggttccaatttaccaaaaagaatgtactagctatctactatccaattgaatctttatagagatatcgactgttcagatttatattattaggatgtgttcaattaaatactaggcaactagtttattttaaaacagaagaagtatgtgctagtttggtttagtaccctaccaatatattggtagtgccaaactctagacaagttttggcactaccaatattttagtaggatagatctgtaaatgagtgtgtttagtttatgccaattgagagccaaattttaaattgtggcgaagaatattttagaattgtgtcaaattaagtataggtattaccaaacatttggcttcaaaccaaatcttcacatttactatttaaactaccaaaaaaattggtatggcaatattttggtattaaccaaaacgctcctatatgtgtttgtcctgaatgctgaagccatcatgtgctagcgtatgcgtcattctggtgtgaatcatcaatcaataactcccctaaccccactgtttttctcatttttatgaatttttttttggttatctggatggtttacacgtcgctcctcattccggctcctcgcgtacgcctgcgtgaccgctcgtaagcggtcaccggtccaacgatttttttgggcgcgggttggagccggtttgactaaaaggatattttgcaaaaaagtccttgtatttccacgaaatatcgtatacgtccttggactggttcacacccgttgtgtttgttgcgaaaaagccctnnnnnnnnnnnnnnnnnnnnnnnnnnnnnnnnnnnnnnnnnnnnnnnnnnnnnnn

SEQ ID NO: 5422 - DNA, 2304 bp, Oryza sativa
cgtcggcctcttccgccggtccgacgtggtcaggatctccaaggtcgacgccttcggcctcgacaccgaggtcatcctccgcaagaagaggtcttcaccctaaccaccaccacatccacatgcaactctctcaattctccacacacaattcaactctccaaacagaaaaaggaacacaaattttcttccaatttccactccgatttttttgggttcgatttgttctttgcaaatgctgcaagtgtagttagttaattaggtaggcgattattttctactaggacatgcatgcatcgtaggcaacaagttactaaaaaaactgaaaatttcccggttaaaagaagtgaaagaagaaagttaaaaagattagtagtgatttggttgtcactttcccttcttttcttgatcactttcaccaattgttcttccctttctcttttatccttgtccactttacggaaagattctttgattgatttgggtgggggtgtgtgatcagtagctgtactaatcgagtatatcggcggcataactgtgtccgtgcactgcacatcagctagaataatactgtcattgacatttgcagctgagacattgatgtggatgccgtagctgttgttgagttgtaatgtgggggatagtacgttggaaacttggaattttgcaggaatgtatggatcatgtatattctctttgttttatgtataaagagagagagaaaaaaatcccatcttatgttcattttctgcaaggatattattgtcacgagcacaacagggccatgaaaacgttcttgcattgcatggagtacataaatgtgagtgcttggattacccctagaaatcacctgcatttattcaaatgctaatgttttagtgccagaagttgcaatgaaagtgacaactgagagcaggtacaatagcaaactatacaatagcaaactataagtcagcaataaacacatttcgatgagataaaagaagagagagaaaatcagtggactacagatttgtagccagctgcagtacagactctaagatacatatgtatgacaggtgggaccaagtatgaattgtgtagtattccctccgtttcaaaatgtttgacaccgtttactttctagtacgtgtttaaccattcgtcttattaaaaaaattaagtaattatttattcttttcatatcatttgattcattgttaaataaactttcatgtacacatataattttacatatttcacaaatttttttaataggacgaacagtcaaatatgtgctaacaagttaactgtgtcaaatattttaaaatggagggagtatatgttatacgtaactattgtatgagttaactactaaattgactatacatgatttggagaaagtcgacctgcaggatgcaagctataatattaaacttgctctgagaagagggatcttttcagtgttctgaatctttcctactgtgatgggaatgacaaaatttatcacagaaattacggcgggtattcaggtaaaggcatcagctggagcaacccttttggctcttttgggtgagagactgacaaaagagtactagaaacttgcaagagcatagtagcctagtactcctgtactgtgcatggagtgcaaattaagtcaattatttgggacagctctcttgacctgaaatgagaaaccatctttgcctaagagcaagtttaataagtttaatagtatagctcactactggctctaaatcatctatagccaatacaatagccaattcatacaatagttgcttactatactattaatatctggtcccacctgtcatacacacattacgtcttggagtccgtgctgcagctggctacagatttgtagccccctgcttttatctctcttcctttctctatttaaaatatgtctatagctggcttatagtctactattgtaccgctctaaacgaaatttcagaaacatgcattcatcccaatactgcggttttttttttctgttcacacagaactgtacagtgtacaagaggcagggaaggaggcacatgcatgtgacaattttttaggagaactaaaaagtagttgtatggggagtggggattaactaaccacctgatcaggcggcctaattaatagcaaggccagctcagtgcatgagacaattgtcccccatacaccaagacacgatccacacagaatgtgtcacatggcctctcacacacaccaacaatttgtactaaacttcggtaaatttttgtatagctgatggatgcctgccacagagtactccactagcttagctcgtgaaac

SEQ ID NO: 5423 - DNA, 729 bp, Oryza sativa
tggccagctgctagcaggatttggccagtgggatggcttggccagagagttaatgtcttttttttttcatatgttggctataatttagcttggagtggcatttggccatactcttggagatgctctaatgtgaccgtttttctcttttcttttttttttccctgaagaagatttgtccgtttaaggcttgtttaattggtgaaatgaaaatttttggatgtcacatcgaacgtttgaccggatgtcggaaggggttttcggacacgaatgaaaaactgtcggtgatatggtcccgggggtatcatgtttagagggaggaggctgccccccaatgccacgtggccctctcccaagggaagtcaggcccgaggtggggtggcggccactccttcccaaagactagtcggaggaggctgcctcccaatgccacgtggccctccctaaggggagtcgtgcccgaggtagggcggcggccactccctggtcgagactagagggagaaggctgccccaaacgccacgtggccctcccccgaggggggattgggcccgaggtcgggcggcgaccgccccctcccgtgactaggggtcgggctcccccgaccccctctctaggtcaccacgtactgtgggttaggtgtccgcctacaggtgctcacctacccgcatttatagcgacctgagcggtcgcgccactccgcatttaatacggcgtgcagtgtactcaacc

SEQ ID NO: 5424 - DNA, 1505 bp, Oryza sativa
  unsure (1)..(1505): unsure at all n locations
tatgttacacatagatgtgttttgaaagctaaataaaattacatagcaacatttggtcaacaatagctatatgtttaacagtagctttgcttaagctgttaatcatatccttgtgtgcgcagctgcgcgcggcgtggcgccgcgcttatacttctagtatatctggtgcttcttcctcaacctctcttgtcctccctgctgctgctccgagaacatgaatggattcataaagttgattcgtgtaattaaatgccacattctgcaactatggacggtggcacggcgcgagtgtgtgcgacattggctggtgactgatagtatttgtggcgtgtgcgcggttgatcatttatttgtctcactcttccgcaactagcctgtacttgttcttgctgagaatgctaacaattcctttacgtaaatttggcttccttgctgtatttgcttgcagtatctcagtcgtcgttgatttcgactagcagatcttctatctcgagcttgatggaggtaaaaaagaaccaaggaaaagacgcaattttgctttacagtatataaatcgtcggtgcaatttgttcggaaataaatagtggactggcacgcgcaatcacaggaagagttttctttaattttgtggcttaatggagagtgactagatgataaattgaatcaaagaagaaagaagatttcagtttgttcttttttgcaggaaaaaaaaagaatgcagtttttgtaagatcggattcagacttaaatgcggctcatactaattggcccagaatgggatttcgattccgtgaggcctatatatatgttgggacgtgaggcccataaatattgggccagaacgggatttcgatttcaagaggcccaataacgggagtaggagttacgtgcggccatattaggcctaacgggattctgacttgtgggccacaatgattgggccgcaactggatttcgattacgtgcggcccagtcaacgggcttggagcttcgcatggctttggacttacgtgaagcccattttcgctgggcccgttgatatatggggcccaggaaagttaatccgaccgccgcgaaaaaacagcagtccagatgagtaacatggaccatctctgcaactgcagttgatttacaccatgatttgatgattgatttaactcagataaagaaaggcatagtttatcaacgaggcaaaataggatgtgaatatgtgatccaactgatggtcaatcattgagctactaccagagatgttcaaaacatttcagtcagtgatgcgcatctattgtgtcagaactcacaagagagatgcagttaacagattcacatactttcatctaaactgaggtgatcttaacccagagcccatctaaaataacagtatacaagaatggacaacttgtagtcagcttcaaccaaatgaaattcatcatcttgatcatcaacccttgtttcagtttttactgtnnnnnnnnnnnnnnnnnnnnnnnnnnnnnnnnnnnnnn

SEQ ID NO: 5425 - DNA, 9469 bp, Oryza sativa
catcagttcagacaaacatgtgctttctggaaagcaacattgatcaactggctgaataagacgtatgatggatcagcgggaaacatagtaggaagtatggaaatgttcttgttatagataagatgacaaatgaatctgcctcccaaacaaaacagaagaaaaaggatccaacacacagttacatggattaccttgagtggtgtacagggatgacaacttcccatcttttctcaacagactatgaagtggtttagacgtgcagttctcaagagccttaatccatatggtctcgagcacatctggatctcctaagttcatatctaaacaaccgattttgttctgatagcaaagatgagaactggtatctaagctttcgtctttcaagatagcagccccatcatctgcataataaatagctttcagtgagcatgagaaagtgactcagtcatcagagtttcgttccataacgatattatacaggaaacagattaacccccatgggtacaaaataactgacactaatgtaataccatatgaagtagagaatgccatttacctgtctgactctctgtgaacatgcttgaaactgcagcatcatctaggcagtacggctctctcatattaaactgtaacagcgctgctgtaagccatgtagactggttctttgtggttttcagctgcttttcagtttcagaaagtatttccagtgcatttctaagtttgtgcacatcaatttcagccgctgtaaagttaagatacaggattagatgatatgtgtatgacacattaatgtgaactgtgagcataataattatcatatataataatgctaagctaatatgtcatgtttaaagggtggaattatcttcaagataaggactccatattgcagtgttatgttcggcattaacaataacagatctgcaggtaatccgtgtgtagattgtacaattttaaagtttgtttgggagggaaggagcatacatgtatgtttaccagtaacctttctaacttcttgggaatctgactggtgcctcccagctaaaatatccatgataagatttgcaagctgagctaataactgcagggggtcaacctttgagctcaaaagctccctagccctcctgacaatggtagcagcatccgatgaaaaagccagattaagaagatcaagcaactcctcatctgagacatcgcctatctgaaaaaaaaaaacagcatagcaagttgatgtatgttcactgaatatgaaacaaggcaatttattttatggtggtaaatatttcaaggctagaaaagctgattgattaacttactaggtcatatgttactgatttgctgatcctttttcctagcagagtaagctggtcaagcatttgaactgcatctcgaatggaaccgttggccttgcgagcaataagctccagtgcttcggcctcgaactccataccttcatttatgcaaatcctactcaatcggagggcgatctctgcttcgtctaccttgcaaaacctgtagctctggcaccatccaactgaattacttggcagtttatcaatgtcagatgtgatcatcacaaagattgagctgtcagggatgccttcaaggctactgtagacagagtaccatccctccttatccatgtgttggcaatcatccacaataagaaccttgaagtgcgaagaagcaggaacttcacaggcattcctcagcaaggcagcaactctagatttgcaatccagtttagaagcatcaatctctatcacactgctactgtttcctgagaatatggccatgcattcctcacagtgcccacaaggctggttcccacctgaagagtggcaattcagtgatgcggcaaatattctagctgcagatgtctttcctatgccatgtggaccatggaagagatagattggagcaagttttcctttcaaaacagcacttgaaagagactgagcaacaacattttgtccagccagctcagagaaagccttgggccggtacttttgaagcaaacttctcgcgctttcttgaaatgtagctccctccctccgacccaattgctctccttcaatcatcaaagaggatgccctgtcctttgttgcccttgacatccccgagatcaccgaggagcaggtctggttatgaagcgccgccttgaccctcgcattggccttgatgatgttgatcggcgagttcaccagccgaccagacctcgcgctgtccccaaactcctccctcctcctctggagatgatcatacatgttgtaactaaagctgtgcctaccataattgctcccctccaggtcatcttcctcgagagaacaaccctcccagatggtcttcttcgccgagaacttggccagcgagttggtctcagggtccctcagagatctggacctcatgacggccagtagagccctcgaaatcgggatgtcaacggagtgcctcctcccctcaatcatcttgcaaggccccaatgaactatgctgcaatgcagataaataacgaggaacaattcagtcttcagtagagaaaggatgtgcaattaggcattgcacagtcaacacaatcttcaaacatggtgcacactccacaaaaaaactaatcttttttcgatcttgtatgcaaggagcagagaaaccatcaacgcaaaatctgcagaaacaatcgctacctgcggttttacctaaccagcattgccatgcaaacaacttgccgagataggcggagccaagaaaaaaattgcagattgtagatggaagtcaatcgggcgcctggatgcaaacatccatagaaaaaccttgcaacttgcaaaggagagcataataaaactcaaatgcaaaatgcatccaagaacatgaaaaaaaaagaaacaaaagaaatggagaatttcaaggcctacatagtacataccgaacgatctcgcaggcggtacaaaaacctcgcaaaagggggcaaaagaagaagagaggaaacgacgcacaattccccatagaggaattaacctcaaagaacagatagaaccaaaaaaacaaaaagaaaattggaaacattttcgcagctccagacgacgtggcacgcaggccgaagaatccaggagaaaggacaaacaaacaaacaccaccgaccgagagcagcaagaacggaagagaaagatggggattcggaaccgaagcatttacctcccccccaaacacgaacgacaaccacaacgacgacgacgcaagacaacaacgccgcggcttttccgcacctccacctccaccgccacggccgcgcgccgctccctccctcctccgttcaccaccaccaccaccacattaatagcgcgagcacggcatggagactcgaggagagagagagcgagaggagcaagtgagcgaagcagcaggaggggggactaggcgagactagactagagtggcagagacgtaaatacgcgccaaggtgaggggtagttttgccccgggaggcgcggggaggaggcgggcttaggggtggatatcaagctggctcggctcggtctagctcgttaggataacgagctagattaccggctcggctcggctcgtgtgtcagctcgagccagctcgtttagctcgtgagccacaacaaggaaaaagagtagtggcgtgtgcagtgggaggaggaagagggcaaatgctcacaaaccaacagatttcaaaggaaaatggatatgatgatatatcactagcttgcactgatcgattactgcaaaacaaatgcaattcagtggccggattaaaccgctactgcaacagaaatcaaggggcattccagaactgaaaaatgcaaatgaggaatcaataaaaatacgcaaagagataatcatcttgaaagagatgcacaaatgatggcttgggtggtctcgttcaccctcctgactcctgctccctcggggtgtagttgcactgatgccgacgaagccacggaggcgagggctggcagcggggccgattgaggcgagggttggcgtcactatggcctacgagcaatctacacgcgacctcgtcggcgggcggcgcaaggcgccgtgagacgcggggagcgagcggcgctctcgtcgcgcggcggcgtgaggagcggagagcaagcggcgctagagtagaaaggggatctgggattcacagaatcacagtgcgtagacaagtcacgtgcgtggttttccattagggctagtgctattttttttcttgatgggccagctcgaccgcttcatattatctctttggactattgggcagctgggatctttggctgttgggcttggctcgttaggctcgtgagcagctcacgagccagctcgagctggctcgttataacaaacgagctaaaaccctagctcggctcgttgacaaatttaaacgagccgagccgagctaggcacgagtcgaacgagttatcgagccacgagttttctgtccaggccgagggaggagggagaagaagaggaggccacgatggcacccacccgtaaatacgcgggggattcgaggggcgtttccgtcatttcgtggctccgtccgtggcacaaccccgaaccgtaaaacggacgggacagcgtggagcggcggtggcgcgggtacaggttgatgacaggtgggccccgggcccacctgtcagtgagagggcgacgtgggtggggggagacgttgcgaagggcgtggcggtgtcgtcagatttactgttgcggcatgcgaggccccgtgaccccaccgctgctgctttttttttttactgatttttttcatctcttgccacctgtgctgcaataatttgttttttttcttttttttattttgttgtgattctcttttatcctctgtcatagaattttggcaacaggatgactaaaaagataggactattgtcgtgtagcctgaggtgtgatttaacttttttgactcggaaaatgtttgtcattaacccatagtacaagtttgtatcagggtggtaggagtactagtacaagttattagttgatcaaattacacgtcatttgattatgtgtgagctttgaaaatctgtttcatgcttttatatgtatactaaactctaaaactggccttaatatgttcagtaatcagtcgtgtactaaaaatttgtcaggagtatggtttagaagatttgtggcttttattcaaaacatatagctagaggcaaattacttgtgtttgttgccgcatgccaacaatgctttcttgctatattagtttatcagtatgataacaacattgtcagatataattaattaatgtgttctgaattttcttatatcctttctcagttctcaccgatataaaagcagctggcaatcgatgtggttttgagcagggaaactactccaacaccataatctgtttctctcttcttttaacaaggattcggtagaaatgatccacaaggggggggggaccaagactagttggttccggcgacttgtttggtgattttctaatcattgtttagtgattgatcaatggtccaacatgcatatggcacagtcttcgaatccaatcaactcaagcatgcatttgtatttgtcgctttattaacttgtaggacagaacgatagcctcttgatctttgcatcattcaagagttgatcgatcgggttatcatcatcagaaacatggccggccctgctcatcatgcatttctccaacttaatcttttcatttgtaactgaggattaattatccactgtaaaaatgtttgtgtggctaataaacagtcaaacagcatttcgaagttattttaagtattcatactttataactttaactatgttatctgcacttggagtggatgatacgtctctaatcataatcaaatcagtagtagtagatagtatcataatgtgtagagaggtatagccgtatagggggtaagacaaacagtgtagcttgcggtgacagtaggtcgtctcgtctgaaaagattcgaccttaattagtttgactcttggtttagcagtttagcttacgctggagctaagacaacaggggcaaacagacacagctgacaaccgagcccaacgttgaaaaggctatcataaattcataattatgctagacacattagagatttgtttactcacctggttagcttattctaatcatcattcgacacccacatgggcacaatagtaaaaaaaattatactaagcaaactggtacagttgttctaattgcaaaacaatgtaaaaaaaagtacagtataaccaacactgttctctcttcttcttcctcttcatgtaaaaagagttgcacacgctgcaatcagccgtagaggagcctgtgctgtctccagtcgcctgaattttctggaggaggcagacaagacgggctcatttccatgcttgtgttgcattgctgcacgatcttcctgtccatgagattgtgacttgtaatggcgaaatcttcagaaaaattctccattgaattgccaccgaatgtccatgaaccctaggtgaagtacgagcggcagtatcacagctctggctggctagctagatctcgtttaagctggcaatggaaggtactactgtactgtcagtgaagtgatattaacgcagatacagtgaccccatcgctgggacaggatcttcttcatggtgcaggagtaattaaacgcctcttcaacggggttcttgattttacctgtctggtgcaggacacggtactacatgtacaccaacttcttctgaaccgagagaggtttcaatgtaacggatggacccccaccacacgatctcttattgcacaaccagaatccttctttagaggacatgaactgataaaaggggaacttgaatagtagtaatatgtttttttcagtactaaaattatgtcttgaacataggcctcactcccgcgagggcggcacgggtggtgctaccgtcgccgcccatctccccctccctctgccttgccatcgctagagcgagcgggcgacaagacgtgtagcgtgctaagatagcaacggtggggctctcaactatagatataggggctttggataatagggggcggtgccgcggcgtgccatcccagctcacaaatcacgatggcggtgttaggtgcaagtgacaacttgacggtgagagcaatgcgtcgtcgaggttgtgcagtgattagcaacccattgaacgaggtgcaggtgcaaccagggaagcgaggcgacaaggtgtggccttgaaggtaaggtggccggtgcttcgtgggccctactggcaattgatggttgcagcctcctcccttcacgatggtggtgatggtgggcatccatcatccacaacgggtgcacaacaaggtacgaaggaggacaggagacaacaacgtgtcagatcccatgccagggaagggtgagtgcacccaacctttgtgatgatctagggtacaaaggtttggggcggcggcgatatgtcacgtccagaaatttagcccaaatttccagactatttttgtgtattaaatccctgtccaggaccagccagggtacacaaaacaacaagtaataaacagttccaaacgtaaataaagcgtaaaatatttacagaagaggcacttagtcctcacaccgaaagagaacgacagcagcggaaagaggcgatcctagcggggcttcaactccactcctcaggcaaaactcaactgggtctgagccttggtcttctaacttcgtcttcagctcagaagcactacacttctgaaaagggggaataatagcaaggctgagtacaaccaccgtactcagcaagccacaccaaagatgcagacgtgcaaggggatacaaggatggcttgtggctatttgcataaaggcgattgtaaagtattttattaagcaaaacggtaaaactgttgagtaattaaagtaatattaaatctccactgatcaacgctacaccacgttgaacaggcccaaccaacccacctgaactacagtgcattgggtcgatttattaagtgtgagactaatcacggtgattctggtcgatcgcccataaccgcgggcacggctattcgaatagttttactctggccagaggtgcacaactgtacccacaagacacaatccaccggcatgtcactgtgcccggccggacacgtcaccatgtcgagtgattatgacaagacccttcatataccccactctgaccaagcataccacacctcaggtttcacccccgcccctagcaggcagcgggcagtcccctctcgtgcctaggtgaatccggaagcgacagaggcagtcgcagggcccgccccgctccatcacgcccatccttgcctggatgcgtcagccagagaaaagctatacttcaagtcaggcagttaccctttcccgcttgtggcaagcgttgtatgtcttccagtgcatcccgcgaaccagtccttaattgccatgggtgcgaccagcaaaaccatgcacccacagcccaccattcagtcgcattttagttggataattacgaccatgaaacatagccaaatgtctcgagcacgcagcttgttctgatactaacaaggtctaatactgcaattatcccatcgactgagctagtggtaattaagcatggctaagcatatagttctagctagatcaacataagtgacacaagctagtcgaattatcacccacggttgacaaaggacaggtatcaagtaaacatggcacaagcgagcagataggtaattcccagatcccatgtaactagcaagacatgcattatttgcaaatggtaaaacacttgtaaattaggatcaaaatgctcaaggggaatgtgtgatttgccttgcttcttcaaacaatcttctgaactcttatcctcgcgaccgcgatcttcggaatcgacggaaactacacgctggcatgcaaaacgaggaaaaaccctaataaaaaccaagtaaacagtacaaaaaaagtaaacaaacatgtagagctacattttagatgaattttgcaagttgaacggctcaattcggagttcatatgaattagatatgaattttagaagtttttagccgtttaaatgaatttctagaattaaactcgatttattgcgcaattattaattattttctcaagggaatggttgctgctgacgtcatcaaaagggggagggcggcgctggcaagcgggccccaccggtcagcggcacaagggcaccagtccaccgtggaccgggaccaccgagtcggtccaccgtcggtccatgggatccgacggcccggatcggccctagccgatcgggcggccacggggcggcgcagccgagacacaggcactgctcaggccggcccgaccgagcgacggcgcgcggcaacgcggccaccggcgacggcgcggggggcggcggcgcatgcggacggcggcggcgcacgctagggagcggcggcgcggcgcgatgcggcaaggtgaggcggcagccgtgtaagt

SEQ ID NO: 5426 - DNA, 6498 bp, Oryza sativa
tataatgtgagcttcctatttgatctttattgattatgtgcatatgtgttccttcatatccatatgtatgcacatcttgagggggagcttattctatattttgtttattataatatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtcggttatttcccgataatgagatgtggaagacatgcattcttttgtgatggaccttaatcatgacaaggatgaaatgcatggagataaaatgatatgtaccacttcttatctcctactttttgataggttcatatatatgatttccatgttattgatatataagtgtgagactaatgtttactcgaatgttatcttatttagtctcatttacattgagaacatacatatgccttctctatatgtataagataaacccccattggtcattctctaattatacatacacttgcatctcttgtatatttatttgtatgcatatatttagagggagcaaatcctatacatttattgtgcatgttctagatccatgttgttcacctattatttatactggatctttgcacttgagcttgcatacgagtatatgacacttgtgatgttaatgaatactcaacaaacatatacatatctttcatatgcaaccggttggtcatcaagtgaaggatgacaaccgatttgttgagactaatgttctcctttgaggtgtgaaaaggaataggtcccattacgatgaggctaatgaatgacaccatggtttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggcgcaaggcaaaggtataatgtagctaagaatgttttcttagtattttcccggtcttggtgtttggtgtagaccggatttgctagataggcgccgtactatcaagagtggtctatgaagcgagcttgtggatgatcttgtgccatattagttcatatgcatgtaggtgcattttgtgggcttgtctaaccaagtgtagaagtgggcatgtccaataggagtgagtgacatcttgtgggtatgtccggtggatatcctttggagtgtgagccatttatccttgacttaagttgtgtttcttggatggatttttcatgggttggatggccctttgaataagctttccatagagtccaagaacgccaaattctgagacccgagtcaagagatatcgccggtttactaacggtcggttgagctgaaaagtgacctgcggtctgaccgtgggccttaggccggtctgaccggccggcgtggtaaggccagtatgaccggccccactggtctgttgcactggtctagtttttggtggcgatacagagccgccagagccgcaaccggtcagaccgagccgacggcggtctgaccgagccgtggacggtctgaccaaccactacactgcggtcagaccggccaggttgagtgggctcaatgattgccctgtaacggctagaagtagtccggtctgaccggcctcacaacggtggtctgaccggcagagcacaaagttggggatttcggttccaacggctagttttggtggttgggggtatatatacccactccccagcagcaagggtaaggttttggcactccattgcattatcttgaacccttgcaagagctctcacacccttgtacacttagtttatctagtgaggtgttagagagtgagttaagccaatccaagtgcattgcttgattgttatagctagtgtggcacttgatcatcctcggcaagcatcctagacttgttactcttgtaggttgccgcctcctagacggcttgtggaggtgttgcccggtgacctctccgaggagattgtggaggaggcccggcaccgtttatgagtgatttggagttcaccaccttcggagtgaaggaagaactaccccgagtgatcgaggcttgggtagtcctctccgtgggccggctcccgccttgcccaccccttgacaaagggggcgtgcggtggcttcgtggttgagcggtggagttgggctcgcctgtcacgcccggaatttctatccaaaattccaaacgcttacatgtgtgtgaaccctcgtccaggaatcagccgaggcacacaataacaaattgataatagagtacaattattactctaattaataggcgaataaaatgtcattacagaggtagatagttcctctcaatcaataaagatctaagcaacggaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcataatagggttccatttgcataaacagcatttagcaaacatttcagaatttaataaaacagttaagtaaaaattaaacaatattaatccaacgctatacaacataccctgttgtataggcccaaccattctggacaaccacacccggctgtacagatctatctccaaaccaggaatataccattccaaaccaggagctaaacaaattattaccagttatagcatcttttattatgatgagaggtttgagactaatcacgaaagacattgttagacccgcccataaccgcggtcacggctattcgaatagttttactctgatcagaggtgtaccactgtacccacaagacacagctccacatcatgtcaccatgtgccttaataccaccacggtacctcggaaaggagctgtgacaataccccttacataacacaatccaccgcagtgcaccattcctggatcataatcacccccttataaacaaggcatggactccccagcgacccctgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgccatgagcacgactctcaaaaccatgtgctcacaacccaccattatcaggttttagttagcacattaattaattaaccaatcatgattgtccgtcgtgaactatcattaagccatctttaaataatagtgaatcataagttatcccaatagtgtgctaatgtttctaagcatggctaagcaatcacatctaatatctagctgaaccaatatataaagcccaactagtcaagttataataacccaaggtatcaaggaataaaggaaccaataacaaaaagggctataacaaacaataggttaattccacccaatgacattcgaaaataaatgcaatagttgaatagaaacagtagctttaaacgggatcaatacgctcaaagggttgtttgggatctgggtgacttgccttgctggccttgaaactcttcaaattcttctcctgcgaaaacggactctctggaaacgtcggaatctaaacagaaaaaagcaaaaacaccaaaacagcacataaacaagcacgaacagtaatgtggatatttttaacatgtagatctcaattttagaaaaatttagagacttgaaccaactaaatccgagctaagatgaattagttatgaatttttgaagatttaatcggattaaaacacttatatggattttaattgaattatgacgcaataatgaattatttttgaaaaggaaaacggggtttattgtgtcagcggctagggtttgcggtggaccgggtgcacggcggcggttcacgggaacggacggccgagatcgatccatccaaaacggacggccgagatcgagtggtccacgaccggctcacggcaaacggccacgatgacgtcagcggtgacgtcaccaccggcggcggctcgggcggcgcaagcgcacttgctcgccggcgaacgacggcgcggcggcgcgaacggaggacacccacgggtagcggacggcacggcgaactcaccggcgaccaaagcgacggcggaagatcaacggacggcgacggcgtcgaggttgaaacggcggagaagatcgggtcgacggcggcgacgggtcttcagcgacggcgaaggggcagacgaggacggcgacgcgacagcgaccacgaaggcgacctccccgagcgacgacgacgaccggaacggcggcggcgcatggctggagcggcggcgacgacggcggctcgaggttacacggcgctagggcgcttccgacggcgagaggcgaaaacaagggtggcggcgggtagaggagacaccggggatccttttaaagggtctaggaggcggtggcaaaggcccacggcggccggcgacgagaaagaaacttcggggtttgaaggaaagagaccgatccgattcgacctcgaatccacaaatttccaaagcgagatagacgatgattccaaaagagaaaaggtagaggagatcccgaagattgtttcctctcaattgatttcaccggaaacggaaaggatcggccgaatttggaaggagacggcggcggcttgcgctagggtttcgggcggcggcggccggaggtagacgacgacctgacaagcgggcctcacctgtcagcgagcgagggcgcgcgcgcggctgcggcggactgggccgacttgggccggggagagagaaagagggttttgggccgactttcggcccaaagccaaaagagacttttaaaaacatttttctatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttaggatttttagggtgtgacatcgcctcaacggggattaggaaaccggcaagtttccgaaccttggtgaaaaattccttgtctcttgtctcatttatttgttgcatttacatttgtgctatttatattcatagagacatatttaagcccatatcacttaggtttgcaaaacttaacttagttgcttagttaaccttgcacctcaccttccctagcaacttaggttagttttgtttaagtgccattaagttttaaaaccgcctattcaccccccctctagtcggcctccttgatcctacaagccggctgcccggcacagccagcagcggcacggcgcggagcacggcggcggcgacccggtcgaacggccaccggcggcgacggcgcgtcacgggcaggcccgggaggcggccagcgaaggggaggaagagggagagggagaggagtgctcaccgagaggtcaaacagcggaaggaggcggccgacagcgagcaaggtgacggcggacgcctcgagatgacggtgggatggcgctccggcgattcccggcgaagaccacagcgtggccaagaaccggcaggagctggggaaggtatagaagggagctggagtgagggagatgacgcggaacgacggcaaaaaggcggccggaacccggcgggaaaggccgaactcaccttgagcagaggggaggtattttcggcggcgattcgcgaagacagaggggtggccgacgtgcggctcgacaccacggagacgtagggggagtcggcacgaccgcatgtggctccgaataccaccgccgaacggctggtgtctcagcagttaacgcggctcgggtgtggtggtccaatgacggttccagtggtggagggggaaaatggatcggaggccagggtggagctcggcgggtctattccggcggtggcgacggtgcttatagcgtctaggagggccgtccggagctcgtcggtgagtggtgtagagagggagcgcggtgggagggtggttccgacgatggaatggggaaacggagcgggggccgaggtgtggcaccgtgcggcggagcctacggcggtggctacgcggcgtggcgaccactagggcgaccgccgccgatggggtgcggcggtgtcccggtggtttccgggcacgggagggctcgggagagaggggaaaagagagaaggaggtgcgggggatcgttttatagagctcgggaggtggaaatcgtggccgggagagggggatc

SEQ ID NO: 5427 - DNA, 3504 bp, Oryza sativa
tttccttttattttatttgattatatgaactttgtattattataattatttcttgagctccgaaaattcacggaaaaatctggagagtatttgaaggcacaaagaatattacaaaatattcccggccaatgatttttaaaaggaaatttctaattccctcaataattcacttgattaaattgatttaacttttattaaatttctagaaaatacattatttaaacgatttttaatcccgaacgaaaatcggggcatcacacgatctgtgattggtgatggaccagatctaatgtgggtaggatgggtatgctcggccttgtaatgatctggcccatgacgagaacaacattgagggttcgtgaggtcggtggcagtaggaccaatccacgacagcgagggacatgtgtgctcgcccttttgtgacggttttggcttgtgcggcgatcctaccatgcaaaggtgagataaggctagccggtggaggggcgtttgtgcaagggttcttcacactagtggtagttggatgctggtggggtaatgcagttgcgattgcaggggtgtataggttgcaggtaaaagcgttgtccaataaattgtaggctagcaacggtaacactttcaagtgctgtgatccctctagaatacgtttgccgaggagcctcgctctccccttggtaggacactccaagtgaaaaccatgtccagatttcttaggcgggcgacaacgcattatggcgtcacatcctcgttgaaggtgtcatctagaaggttctgtttttggctttctaccttaaacagttggggcaatgcttatggatgacggtaggtttgtacgaggaatgagtactgagtagatctttcttgttgcttgccctatacctctgcaacccctctcggaccactaatttcagttgtttgaaggtgttgtcgggtggttaaaatgtggatgtggtggtggcatccgtcggtgtggcactagacatttggtttgtgtaggagctacagcatgtggtggtggttttgtttttctattttcgttattaactcccataattttagtcttatagtagtaattttgtactagtactatattaatatgaaacatcacagtggatggtgttgtttgtttcaaaaatatcaaaataaaatgtcttgaacgcaagggaccttttgttttgaattgttgaacaacaacaatttactcctaactaggaagaaagcccgcgcagatgcgcgggcagttttatgaagacaatttttaaaaaaggtaatatctcaccatttataagccgagaaatatattgcatactttaatatatttaagtaataaggttatctcctagattaaataaaatcactttgcctctggttacatacaaattttcttgttgtcacttcaacctattatcactgtttaaaagccaagtatctattcatagatgaactatgtaatgtatcaataaaataagcctaatacatcattaatacattgaaatatccactacacgtaagtgtttcgtgcctcaccaattttcaaaactatatataaatattgtaaaaataccacttgtacaaattaatagaataacatcaagttatacataaatgcttctctaatgcgtgaagccgattgtagtggcgagactttctctgtctattgccttgaaacatgggtcccatatcgatgtagttgtgcacctccagactaacctggagtacaattttaatgcctaatttactatcacatccttatcgagttgtgcatcggtaagtagtaagttgagcactattggtgactgtggtctccactgggaccgccttaactcccatatgtacgtccatgttatacttatagcaacgtagcaaactatgttattcatgcttatgcccttcatgaaaggaaaaagagaagatggatgtgatcaaaagaatgttttttttttatgttttgagagtagattcatggtatagagtagacaccacgtgcttatggtgttaaacattatgcaatttgaaaatgagcgaagttgtaattcgacggtactaaaagagaagatggagatgatcaaaagatttttttttttaagttttgagtagattcctggtatagagtagacaccatgtgtgtttatggtgttaaacatttatattttgacaaacatctatagtttagcgcttggtttattttcaatacttattgttgataatcacatgagacacctttactaattcgaagaatatatttatttttttcaaatttattaataataactaatatgtgggagtatatgggagttttttattttttttgtatgatactatatacgtatattttttttggttctatcttttttgacccgatggctttattcttttaccgtacgtatgtaggtttcattgttccttttcattctaacgtaccgacttttttttttggcgaacctattctctctcgtatgtataggtggaaagtctgagtattagagatataaatatctaatctaatgatctaaataatggatccatctatttaagtgaaaatcaacggtatagatatagatataatctaatggtctaaaataacgggtccacccatttaaatgaaaatcgacggtgagattaaatagtaccacgtggcggtttaggagcgtttataagaatgccacgtatcgtcttgagagtgtttgtaggtcgttcaatagacttttagtatatgatagatagatagatagatggcgtaaggatatcaagatcgagaatggccttgtaaaatacgggcctttagtgggctaggagcttatggtggagtatagcaatatgggcttctgatacaaggccctggagctcgcttggtgcttaatcatccggctatgctatataagcaagctctttgatctaaaaaccagcttgagaaagaattatttgcattttagccggtcatgttttggtactatactagtataatttgaacaaaaatacacatttatatttgaactctctaggctattcccctattacatgtagcatgacatcagagtcaaaacagatacgcactataaatttagtttcatcatatgcaacaaatgacattatacatagcaatgacatcagagttaaaatgaagagaacaaaaagaaaaaaaattcaaataacctccccaaaaatcaaatccaaatcaactggctctctagaaagcaaccctgttccttaagcaacttccctttgtcttcttcccagcggcccataagtagtccacatctccactctcttgaccacgaaacggcccaacacccaaaacccccgggcccacatgtcatcctctcccccaaccctagcgccaccggcattccgatccctcctacccctggccccacatgtcagtgacccgaaaacgcctcagggtatatatacccagctgtgcctaagccgggcacacgccctctgaccccgatagaaagggaggaaaaaaaaaagagaaggcgaaaccccaaatccgccgcgatg

SEQ ID NO: 5428 - DNA, 2893 bp, Oryza sativa
  unsure (1)..(2893): unsure at all n locations
nnnnnnnnnnnnnnnnnnnnnnnnnnnnnnnnnnnnnnnnnnnnnnnnncttgttccccattcatcgggtgatgaattgtgctctggtgattgtgaaatggtttgcttgttgattgatgcgtagattgatctgacctggatgcttgtttaggcgatgcttgtgtggaaatgattttcattaggacgatagtttatttttccgatactctgatgtggtcatgaattacgtgatcctcttatgtgacgatccaatatttgtttggtagctagtagaaacttggtaaagcggtttggatgatcataagtgaatacagtgtggtgatgaaatgtgttaaacacgtgtgtggttctatagtcataactgactaggcgcattcaaggcattcgctgccccacaagtattctgccttttgtgcctgacctactgatcagaaatttgatatccaaccaaggaatagtttgcaagcctcactgtggtaaaactcatacttggatagtggtagtgtttgattgctttccgtagtttccacctctgctagcatacagcggctgatgatttagctgatctacgacgttaaatacttttggtgtgcattcctttggcacttatttgccttaacttgaattatagttgtctaatatgattattggttttttatgtaagctttaggatgttgctaagtccatgacacgttcaccctttttaggcttccgctgttggggacgctaatcaaaccaaaacccaacatgttcatgcacatccaagctcgaggatatcacggggtatcggagaagagaaacttgctggatcacaaacgtagattgcttgcagcaaaatatgaactgaaaggaaagctttataaggctgtttgtagggaccctgatcttccagcagatatgcaggaccagtttcgctataagctgtccaagttgccaagaaatagctccatgacacgccttagaaaccgctgtatcttcacgggccgctcgcgcgctgtttacaagaaattccgcatgtctcgtattgtgttccggtcattggctaataagggtgaattgttgggtgttaagaaagcgtcttggtagatgctaacaaccagtagatcaaagcactagctctgcagtagtccagcacaataagtttgcctccatgcagtttttcagtgtttgcaacctgaaactatatttcaatcttatgaccagcagccaatctggcactctttcaattatttagttgaaccaatgtactgtactgtttttctgcctattgagcatttatgaagttaaaagttttggaccattctttttcccctgcccctatatatatggtatttttgaattcggagatactttttttaccatcaaggtgcgctcagtcatgataaatacctttacttttgacagtttacttgtagaattagttatacttactgataactgtttcgcagtatgtagattaatttgcttagctttgggttacttgaattctgttctatatgttattgctgtgcctatgtattgttgaaagttaataatcacacattctagcgaactctggtgcatgctactggttgctcttgcaatcgcattaaacatggaattttgttaattaaggcatttgacctgttgtgccatcagttcaagatgtagtgcttcataatttcaccgttcatgggcttaatgagtggatcctcccttgttttccctagatttcagcaacaaattcctttcctgttcctgctgagttcctgtttgatgtaacttgtttgttgatgttcaagtattaaatcttctagatgaataactcagttttcactgcctgattatatttgtaaagagaactagttaacatatcaatcttttagtgtctgatttggttcaggtcccctaattttgttcatattgtgcaattttgcctgattctatgtgcagttgtgaactgggttttgtattagatcatcttacgaattgaccggtttgcagcttggataatcattatagctgctgtctatatataatgatattattgtatttgattctatagtgtaaataagctaaggcaggtttttgttttgtctgatctaattttgtcatgaagcaaaaatcttaaacatgatctgatatgactggtctgttggtttaggccgtttgtcctgccccaatttttgcaaatgcccatacccttgtgattgctctgtcctatgaacatccattccctgtttcaggtggatacaggacagccgtgaccagttcactaaggagcgcctggattccatcaacgacgagttcaagctgtaccgctgccacaccatcaagaactgcacacacgcctgccccaagggcctcaacccagcgaagcacatcgacacaatcaagaagctccagctcgaggcctgagtgagcagtatatctctcttcatgagatgaaactctgtcgaaaaattgtaatcagccagcctcttgtttctctgcctttttagtccatcgcctgacgaataattgctggaacgcaggattcccttctgggcctccgatctgatgacttccatttccatcagatggagggagcattgtagggagtgaataatttgctaccgtattttacgttttgttctgtatctaattcggtttgttgttcaccgtccattccattatgtcgtgcggtttatgcatgaagtaattcatggattttacctttgtttttgtgatgttgaacatgcccttcatatttttaacccggaaatcaacaagcattctccgtaatctctggttagtgatcgggtttagccatatagtgaatcttaaattgaagcaaaacgaatcggatttggttcctgtgcagttcttggtattactgcaacttaggcggtcatattgtggctgtaggatgcaa

SEQ ID NO: 5429 - DNA, 5913 bp, Oryza sativa
  unsure (1)..(5913): unsure at all n locations
nnnnnnnnnnnnnnnnnnnnnnnnnnnnnnnnnnnnnnnnnnnnnnnnnnnnnnnagtacattctttttggtaaattggaaccatgccattataattttttaaagtttgagatatgccattgatatctcaatgacatataggacccacataagtcaatgacatgtgggtaaggatggtatatctcaaattttacaaaattataatagcatggttccaattttccctttgaacggaggtagtaccaatgctgaggaagaaatagggtctttctgctcgttcatcgctacaaccttgatgcctttgtcgtcacctagctgctcgcagaagcctaggatgcttggaaaatccttggaaatgaagatgtgatataccattggcatgttgattgcgccaagatgcaaaacagtacagctggcatgttgattgcgtctttctgatgattgatataccactgacccaacagcccaacagatatgattcactgacacaatgttggtgccaatccaatccccattgtaaaaccagctaaacaaagcgcaactgtgctctgtcgccttgatcatcacagaaagacaattaacatctactcctagtattttttttttaaaaaagaacacatcaagctacttatcgctgcaggcgagaacgtacagtaaatgaggtaagcaacagatgcaaatgctgaggcagggagcaacttttacatgacgggggttcttttctctgtttttacttgtgaagtaaaaaagggtctatgggggaagttaaaaatggaatgcaactaacaacagcaacgggtgtgtcagaggtgaaagatctagacacataagccaccacaacaaccacaagtaagaggggctcgctccgctacctacacgcgcaagcacaacgacaagcatcagaaaacgcaaatgaaaatcatcaacttggaatatcttggatgcagcaaatatcacggcatgtgccttcttgcttcgttgttcatcggtccggtccagcttgatgcttcctgctcactcataacattggttcaagctgaagtagcgacgccgaatgagggtagaagcaatccgctcttcttggcatgctccacatagaacaggaacttctccctggcatcaggaatatcgagagccagatcatcaagcccatccctcacccttgagaaccccttggtcatctggttgatggtgatgatcccttcaccaaagcacttctgcagcagaccgaggatcctgtcgttcttcttttccattgccatgacaagcgccttcttgaccacctcatgattgaagaacggcatgtgcagctcgcggatgcagttgcaagcttctcctacatcgcctccgctctcgtactcctccagaagctttgctatcttgtcctttgtgtcctccacaacccatcctgtcccaccgccccagcatctcagaagcctctctcctgcatggcgggcagtggcaagggagcgcgccatgttcaatgtttcagccccgctgcagtttggtggaagcttgccgcttatctcatctaagttcagaggcgcaagcacatcatcaatcactgctctggctaggaacagtcccagctcatctgaggcatccaatatatcaagtgcggtatcttctgcagattcaagaagcattatgaaacccttgacaatgtcttctgttgagaaccattccatgcttaatgaggatagaagaattgaagccatctctttctccctgtttttgcggtccatagcaattgttatnnnnnnnnnnnnnnnnnnnnnnnnnnnnnnnnnnnnnnnnctattacctgacaaggggtctgaaccattataatccttgccttttgtggggtctgaaccattataatccttgccttttgtctgcttgatgtcgtactacatagatactcgtttcaacgtacccaaatactcaactcatccggtccatgagtaccactcgtcgataattatgcgacttaatttcccgcagcatcatgacggggtatttatctagttaaactaaatttcttgtgaattaaaaactgctacagagtagggggaaaagaaaaataaattacagtacctagacggtcaaggtcaaagcatcgcatgcccttgcggctttgactcttggcttggaggaagacgcctgaaagccagtgaggctgagcagcaaggctgcctggctgcgtcgtcacacgccacgatgcgtcctcgtattccccatctccctcgtcccgcgagactacggccactactcctacgagagtacgagtacggaggccgcccttgagttttcctctcactgagaggggttgaactgtaaaacatgtgttgtacagtgaaacattttgacttttacctccttgttttgtttgggtgtatttatgtcctgtttagttcagactaaacttccctcaaacctttaacttttcatcacatcacatcacatctaaaacttttctactcacataaactcctaactttttttccaaactaacaactttccctaaacttctccccaatttcagaaactaaacacagccttagttcacgccaaaattaaaagtttgattgaaattgaaacgatgtgatggaaaagttggaagtttgtgtctatagaaaagttttgatctgataaaaaagttgaaagtttaaagaaaaagtttggaagtaaactcggcctttgtttgacccttctggccatctatcggatcgccgtgcccttgccttgcctgtatggacgcattgtcgtagtactgccttcgtgcagtgcagatcacatatatgcgccgtgatgtgtcggccgggatggcccaccacgtcagcatctgcacgttttgcttcatcatactgatagtacaggattacaggcacagcttagcagctactcctactaatagagagagaaagagaaagagaaagaggaacaaattttggagctagtaaaattgaataaattttggagcaaggtgaaacaaacactggataaaaaatatagtaaatacatatatgtcagaaagaaaaaaatagctgaagtcaaattgtactatcagaacatataatagttgtgttccatgtcaagctcgaaaataatttaggatactcacaagaaaataaacgatcgtctacgagtaaacatcattttcatgtggattcacttaaaacggcgttcttctatatctatacaagttcaccaaactaaggatcgacattgaacacataacagtcaaagacacagacatgatcgactatgctaacttccattcgagatctataatttcttaaaagataatttcataacataaaacagagtaatattctagagtaaaataggagctgatgactgatagtacagatccaacggcgatgacgtgaacatccaccctaatccatcacaaaacccccgtgattcccataaaaatcctcctctccttttttcttcctccgaccaccccaccacatcgagtacggcgggggaaaaggcgacaccgcaatccggccgcccaatggcgcgccgccacgtcaccccgactcgccacgtcagcaagggatcacggaaaagcggagagatccccctcactttccctccaaatagcttggctcgctgcttctcttctcccgcgctttttttgcagcgaggtccctcaggttgcgtggtatttgcgttggttgggaggggggcaatggcgagcggcggcgcgcggcggaggaagggtcgccggggagggagggggaatgtgaagaggaggaccaagtatctgagtcttagtcggttcttgattaagaaggaggaggaggaggaggtggtggtggtggcggtgaggtcgccggagttggtgcccaaggatgaggcgccgtcgtcgccggaggacggtggggatggaggtgaggatgaggaggaaaagccgcagatggagccgttcgcgctgcatcctgagccgtccacgctgttcgcggcggcgccgtcgctcaccgacatcctcggcgcctccgctggcggcggcggcggtggcgggggcgagtcgtcgtccgcggcctcgccgggcgtttctggcgggaaggagctctccggcgaggaggatgacctggcgcggcgcgcgctacgggggcgggagcggtgggtgtactgtagcagctcgtccccgagcgcgacgaccaccaccaccaccacgacgtcgtcctcgtgctcctccgcggcgagcacgggcgcctcaagcggcggcgccgcggcgcggtcgctgctgctgaagctcgactacgaggagatcctcgccgcctggccgggccgcggctcgctctacatcggcggcgccgccgccgccaccgccggtggcacggacaacgccgcggcggagctggagctcgactccgtaagcgccccactcgccccactcttcttggacacgccccgtggtgacactgacaccggcggcgcatgctcgtgcaggtgttcgtcgaggtgtcggcgtcgcctgagcccgcggcggcggcggcggcatggagcgtgtcggagccggcggcgagggcggagaaggtgaggcggtacaaggagaagcggcaggggcggctgttcgcgaagcggatccggtacgaggttcgccggctcaatgccgtcaagcggccgcgcctgaaggtgaccaacttatctcaacctgaactagttgctgcatgcttcataagttcagaaaaattcttacctgaactgagctgaactggatttgctcatttattgattcttcagtaattgtctccagtcccataaactgtaaaagacttgtactttgtagtgtaaatgattcatcttgtcatcttggatttggcatggaccagcattatcattccgaatcagtttagtctaactggttggattcagtttattatcttcaggaattactgaatactgaataaggaatgtaagcatggaactttggtagggactaggaatcgaacgattaattaacttggaggcaacaggattagattctacttcttagtagatgtaagctgctgaagtgtgggtttcagaccttattgtataggctaatttatttctaatatctgaaaaaaataggttaggcatttccactatatccttttttagttagctctcatgatatatttctgtttttttgtctgaaattccttaataaagcttcagttgtctgctaattgcttatcagaagattagtacacttcaggcacactctgagcaaagccaatggatcatacatagtattgaacttctagtattaggtgataactgaactgaaaaacatgatgaattcacacatccgtggctggacatgttgatctttcactttctgaactagaaagcatcaaaatgcactttatggtttcactttctagctgatagaagaatctcttatgtaaaatttatgttcattgatataactgtgtgtccgcaaaccgacaaactaagaacttaacagtgttgattcatgaattgaaacctgctagactttgcatcctggaagtgcaagaaccatcttctacccatagtccatacatttcttttacttgatgaaactctgtcctgatgaaaccttttggcatttcttgcatcgctgcactgcagggccgtttcataaaggagaaggaaggcgccgcaatcacatagagaaagccagctccagctgcttacatagccttccctgctctctccaatgccatggtggatgcatcattatgcatctctccatcgcttcttcgcgtgtacatgatctgttagttattttgtttagttctccagtcctcatcatgtccaaatcagttcttctgccctggggctgcaagttgtgagccttcaggtgcagagatgcagtgtggattatgtctcataggatgaaaataacagcaattcagttcagttcagccatgatgtgcccaactgttc

SEQ ID NO: 5430 - DNA, 1730 bp, Oryza sativa
ccagtcctcatcatgtccaaatcagttcttctgccttggggctgcaagttgtgagccttcaggtgcagagatcagtgtgatatgtctcataggatgaaaataacagcaattcagttcagttcagccatgatgtgcccaactgttcatcaacgatcagttcaacattttgtaatgtcttcaggtgctggttgtcgttgagagatttaatattggcttctccacaaaatagggcaaaatcatcttccattatttgtaaagaaccagtaatgccttatttggggaattcgagatttggacaggtaactgttgagtaccaaataatcggtgaaaatctagaaaactgggattgttatcccttgacttctagtttattttttaaaaaattttataactatatattcttaaaatttaaataggaatctatttagggagctagagattctttaaaaacctaacagaaactcttcaaacagaaccaataaactgacagaaactcttcaaacagaacgcaatcgaagggaattcatcaagggcaagagatgtcaggatcagaatcgtctaaccagtgcacagttcaactgatctgctccgtttaatcatcctggaaatggactgtattagcggagtaatagtattagttggtgtaatttttctgaagaaattactgatgatactgtagtatgcagctggagcaaatgcttccggtggcggtggagccgttgcatgcaccgttctgccgccgctgcaagtccagtgtcagctcacgtgagtgactcatggccccacctgtcagcgtgcatcggtactcagtgtgttgtccttttgcttgtggctgccaggtgggccccactggcaggcggtttggccgtgcgtggggagcagcatccgtggtcaaacttatgctgttcccagtaaaactgtaaaaaggtggtgtaaccaacagctttcgacctgttcactttgacgtaaaaaaaacattaccaatttttggtatagttgttaaaaattgtcaaaattttggcagtatttcttatatagttataaaaatttgacaataaactaaatagccattttttaaacaactttatcaaaatttggtaagattgaaaatggcaccaaagtgaacaggtacttcgtgtcgggactcggggtggtaaaagaaaaaagcgtgagatcagacggtgaatatcgaacggtggggagagagccgaggagaaatggacggttctcgttagcgttgttgtacagagcctcgcgagatgggctgggcctccgtggaatagtagaaggcccaaatggactaaacaaggccgctcatgtgaatacaagcacacggccttttttttaatttatgggcttttctgagagcccatcacttttaggacttggttagttcgcgaatagaaaatttttaggtgtcacatcgaacgtttgaccggatgttggaaggggttttagacacgaatgaaaatactaattccataactcgtctaaaaactgcgagacggatttttaagcctaattaattgtaacaccctgaaaattcgaccgacaaaatcaaaactctaaaaatacggattttcaaaaactttttaaattaattgcatcatgccgatcttattcgtctattttatctggatttgatctcgaagattattaatcgtgagtaaagaatagttaattaggagtaaaccgtaaaaacaaaattggtaaaatacatacaaattaaa

SEQ ID NO: 5431 - DNA, 5203 bp, Oryza sativa
cacctaaccctgtacacgtgggttgatacgtggagggggtcagggaagctcgaccccaagcgagggcggcctcctccctctagcttggagggggcagccgccgcgccaccccgggctcgacccccctcggggggagccacgtgggtttgggggcggcccaaccccaagctgggagggagcagccgccgcaacaccccgggctcgacccccctcggggagagccacgtgggtttgagggtggcctcctccctctagctgggtgggggtagccaccgctccaccccgggtttgatcccccctcgcggggagccacgtgggtttgagggcggcctcttccctctagacgtgatatctccgggcccatatcatcgacaatagtgtttttggttttgtattggtatatgagggatgtgcgaaaaatgaaattattttggtactgagggagtaaaatgctagtaggtcaatttggtattgagtttggattgacatgtttcctcagcccaattctcttcttcttattctactacttagttgacaacccagttctgctagcggcctacagccatctttttcattgctattgggcctacatatcacgagtacttactttacggcccagaatacggtagcccacaatctcctacagtctcaacctcagaatagtaaggcccgtcaaagattatgggcccccactacctgtcattgcgattgtaacacagtgaggcccaaaatgcagtcaatacggaggcccacgtcggacgggccacacacaccatccgtaccacactttttctcgggtttggtccccgctttttacagaaggtctagcacgtagaaataaaaacttacggcatgtttgctttgcggtcttaagttgtcacagtttgtcacgtatgattgaacaattagacaattgcttaggcagttacagttctagcaaaattccctccaaacaaacaagcctcacgcgttaatgactcagagagatatgacaagactcatggctgtgtcttatgacataaaccggatatgtaattcatttccattatctaaaaaaagagaaatatgacaagactagctacacatacatgcatattacatcattaatcatttttaaataatagaaatggattagatgtccgacatctgttataagacacacaatcacaagtttatattaaaaagagatgaaatataaaaacaaataaaaaagcttctacttatacttcacttacttataaagctcgttgattgaagtctgtgttgtagctagtttcaaatatgtagtttgttattatctcaattcttctctttcaactaagtacaaatatgtggcaactaatattagctttctttcaactattttttttccaaatttctactagcatttaagtgagaaataaactactccctccgtttcaaaatgtttgacaccgttgactttttagcacatgtttgaccgttcgtcttattaaaaaaaatgtaaaatatgtaaaactatgtgtgtacatgaaagtatatttaacaatgaatcaaatgatatgaaaagaataaatgattacttaaatttttttaataagatgaatggtcaaacacgtattaaaaagttaatggtgtaaaacattttaaaacggatggagtatgaaatagagtttaattttatacgtgtagtgagacttactgcatctctagcggtgagcacgtcgtacgtacaaaaaccgattatccaacattcatcacaaggcggcatatgcaaattacaagcatgttgcaggttgcacagggctggccgtacacttctactgctacctctgaattctcaggaccatccatgatcaaattgatcgagagacatgcaggttaatttctctgtgcccacatgtactctctgcagattcattcaggcccagacaaataatcccctttcctggtttcctccatattctcctcgataccaaaaccatccatccatgaatccatgtgagatgtgatcttggagcccccggttttggtatcctccagccgctgttagcctacagtttattgctcgagaattctggagcattcggatatcgggagtagattctgattgcatgttttgtaaatggttataattttatttaaaaaaccaacaagttacatattacattccacaaacatgcatgttaaaatttaacttctacaaattgcaacagaaaaaaagctatatgtagttaatgtatatttgtacaagttaaattcaaccttatatatatttgtatatcttgttgatttttttattttcttcatacttatttgaatgacatacaaataatgaggggatgtattagagtatagaataatgtccctacggctatcatttcagtatgcagcccatgtgtgcgtgtgtctgaaaaatcctaaataattcaggccaatttgcacacgcccagcaaacaattcaggctgctagctatagctagctagctgaccgtccaatcattgcaggatagatgccgtcgtcttcttggagagctccatgatcgagtggcagtagaatcccagtgcgagtgtcgttgatgcgagtggcagccatggtccatggttggtggagctgcctctcgagcgagcgagcttgctcactgtgcaatgtacaatgcactgtactgtgtcatagttgctgaacccagacattggcagctggtccaggttcgatcatctatatggatgcagctgcattatattcacgaccatgccacatatgtaggcacaactacataagaacttgtatggtccaatatattgagtacaaatgatttaatagtataaactactttattttttcacttaaaatttataagtttttttacacacacctgctatgtaacttatattatttaactggtaattggtcataaccaaagtacatagatttttttaaataatgattagaattgagcagcaatcgttcgactgcaatgcgtctctcatgcgcataaatgagatccagtgacggcatgagcatgtcccaattaaatcggattaactctcaaccacgaaattactcgaaagtgctttttaattttctatcctttttgcacatctatatactactagtatatagaggcagtatataccgtaaagttctctctctctttttatattgcatgaccatgcatgcgtccatgtgacatgtccagcttgccaacaaagaagctaggctactgcagtgatgctgatcgagtgatcatcgagctcacggctcacctataaataagcagctttgcctctcaccactctccacttcacttcacttcactcttcagatttcagacaaacacatacagcagcatcaccagctcagttaattgcaagcaagaataaacaagctcgatcgatcactgtgataatatggcggggaagctgtaccagctgatgtcgaggatgcacctggcgaggagccggtcgtcgtcgtcgtcggcggcgacggcggcggcggcggcggcggacgtgccgagggggcatttcgcggtgtacgtcggcgagaggcggaagcggttcgtgatcccgacggcttacctgaagcacccgtcgttcgtgctgctgctgaagcgggtggaggaggaattcggcttcgactgccaccgctgcggtggcctcaccatcccctgcgccaccgagggcgacttcgcctccttcgtcgccgaagccatcgccttcgacgaccaccaccaccactagctcgctgttaattagttaattagtagcttctagttaattagctagctatgacggctcggatttttgtgttctcttttcttgttgctgaggattaattggaatccttcttgctgatgagatcgttcgttgtactacttgtatgataacatcatttgatggaaagttgttgccaatttcgacccatgtccaagtaatttttcaagaatgtggggtcggagtccaattctccgaaccccatgtttcaacgtttgcccgaactaaatcggtgaaaaaaaaagaaaaaaacaatcagacagaatgatacggtcattaacctggatacatacatcattcctacaggatgggggaatagagtaattttcatctttcaggatgcagataatcgaatagggaacttagccctcaaataacctaatctgaaattcgcttcgacagagatttaaactcagaagcttggtatgctactcaggtcacttaccactaggctgcgtgcaatctagttggactcttctctgtacatggagaattaaacagacacagaaatccggattaatgggattatgtttcatttttttctctctcatcgtttaagaacatcatcgtttcagccatcctgaacattttgtcaggcatcgttggatctgcaagaacggaacagaaggttcagagtgaaaagaagtgttggtggggttcggagttttattctcgcgaaccccttttctcatcgtttttatgcactaagtcaatgcgaaaaattatgagaaatttttttcagaggctttttagggccaggtgtgaaaaactgctagtctgcaagaacgtagcagaaggatcaaatttcagagttaaattttggcgattcttggggaaaaaaaaacctgtagggtgggggttcggaaaatgaaactccgaacccctagtttccttgttttcccgatcgagctaaatctatgtgaaataaccatggaatggaagagacgttagagtcttagagacagggagtatagtgattttaactctctattaatacgaagatacacaaatccaatgcgttgtgatttcaacctgcaaatagccgagctggacactgcgaggaaaagagactgaaatcctgataaacatgagctgcatgcattcataaacatcactgtccagatttgcatcgtacattcagagcattggttgaaagcttaaaattgtgggggagagatagagagagagtgagacagtcctagacttggtgcccatcacagagctttcaagactgcacagagcactgaatttgctgtgctttcctggattcagacttccgtatcatttcctggtatacggacggatgaaatgaaaccggatgctaattcattatgccgcgtgcagctaaatgattatatatgtgtttcaacttgtcattttttgttacggagagacagcgggtgcactagatggtcagagtgctgttcctggagaaagaagaattcagcaa

SEQ ID NO: 5432 - DNA, 1431 bp, Oryza sativa
tgtggggaagagatagagaaagagtgagacagtcatagacttggtgcccatcacagagctttcaaagactgcacagagcactgaatttgctgtgctttcctggattcagacttccgtatcatttcctggtatacggacggatgaaatgaaaccggatgctaattcattatgccgcgtgcagctaaatgattatatatgtgtttcaacttgtcattttttgttacggagagacagcgggtgcactagatggtcagagtgctgttcctggagaaagaagaattcagcaacagttgcatatgaaagtagcaggccttattattttctccgtttttcccatttaaaacaggcatcatcagttaataattatgtaaaacaaaatatggtcatccgttatgtattaggtttggtacccccagcattgatcctatcctaataaaaagaagttgcagcaaaaattgcttatcagctatatgagatactttttgcaagctgtttttttggcccaaaactttacacccctggatctaaacaccttctaaacagggcctgaaactttttggagagagacagattgggacagtcctagacttggtgcccatcacagtgctctcaagacagcgcagagcactgaatttgctgtgcttttcctggattcagacttccgtatcattttctgttatacggatggatgaaaccggatgctaattgatcatgccgcgtgcaactaaatgattatatatgcttcaacttggcattttttttaaggacagacaccgagtgcactagattgtcactttgtcagagtgctgttcctgaacaaacaagaatggagcaacaatcgcatatgaaagtactaggccttgttgctttttttttcttccgtttttcccatttaagtgctcatctgaaacacatggtctgtctcatgcacaactcattgacgaaaagatagtcatcggttaattatctaaaaaaaaagatacccatcaattatgcattactgcattaggttcagtacctcagcattgatcctcttctgacaaaaaaaagatgcaccagaaattaaagatttgttgataagattgcagtttttttaaatctaccataagatgcgtttgtagtccaacggttaggataattgccttccaagcaatagacccgggttcgactcccggcaaacgcacttttttggtactgaagtttgaaaatttaaacgaaaccgcttcatcttgcaggttttcgaacttttatttgtactgaaagtttaaaaaaattaaacgaaatcgcttcatcttattgaaatttatgacttcggtgtgtactgaccaggaactgagaatgaacttttaaatacagcaacttccagcaaacgcacttttttggtactgaagtttgaaaatttaaacgaaaccgcttcatcttgcaggtttt

SEQ ID NO: 5433 - DNA, 3988 bp, Oryza sativa
catcgctgcctgtcagattcagacttgcatccatgacataaaaataaagtgcttcctgttctcgtttgactttttccacagtggacagaaattgtcaacttcgaactgaaacacatgcgtgctgtttgattaaaactgaaacatatgcagctagctcttgaatcgaaagacaagcataggtgccgttgatgctattgttccctatccagagccaagaactttaatggaaacacatgggatgcatattgcacataagcataagctaagtttattgttcatattaagacgtgtactttatgaactactcctacatcatcataaaaaagaacgaattaagatgccccactggttgaatatttgtttttcattcagatgtacgcatagcgtttgtagtccaacggttaggataattgccttccaagcaatagacccgggttcgactcccggcaaacgcatctttttgttagctgaatctttggcaaacgacttggatttcatctctgcattttctaatttgttaagctcgatctttggccaacaactcagactgccatctgcttgtaatctagatttcatcttaggacattctctctttagttagctgaatctttggcaaacaactcagatttcatctctgcatttcttctaatttgttaagctggatctttggacaacaactcagactgcacatctgcttgtaatctagatttcatcttaggacactctctcttttgttaagctgaatctttggccaacaattcagaattcatctctgtttttcttttgttgcatctgctctttttttttgttgctcttgtaatttatatttcatctctattgttttattctttttttggttgcacctgatattttgttgttgttgttgttcttataatttagatttcatcttaatatatatccttagctgatgcaaagaccggaagttttacttcctttgtccaacctcagtctttaacttcagtaatcgaactttgactgaaaacaaattgttcagcaagaacctcaaagtcataattcactgcacaatcatgcaacacaacctcccgatccaagatctgcttatgcagttatgcaaccccagtcatcactgagcctacatccgaacaagtctgtcagggaaatgtgccggatcatgtacttgatctccgcagcatgccgcatgttctcttgcagttgcagccatgatagattgatcgacactgtcactcatttcgcgacgagtcgccttagctgtccagcgatcgatcatgcgccgctgcaccgcacattgcgcaattctaggccacagaagagccaataccatattaccatggtcaggaagctgtgggtgccgagctggatgatatcttgatgcagcagatgtcctctgggatgtaatgtactactgtgcctgaactctgaacacctctgaagattatagccttttcagtctgaaatctgaacattttggccttcaaattcagagatttggctccattgatcctccattttcaggtcctaatgatttggtggtcaagcacatgaggatggatacccatacggccatgtctctgagtatttgtacacgagttgaattgaaattttgcacacttgggggtccatctgcatgtccacttgttgcagcagcagcatgctggctaaacaacaagcattttctcatgcagcatgccaagtgagccggttttgttgtgacgtgaacgaacggccaccaccagttcttttttttatgcaggatttatattggaatggccattgatattgatatatttttcgtgtttgtcgcgcgacgggatatgcgtcttgcgtggatttcattaaaaaagtactagtgtttctactttctgcaaaaagaaaaagaaaaatcagcaaactactgaaccctgcactgacagagaactgaaataaaaaaattctttcagaaaatgattgactgaaaaattagactatgacaatcggttagttaggtatgttatctgaaatgcaaacatcagaatttgaaaaagcaccaggacttctcacaagggatgacatgaaagctcaacaagagtccattttagcagcatatgtgggcatgctgatacaagggattataatcattaaaagtcctcatagaaatccagtctcattctagtgagaaaggaacacatcagagaaccatcatgtgacactgtctcttggtcatcagtcatcaccacgataaaccttgagaaacacttaattccatttagtcttaaccctgcactaaaacgagcactatatatacggcatcacccttgtcgacctgctgcaaaattcagaagaattcacatcgaaaattcagagtttcagagactatagtgcgcagacagacagttatcaagttgccgtaactatcactgtagcaaatactgcaaggacgagttcagactgacatagtgacagtgaatctgtgatccagtgaagcttagctgcagctgtgagagagtgagctagaatgggaggtaagctgcagcatctcatggagaggcttcacctggctgggaagggcggcggcggcggcgcggcgagggacgtgccgaggggacacttcgcggtgtacgtcggcgaggctcgggcgaggttcgtggtgccgacggcgtacctgaggcagccggcgttcgtggcgctgctgaagagcgtggaggaggagtacggcttcgaccactgcggcggcggcggcctcaccatcccctgctccgagcgcgacttctccgccctcctcggccgcctcgcctcctcgccgccgccgccgtcgtggcgttgatcacgacgagctcatgacgatgacttagcacatcgatcgatgaatggctagctagccgtgttcctgttcttggtttctttcatccacggcaaacgttggaattcgtaggatttttctatttatcagtggcgtgtaagtgtaattatgcagccattggtgtgccgaatcagcgcttaattttttaagagtgaatcagcgcttatttgaaaaacattttaggacttgttcatatgaattttacatgtttttttaggaatcagttcaattcccccaaaaattctttaaaattcttacataaaaaaattaaaacattataaaacagtaatactgttccaacgaaatagctaaccatgctaacctcataatggtacctatgagtatcgtgtatggtaccatgatactagatccaataccgatattgcgcttacgtcacactaccgttaccacacataagttattatgttagaatggtacttactccatctacttttgatagagatattttcaaatatgaagaaattacttttgatagacatatttcaatccaactacctattcttttaatgactttcttgaatttaatgcgtgactctccattcgtccacactgcataggcatcgagaaatgtaaatattaatgaattgcttgtttatgtttaaataaatgataggtataattatttatccttggtcattatgccaagatgaaatataattatcaaaagtagatggagggagtatatcgttatgtatgcccctatgtagtttgccctcagtttttatttatgggccggtccatatccgacacgccggcccttttacttccctttgttttaaggcccacaaccatgtcggcccatgtgaaagccatcttcgcttttctctccgaagaaatggctctcctcttcctcttcacctccaccaccctcttgttctcctcctcctccccgcgccgccacgcgctcgcatcgcatccaccagcgcccaaaaaccctacacctgcaaaccctagccgcccgcggtaatggccggcgtcctgcggctcgccggcgccgcgcggtccccactggcccgcgcgctggcccccgccgcacggaggatgggggcgtcggcggcggcggctatggaggacgaggcgtactggaccgagtgggaggaggaggaggagaaggcgagggcgcgggag

SEQ ID NO: 5434 - DNA, 3265 bp, Oryza sativa
agtcggaatcgcgccacacattttggaaggtttctttctcccagcaattttggaaacttttcttgaggcgaatctctaactctaatttgagcttttccgcgaggcttttgctcaattaatcataaagtaggctagattcctgcgtttcctggccactctttgggagtgcttctggaaatttcttgtcacatatctttggatcattacgaaatcttcgatatttgcctcatgtttttccgtaagtccgtagccacaacttttcaccagagcaagcaaatccattattttttccttattccccacgaaattggcaaaccaaacaatttccgagcgttgtttaacagcattattactctttgattcttcgatttctctggtgcttgtaaattataatggatcgcatgatgctgagagaaagggcgtgtggcggccatgtcctggtcagcgtcctcccctctgcacgaatggctgcgggggcatctccgtaatttgcttgcgtccacacgatgccatgggggcaattcggggattccacacaattagggtttcacgtcgtaaagtttggaactttcgatcttggaatctttgtggcgggcggccgccttcttttgcaggcttcccattttgccctctttgttgtaccttcgtttggctggctctcctgtagctttccctgaacagctgatagttcaggtagtattcggtagagcttctcaagttatcatcgcagacaatgccaagttgagaaccatatatggcttggttaatcagctagttgggtagagcagtttgacaagttgagaaccatttcacaagtgggcaaagatatatattctgaatggaaattttgtggctttggggatatgttatacaacaagtgtttcagggtattggaatatgctgaattgtttctgcatttgacatggacagattgcaaattcggtgaatgaagggaaacttgtgcccgaggacattatatttggattgctgacgaagcgtcttgaggagggatacaataagggtgaaactggattcatccttgatgggatcccacgcactcatatgcaggcggtaagttcctgtttgccttgtctgcttgaactaaataacaaagttctcggtatcatgtaattagcattgacattagatgtattgaatttagttatgtccaacacagttactaatttcattgatctgtctgtttttgaatgtttcaggagattctcgatgagattgtggatatcgacttggttctgaacttcaaatgtgctgataactgttttatgaagaggcggtttggtggtgacatctgcccccactgtggacagctttttgattttagcaaaactgcgtcttcagaccgtaatccgagccttgggagctgtacatggccttctcaggtgcaacatgctgcagttttaggtctggaggactcgagaatggagaagatgcgtgcttatgctgaacaggtattttcaggccacccaaacttattgggtctattactagcattgatctgatgagctttgcattgcaccatgcacccaatgaggcctgctttatgtatcacctgattgcatacctagggatggcaatgggttgggttgggttgggcacggacggagcaggaacatgcccgacccataaccgaatgggccaagggagagatggggccaaaaatcagccatagatatacaaaacttgggtcgggcatgggttacccatgggcaaaatagaaaacctggcggcacccactaaggtcttgggtcgagcgtgcccctgggcaaaaaatcgaacccatgcccatcgggcacagcgcccgcgggtacctggatccatgggcaagattgccaatttgccatctatatgcacacccctaaaaacttgcattttcagaaacaagaagtttaaactctgagaggaattgtgaggcatgatactagttcttatggagttctctagctttgttcttgtagtacagtaacatgataaactctaaatgtgaaactctcaatatgcagaccaagctactggaagactactacaggaaacagagaaaacttatggaattgaagacatcagctcgccctggagaaacatggcagggacttgtcgctgccctacatctccagcatctggatgcatccccgacgccgcacaaactcactatgtaaatatcgtttgtgtgttgtctgagaaagatcaaagaacttgagtctaaggatctagattgtgatcctagcctgcaacatatgtagtattcctatcctatgtttgtggattctgacttctgaggagtcagccggctgtcatttttgtctctctgttttcatagatataaatgtaagcgattttgcggacgcacttatatgtttgtaatgaagaatactggacttgcgagtgcaagtataccagcttgttttcctccttatcagttcttctatactgtcttgtttacatagatgatatatcgtatctcctgctttgatcttagttcttgagtattccatcagtgaagccgatgaaatcttggaagcgtctgtaagttttggaaaagaatacagtttcctgtgtaatatccatttttgctaggtcacctgggcactgagaatagttgtaaaacagagattgtggagtgactatctgcattccagtttggtagctgttcatgatgaacctctgtttctatctcaactcaaggtgttttctgattgtggactgtttgacctccagtttggactgtaggaatttcgtcagtttttgtaaaacttgcattcacatgcaagagctacacaggaaattgatgtacagtttctccatatattgtcaggcgaaaccacctccagttcagtgaatttatgattcaaatgcacacgagcatctgcaaattcaaacttctgttttgaataacaaaaaaaaaatcaaacttcctttcgaagcatatttggattcgattttgtcagatcacatctgaatctgctacaaacggcacagattacacccccccactcaaacggacggtccagatccccgcacaattaaatcgatctcgccatcaaaatctctccgcatccaaccaaacaggtcgacgcgaagaggaagccgcagcacaagaaaaccaaaccccaaccgcggcgacgcgaacggcaagcaaaacccccacactttccggcggcggcggcggcggtgaccgcggcggccattgagaccgtggagacgctggtggcgcacatccagggccttttcgggagcggggaggagctgg

SEQ ID NO: 5435 - DNA, 2497 bp, Oryza sativa
catctcggtgatagtcgcgggcgccgtggttgtggcgtacggcgtggcttgcgttggggcttacgtggcgtgcggtgtggtttacatcgccgctcacctcctccggcccaggtcggcgaccaccgtcgttaagctccaggttagttagtctaccatatcacacccaacctagctttgaattgatgatcacgtgctaatctaattgcatctgtcacaatatgaggggaaactattttcatccctcgaggggatatcccctcattgtatgcatgtcattcaaatggttataaaaaaattgagaagatatattaacatgtgatatatcgctctacaaacatgcaagttcaaattcagcttttatatctcgcaacgaaaaaaacaaatttgactaagaatatacgttaactagttgtagtttaatttattttttcgttgcgagatgtagaagctgaatttgaacttgcatatttgtggagtaatatatcacatgttaatacattttctcaatttttttttcaaatttttgcataattatttgaatgacatgcaaataacaagagaatatctcctcgatggatgaaaatccactcccacaatatcagtactaatctaaattgtatttgtcacaattttactgatctaaaaataaatatactgtaaggatatatttaatatggattaatttgaactcatttgatgttatagatattattaatatttttttctgtaaaattgatcaaatttcaagggagttgacttaggataattcaaagtgactaaggataatagcatatgaagtgttttcattgcattggtcttgcgtgtttcctaactccatcattcaaaaagtgcttcatatgggttgtgtgtgaagtttgttgggttgcagttgattcgtacgtgccaaatattctccccaaatctagcacaaaatattgcatatttcgccgtttcaagttccctgtagtactaagctaacaaaaattagttattttccggtagtagagctaaaaataattgtatttgtcacaattttactgatctaaaaataaatataccataaggatatatttaaaatggattcatttgaactaatttgatgttatagagactagcaaaaatataatttcatctgttacaatttcactaatcttatattgtaattgggacaatttcaatagtctaatttgcatttgtcacacaattggtatgtatgcatctatcgctacactaatctcgttgggggtttgcgattaaattgtctgaattttttttcaggttgcatttcgtgggctgacaaaaataatacagagggatctcaacgggattggtaggaaggtggacacttccaaccggagttgggacaagttcatgttgaccggtaatgcggtttctaaattcttgtttgcacctatatatggttaatgcatcctacgttcgtaaccagtcttttctttagctttgaattgaagtctgtcttttgtttagctttaaagtcatcagcttcagtctttcttttctttttcagttatacatttgattctatatatactgcaatttgcgattagatatacatttgatctgcaattctgatcaaatggtatatacccaattcaacttcaacagaagttagcttggggtagcatataggtatctcaagagccagaccgcagctgtgaagtggcgatatcttgaactgaactcgatttttgttcttctttcttcaatcatagctagataggtcatttatatttgacctttcatgcgcatgtgtgtgcagaacatttcaacaatcattcaacaatggtatctctgtaatctgcatatatgtctctagtagatatgtacaatttgtatcactaatacatcaactgctagcttagctttggctgtgtatatcccctttggatatagaggctggattttatccattatcttaaaaaaactgctagcttagcttgtttatcattccttggtagctttggttatgtatgttccttgctcaccatttgtacagagaccatatgctccttgaaccgtcacaaagatatctgcatctcttcaagcttatcggtaagaaatttacacaattttattactcttttggcgatatataacattcttattcctacctaattaattcttccctttgagatgacaaacctcatgtaatttgggcgtgccattttaacttaggctgacttgcaaaagagactgcttttctggggtgattgctgggagaaacattttgataaaatttctatcgaggagaggagcaagtttgatgaagaaactctatacaacgtgcaaggaatcaagatgaagaaaaaatatttgaaacccggcctcggaaaagaaaacgagtatctggtggtatgtatatataaactctccatggcttatcaaatgcatttacacatgaatttcttttgatcgaggcatgttggttacattctttaacatatatatgatcttgggatgattggacaaatcatgc

SEQ ID NO: 5436 - DNA, 2563 bp, Oryza sativa
gtaatgcaagaccaatattttattgaagttgctaatgtgactgatgttaagcagtctaaccaagaatctacaaaggaagaccaagattctaagcagtccaactaagaatctacaaaagaatgccaagattcagcaactacttgaagaatcatcggggatttgaaaagttatgtcataggtgctactctcagtaaaaaaaaaagagtcaacttctggctatgtatctggatatagcttatgtccacatatatagccataagtagacttttttttgacggagggagtatggtgtagtcacggtagcaagatctcaattcttaaagaaatgaaatactgaaaaaaaaatgacaggtgtaatgatttgaatgcattcacttatagaagcattttacgaactcattcctctttgtgaatgagaatgatttttaaatagttcacaagcatatggaaattcgccactaagtctaatatgtgagttgtaatttgtaaatttacaacagccacagatataccatgcatgtccgatagtttggtaatggcattataaaagcatattcctctgtttcatactatatataaaggacgttttgatatctattcatcatctaaattaaataacatttatataatttggacacatatatgaagcatatatatttggatttaactcggtaggatgggcattgttagaaacaacgatcggaaacgatttggtaccatgagataccggtaacttgaggtactttttgttggaccgaaacaaatctcatggaataaaagaaatcatggaataaaagaaaagaaatagtttgttggaccgaaacaaatccatgggataaaagaaaagaaatgggaggtggacggaacagtggtctgacggtataagagagaaactgactcaaatcgctcaacgatgcattttaaattgtgttttgaagtttcattatttttctgattaaggtataaattttatctcggttttcgttagcatgtttttcaaactaataaacggtgcattcatatgtaatctttctatatataagtcattttaatataaatcgagttttcaagtttataataataattaaaatttcattagtcatgtgccaatagttttcctgtagttcatggcctaactttatcttttatctaaacgcacaactaacgagtgccaaaataaagtagaatttacgattgaatctcgtgtttgtttccggctgcacatgttagggccattttggattgatttcaaaatgtgccataccaattgtttggtaatttaaatagtagtttgattggtttggattagagccaatgcattggcaatacccatacctaatttggtagtactctagaactttcttcactataaaaagcatattggtagcaaaccaaacacatattatatgaactctatcctaccaaagaattgggggttcctaggaggcgcgtgcgcgtccgctgcttaacttgcgcagccgcgccgtccccctgacgactagtccgcgcgctgccgccgctaattatgataattagtgttaattactgttattagtattatttttaaaaccgtaacaaacataaataattcagttaccaatcattttagaaaagtaattgaaagttttaaatttgtagtcaaaagattttgaaatttgagttgaaagttttaaattttgatttcaactttttaaaattttgacatagaaattttcaagttgagttgaaagtttttgaaattgaagttgaaagttttcaaaattaagtcgaaagtttcacaattaagttgaaagtttttgaaatttgacttgaaagtttgtaatttgatttgaaagtttcgaattttgagttgaaagttttaaaattttgagatgaaaattctaaaaatgtgagttgaaaactttcaaatttgaatcgaaagttttaaaattttgagatgaaaattctaaaattgtgagttgaaaactttcaaatttgaatcgaaagttttcaaatactgagtggaaagttttcaaattctgaattgaaaaatttcaaatttgaatcaaaagttttcacatgctgagtggaaagttttcaaattctgagttgaaagtttttaaaattttcaattttaaaattaaatcttatgttaaaaagtttagttaaatgttctaatcaatgtatgtatgtatgcagtgggttttccaattacaattagcatatactactactaattgagtgtgtcactattgaatcatcgttaatcattgttgaaaagtcactaggcccagcaggctcatgtcagacatgaagctgaggcgttgccgtcgcgaaacgctcgcgacttgctgatctcgcgcgtacgcgcgaattaccaatatcgaaagagttggtagtgccaaaattaatctagatattggtactactattgaattggtaggatagagaaccaaatagacttgtagtcatcatcacgaatcttgaagcaaattatttgcttgacacacaagtaattaattttcgcgagattagctattttttgggctaatttgtcggaacaatttactggtgattacgtacg

SEQ ID NO: 5437 - DNA, 4325 bp, Oryza sativa
cgttgcaggctctggcaaagacaatgcaaaaggatctcaatacgattgctgccaaggtggacactactaaaacagcgtcgctacaaattcatgttaacgggtaatataatgcgatttgttgatttctctaaaccctaaattcattcttgcagtcggctgttatacattattgattctacactgcacaatttgatacttagagtagaagagaaatttatatatgttcatgccccatttgtgcagagacgatatgttccttgaaccgtcagaaagattactggttctcttcagccttatcggtaagaaaaatatacaattttcagaacctttaatttcgagacaaacgcaacgtttttgtgttccactaatttatgaccctgtgaattaactcaccgtgttttgttatttgggtgtacatttaattttaggctgatgtgaaaaaaacagtcgacgaaatcgattcttgggaggagcattttgataagatttctattgaggagaggagcaaaactgatgaagaaactctatttaacgtggagggaatcaagataagtaaaaaatactccaaaaatcctgaaagctgcagaaaagagtacatagtggtatgcaaaattttcctaagcttgcatatatgcttacaggattttttttttctcgtcagtggttgccttggaactctatatctaattaatgatcgattgaggcatgcttttttactaagatatttgtttggggattattgtcaaatcatgcagttaaccattattcttgctgctgagggaaaactgaagtttccccaaatcagaagcgccgatgatctgcgattagtactgggaatgctcaacggtatacatgcaagtgaaattaaggtatattagcatgcatgttattcatttcatttacacgtcctcttatcttatatatatgcaccaattttttaaataaatgaaaatggtttacatatctgatttctgacaatcggcacacaaacacacaaccaatatttaaaattaaggatactgcatctcctgcaatgcaacctcattaattcttgtgagtaatcattcactctcaaattaatcatatcctaatcctaactatattggacctattgtttcagggtgttcaaattctatggactccacaagaagaggatgatgctctttcagaagagaggctactaaaggactatccatatctgaggcccctaaaacaagttttaattggagagtcaaaacaacttttacttggagagtcaaaattcaaacaaattttgtttggagagtcagaagagaagcaacttttgcttggagagccaaaagaaccgtcagtacaagaagatcctaataatactaagggataggaactttgttcttgctgttttacttgcatgcaaaaaaatgtgaattatatggagtttattagaggtggatgtcagttcgatctatgtacccactcatattcaaatctcaattaatttcatcatacctaaaataacatttttaaaagtagcagggagtacttaaaccaaacaaccttaatacaaaatcaacttaaaattttcatatacggtctatattttaaaattttaagagtaaatttcacaaaactacagatactatgaccaaattatcacaaaactacagatttaactcagtgtatcacaaaactacacatttaacaccaaatttatcacaaaactacaaatttaagatgaagtgtcacaaaactacatgtttagtaactaaattatcacaaaactacatgtttagaaccaatttagtcacaaagcaataatgtttatagctccaacataacaattgtgctataaatttaaacttcaaaagctgtagttttgtgataacttcaatattaaatatgcatttttgtgatacttaagcataaatgtgtagttttgtgataaatttggtgctaaatctttagttttgtgatacaacgccttaaatctgtagttttgtgataatttggtcaaaatacccgtagttttgtgaaatttgctcaaattttaaattagtgtgtgctcaacatgtatagcggtgggttttgtgttactaatcacagtagttagttttgtgtaatttcaaccataaaacatgggtttcgtgacatttgttctttagaaacataaacgaacaaacagattgactgctgctacttgtctgcttcttacacttctgacacatcatactgaatttacaattgaattttctggatcacggcaagaatatcttatttaagacacactaaataatttggagcagtgacaataatggtaaattgcgtctttccgaaactttaattattcaataattattaacagtgaaatttggtaatcggcaaagacatcatcggcttagaatcattatcggctgtagcatctcggaatcagccgatgggagttatcaagtcgccaatagtcggattcctgctatattcggttaaggaaatcaatctactaaaggaagcttatctctaagtgaccgagtttaaagagaatacggcatggcaatttatctattaattaggaataatttgttagtttctttttatctttaggaaagtgtgtttagtgtccaataaggactttatattttccttttatctttaggttagtttctttcttgtccgacaaggacttgtatcaacccatgggtataaatatgtacacccggggtctatgtaatctatctctatgatcaatacaattcgacgcatcgccaccctttttacttctatttttgttttttacgttctggcggaacttggcacccgacgcggggctgcatcatcttcaatctccggcgaagggataagtccaatgttccgtcggcccaagcaattgtctcatctacatcggcgttatttaaggctgcatcagtacattcgacctcttggattgctctagtttggatgatatatttgcctacatatttatcatatgtctctattaatctagtcttagcatatcaatttagctctatcggctgcttctcattttagggtttctgccgatatcggctaaatcgcgttgctagattagattagctcatacatctaccaccctaaaaatcagtcaactgcttgattgtctagatattatgtttcttttcatacttagtgctgcatcagttaaatttgatctactaagtcatgcttagaaccataatctctagcctacttcttgatgccaataagggtttcatcggggtttcagccggtgagttatctggacgttgcatcggctcataaggattgcacatacatataagttggatttcgccgatgacaacaaaggtttcactgtttaatctaatcttgtggatttcatgacatcggacctctagacaatgtgtgctttaaccttcggatcgatgcttatttatcatatcattgctagctgattggtttatactggattatattgttattttattacatcatcatcagtcgattgcctttatatcattatctacattggacatatagccgattgcttaaaccctatcgctatcggctggtatcagcatcgactattattggctaccggctagaactactccatcggcttgtcagccgatcggctgttttgatctactatttgcatatcttgtcagttgcaggatcaaactgactgacacgcccacatctcatcatatttggacctgcactggagctaagcatatctcctaggtcggggtgttcgattttttcgtcaacaataatttaatcaaatgcatattcacttaactttatgttaattttttagataatggaaataaatcatgcttcacttaaaaagagctacaaccacttattacacaaacttattcaacaaccaacacacaccatagagttcacaatacacactccgaaattaacaatactcggagcacaaaatagacaccaacacaagataaagaaaacacaattattgaatcctagttgtaaatctccacccaaagttgacgaaaatatgcatgatcgttgactcaaatttgcgatgtgcattatttattagcttgatctgagcccaaaccagaaccaatgcatataagattttgatgatgatttgtaaaaaaaaaacatattatttctattaagtcatagaagaatatataacagatgatcctacgaggataagtttctttaatacatttgaatggattaggcttcgtttaatccagtatgtattcagccttcactcgttaagccctaaaccctaaacgctctgtctctctctccttctcgaccacggcaatggcgatcgccgcgcgcctcctctccacagcgccatgccgctcgcc

SEQ ID NO: 5438 - DNA, 1282 bp, Oryza sativa
ctcatcaagagaagcatccccccgccgaggaccatcagtgtggtcaagcttcaggttaatttctctgaatctgatcttagagtgtccatgagcaattcagagtttcagactgggtttcttgatatgatcagtgatcgatcactgattcaaaattgtatatatactgattggatgatctatcttcgtctctgttactcgcaatttagattgcattgggtggtgtggctgcggcgaagtcgttccagaaggatctgaaccggattgctgagagggtgcaaggctctagccgacgttggtacaagttcatactgagcggtaatgcctattctgaatttcttgcacatcaaatctatttattctcctcgcaaaaaaaaaagaatctatttattctgaattcttgcacatcgaattctgctttggtggttccatgctaattacttaattgcagatggattatatttgacactagctagtagctttaaatataaatcgcacttaaaatgtctttaataataagacaagtagcaacaaaattaataatatttacataaatttattgaaccaagacaaatggtcaaactttgtagccaaagtcattcacgccaaatatttattatcggagggagtagtatgttagttttactgttttaaaccggaataatatcctggcttctgaatctgaagataaacaaagtcacaacgtcagtctcttatctaggttgccctctaatgagggtttcaagtgtgcaatcagctccacatataggattagttggcaacttttatggatcattaggagtaggaaggggaaatatatatttgtgcttaggccacacacggcacgcaccttgcagaaagttcagagatatatatattgagcatgtttttccatgtgtgcttatggatgtagatctgttcaagaagtactactatcaagtaatagcattttttgcagaaattaatctatttgtgcataggactcaatttagtattaaagtgatggtaaaatattcttttttgtcgggatgaccgaaggagatggtaaaatgtacctataataaggttataaaataatgttactgttaacacttcatataacttagatacttatgaccactatcaattgtccaatgtatcatggtagcttattttttatgttctggtgactcatcttatttcagataccatatcttcattgcaccgccacaaggattactgcatctctacaagcttatcagtaagaaataaaaacagttttaacattcttttggtagactgacag

SEQ ID NO: 5439 - DNA, 2586 bp, Oryza sativa
aatagcattttttgcagaaattaatctatttgtgcataggactcaatttagtattaaagtgatggtaaaatattcttttttgtcgggatgaccgaaggagatggtaaaatgtacctataataaggttataaaataatgttactgttaacacttcatataacttagatacttatgaccactatcaattgtccaatgtatcatggtagcttattttttatgttctggtgactcatcttatttcagataccatatcttcattgcaccgccacaggattactgcatctctacaagcttatcagtaagaaataaaaacagttttaacattcttttggtagactgacagacatagtttgtgttcgcttctagtttctctccctcgatttgacagcctttgtatgttccgcccactgcaattacgtactgaatcgtataattttgctgaaccatttattttaggttgatataaaagacagcgactcttggaatggtcattttaagaaaatttcgttggaagaaaggggcaaatttgatgaagaaacgctttctaatttggaaggcgttaagagaaataaagaatactctacaaagatggatgggagcaaaaacgagtatatagtggtatgttagacttgttactttgtgaaatgcttcttgaaatatttgccatcgatctgctgattatgatgataaaaggacactttcttgacaaaaaaaatggcgttcttatttgtttgatgtctaatgactgatttgttctgatctccaaatcatccagttaaccattcttgttgctacggatggaacaatggatttccccaaattgatcacaaacgctgcagatctgaaagttgctttgacaaagctctactctacacccgaaacaggtcttgaggtatggggaatatttccatttgtatttcgtaaatcgtaagctagcacaactgcttcttggtatattattgaacaagctagggaaaacgcagcttgaatttactaagttactcatatcacttttaccacttttctgataagtattattatctgtttgttgagtgcctaatgaattggacaaactaattttgttcagggtattcacgttttatgggcacctcaagacaaggatgatattctttcgaaggagaggatgcaaaaggattatccatatctgaagcccttgagtgtctgattagggcggccttctcttcgtgtccttggaggaaacccatacaagaagtgaagaagagcattatcatagtcccagttattttgtagttagaacttagaagaacacatacagatcattaggcaattacactattataggtctatagtctatatactcctatatactggtaattgagatcagctcattgttttggttgccagtcaggaatcagggcacctttctaagcctcaggaaatgctctgtaaatggtgatgaacttgtaatagagcacagtggtacacaagaattttcagctgattaacatgatcaaggttgattttataattccatggaactattattgtatttattaccatattttcatataaaataatctcaaaatggaggaaaataatcttagactccatactccctccgtcctaaaaaaaaccaactagctatgtatttggacatgcgtcatgtctagatgcatagttaggagttttaaggacagagtgagtatgttactccagcagctatagtgatgttgatttgagaaatttaatatgctattttttaaatatttacatatactccttccggtctgaatatttggcgttccccgacccatcgccggaggagaactcccgtgctcgccgccgacgttgctacagctgtggttggccagctccccgtgttcgcctagaccgttaccattataattgtcatattttcatgaaaaattcttaacatggaggaaaacgttccaagcttccatatgacactctaggagctagagtgatgttttatgagatacagcactcttcccttgctatactcccagattaacatgacacttttaatacttcctccttctttaataatgacggataacattgatatacttaaatattctgagtaaatttactttacaccattataaaaattagaatacaaaatgggtctgataatacaattttttttttataatataaatacagattacatgtagattaaggggctgtttagttccccaaaaactttttctaaaaacatcacatcaaatctttggacacatgtataaagcataaatatagataaaaagaaactaattgtacaatttacatgtaaatcgcaagatgaatcttttgagcctaattagtccatgattaggcataagtgctatagtaaccaacaagtgctaatgacgaattaattaggctcaaaagattcgtctcacggtttccagacgagttatgaaattagtttttgtcggagaatgaactccttcaccagggaaccgtgaggccccccctttgtgagttcggccgggggcagcgggtgagattcgagggcttggtgagcgaagctgtgtcatcttgagggggttcaatcccccaaagacaatgagacaaaagggt

SEQ ID NO: 5440 - DNA, 4038 bp, Oryza sativa
ggggtgtctcgcatattatccaaaaaccatctgatacgagatcgaagcttcaaggagtccgtcagtctagtcctccagccatccgcaggatcccggggcaggtagagggtggtcactggcacgcgcaaacctgagtccccacggctcagaggtagtggcccctggatctggcttgggcctcttgcccggaggtcgtgtgctcttgcgagcagtgctaagggtgcgagggcctccaaggaaggtgatgcggggaacaggggtctcatcctctaaaggatcagtgatgtctggctcgatctctggctcggtgtcggttccctctgtctcggagtcgacctggatcggagtctccaaactggaacccagctgtggagaaggtgtagggatcagtggagtgtgcaccaactccggaacaggtggctgtgccgctgtcgggtccactaggtagggcgttgactcggtagctagcatactagcctctcccagaagagcgtggaacgccggtgggtacggcggggtgaggaagaagtagcggtcacggcctactgctgtggaagtagaagcccctgtagtgctgatcttggctgctcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtccatctcactgccccaagcctggtgctcctcctccaactgaagctgctgcactgagaggtcagtcaactcagtctccagctctcccatacgtctctggtggtcgtcaatctccaacagagcctcctcgtagtagtcatctactgcctcagcccatcgtgacaaccgagtcactatcgggttgtagcagcagggcgtgtcttgaactgtgcaaactgagttgccctcctcccggaacgggtgatgagcaaacttggtactcactaactcagctcggtgaatagagctgagtcggaggaaggcctcccgggcggcatcctgcatcgcggtctctggcaggtctcggtggtgacgtgtctggaagctgtagtccaacttggaagggactcgggggtgaatctcgacccgagcctcccaaactgagccacactgtctcactcggtatgacgggaacccagggtatcgcagacgcctcaacattccgatgcagctcaatgacatacccctctgattgaggtaagctcaactcccaggtagcgggtgaatccgaatctgccatctaattttaagaaaacccaaagtcagttaaggttaaaaattgtttttgtaaagaagatagttaagagtaagatgaatattgtacagagttttgtaaacatagcgtatttatttttgatagtattactaaatgggaatttctcccttggccaacttagaaaaggggtggggcgccttttggtcttttcctacagtcgtatggctctgataccagctctgtagacccccgtttttataacaggaatcaatcgtgtaaacagtaccatttccctggatcaagtagtttggtacacacgaattcatagctggaataccaagtgcacatacacgagtgtctaatacgaattattacatcataggcccgcaggcatagtcttaaatcatcggaccgagcggtctggaatacatccaaaagcagaaatagataaggcagcggaattcaggcagcggcatgccattgccacaggcaacgaccgtactaagacctactgaacgccatcgtcttcatctccctcctggtagtaggcatagggatcctccgaggcttcatctcctgcttctgattaattttatatttgcaagggtgagtaccaaccgtactcagcaagccatcacagcaatgatgcacatgacagaggaattcagaggatggctatggttcttttgcgcaaagcaagttttgtaattcttttcacaagcctaagacctagcatagactgatcaagttttaataccagtattcatattaaacaatgacggttctgtccaccatccattgtgatcccaaggatagcttcccgccattgagtcgttatggttttctgaggacgtccacattcccgcctctcaggaagtggctccatcagtataaaaatcatcatgcagatcccatcccacacaagtttaagaattttagagtctagccaagtgtaatacatgtcccggtgctcaataaccgcgagcatggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggtgacaccgatgtagggcacgcctctcggccctacctcaatggctgtcccaccgtagcgcacctgcctcactcaggggtgaaccatctatgcagggatactgcatccgctcagctatctaatccgctaggtctacacccattcgagaagtacggttgtacgggggtcgtttcatgcttaacttcatggcttggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgaatagagactcatacgtaaatatggttacaaagatttaagggttaacaataatcaaggcatggcataatcacaagtgggatgttcatcattgcatgcaattttatttgtaaacaaaataatttcgcaattgggatcaacatgttcaaggaatagtgatgacttgccttgctcaaagtcttgcgggtcttggccttcgcttggatccgcaactccctcgggctctatagttacgtgcaaaaattgatttgaattcgattagaattcaaataaaaatccaaataaatccaaatggaagtcgaacgcgaaagtcgattcttttatattaactttactattcgcgtactagggcaaacccaatttcgattcaaactattttgcgggtataaatgttttgttctcacaagtttttaatttaatctacccgagcattatatccatataataggttagaaatttctatcgcgagctaaatatcggacggaatcctagaattattatacgatttaatttagtctatgactaaataattaaatataatacacgggtaaaattcctagtaattaaatccgaatttctaccgtgaaccgatgacttatagagattaccaaaaataatctataataatctataagaattcatctaattgtttagttattaattatatctaaattactaccaattttaatctaatttgatcaagaaacatatttttataattaactcggaatttcgaccgaaatactattacgctcgaggaatttccaaaaataatctatgattaaccccgaccatttttatttcctaaatcctcctaatttctcccccaatttcccttctattttctccttttcttcttttctattttccctctttttctctccctctctttctttttctctcttttctctccctctctttctcggctctatcccacccgagcggtggcggtggacgcaaggggaaaggagggcggctcaccggttgtgggagcggcgaacgacggacgcggagaccgtggtgcacgg

SEQ ID NO: 5441 - DNA, 778 bp, Oryza sativa
tcgattacgtgcggcccagtcaacgggctggagcttcgcatggctttggacttacgtaaagcccattttcgctgggcccgttgatatatggggcccaggaaagttaatccgaccgccgcgaaaaaacagcagtccagatgagtaacatggaccatctctgcaactgcagttgatttacaccatgatttgatgattgatttaactcagataaagaaaggcatagtttatcaacgaggcaaaataggatgtgaatatgtgatccaactgatggtcaatcattgagctactaccagagatgttcaaaacatttcagtcagtgatgcgcatctattgtgtcagaactcacaagagagatgcagttaacagattcacatactttcatctaaactgaggtgatcttaacccagagcccatctaaaataacagtatacaagaatggacaacttgtagtcagcttcaaccaaatgaaattcatcatcttgatcatcaacccttgtttcagtttttactgtgcccttggaacccatcagtttcttccactttcgtcttgcagtctggtctgatcttgcagaaacagcatttgaacagtcccctgcgaggcaaagctccattttgataaggagcaccagcacggcgctgtagaagcttcgagaaacagcctcggcgagctctggcttcgtcaacctttggtgtgtgccctccagctttgaaggaaccatttcctggagtggatgcttcaggtatgactgaaatcttctgatagctcaagatcctcgac

SEQ ID NO: 5442 - DNA, 907 bp, Oryza sativa
  unsure (1)..(907): unsure at all n locations
agacccctgttccccgcatcaccttccttggaggccctcgcacccttagcactgctcgcaagagcacacgacctccgggcaagaggcccaagccagatccaggggccactacctctgagccgtggggactcaggtttgcgcgtgccagtgaccaccctctacctgccccgggatcctgcggatggctggaggactagactgacggactccttgaagcttcgatctcgtatcagatggtttttggataatatgcgagacaccccctcccttacctagattgacgagtagtttgatgattagttcgttgtatcttttggatgaaccttatttggactgcgtatgtatgcagtcgattgcatcatgattcatgtaccatttgtgaaactctgtgatgttatttatgatatctattgttgttgtattataaatgagtttattccaccatgcttgcaaaacaaagttcatatcaacataactcccttaatgggataaagccataggagctagttagaaaattaggatacttactccatcaacctacacagatggcaagccgacgttgggcaacaaccagcaatgacgaaactcagacacccgacttaaccactctggccggagttatggccacccaaactcaacttctgcaagctatcgcgaacaaccaaggcaaccgcggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5443 - DNA, 3499 bp, Oryza sativa
  unsure (1)..(3499): unsure at all n locations
tcaaatgtcataaaattagaatagacatacaattggcgctaatattatggatttgttattcgtgattcactgaaatattctctatatatgtttgcggatcttagagaaaagaaaaacaattatgcttcgtcattgataaaaaaattaaaatcaaaatacaatatcaactatggattaataaattgaatattgataaactctcatagaggaaagcaccctaagaaaaactccaaaaacttgagcttggcaacttgggcgaagctcaaggtatggtggagcgtgcacatatcgtcgttgcagttgcaaaccatccccagcctctccaggtcggccggccgaaccacgggctccttcacgaccaacttattgacgacggcgatgtcgcaccggatcgcgaacccgtcatccttgaggtaccacgacttctccagctccttcctaacgacgaacctgtcgaacccctccgtgaccccggagtagaataccctcgtgaacctcttctcgtgcggttcgcccaacggcagcgtcagcccgtagtggtgttgagggaccaggctaaaccggacctcggcctgngcctgngtgatgtggtggagcgtgagggaaacaganacnaaacccggacacgtnctcccgtttgggtagcagaggatgccttcagtgtgggccgccacttngaaacttgaggactcgacgaagtgcccaccatccgtgcatgggggcgatccgcgtgtatccgtcgatcttgagcatatggcatccggtggtcgcagtggtgctgactgtagacacggttacatcatcctcagttggcgccatgagatagatggcacatgggtcgtcagacaacatacggtggtgttcgatttgtttgtaaggtacgttggtagggttcagttgcttcaatatatgaagatgttaaggtatatgtcggcctgtagctagtctcgaataagacccattttttgggcctgaataagtattattactacatgttggatatcgcggatcgttgcaaactattcaagtctctgtccggttcgtaagcgagcaagggggagatattactgatttcttaagtggttatgaaaagctagtaatatctgatgtgttaatcaaaaaaccggaggaatatgagaaacataatattctgataggaatgtaagtataaaatagaggattgcaaaacacaggaaaaacataggaatgaccgtgttgattggaccacaggaaaaacacaggaatttgaggagagataaagactaaggatttcttccatgaggttccacctcttgttaaaaatcctccaaaacttatatgagaagagcgattccatagaaatttcataagattctatagggttcattcctttgattcaaagaactttgtaagaaaaattcctatatgaataaaattctctaaaattcctatgaatttcctttgaataaaaggggggccttagtatgaatcatattaatgtatccactatagcaagccaccaaaaatttgtaaattctattcccgtgcttcaccttgtcccgttctctttccctgccctacttccctcctaatgtaaaataattactcttacttttacatgaaaatagggttccatcgctaccaatcccctctctcgtgccctccactatcactcccccactccatcttcttgctgtcatgtccaatcacgcttctcctctaaggttttaactgcgcgtcctaaggttacgttgggttagaataatttctcgtttatcatgagcacatttatcaaacggctaaattgaaaaaaaaaattatatatgtattttaaaaaaacaaataaatttgtttctcaaatttattatagttaatacttcctccatcctaaactagagataaaagaaacaattattatcaccccatttgaatcatcccaattaatacattacataaatataatagttaattacatatgtcacatgcattgaattatgaaacattaaaaaaatagttatgcattatatttttaaatagagcgagtacttaaataatcgtaagctaattgatattctcattttttccgtgacactaactagctaacttcaaaagctagcaaactattctcatgtcccactcgttcatagtgccacacaagatttcaaatttataaaatataatgtagaaaaagatcgggatattgcgtcgcagctggccctttctttgtgttggagaataggagccttttgtttgggagctcatgcctgcagagaagcagagaatttgatacattagtactccgacttcaaaaagctcgataagcaaacatgttaacacatagtattaatttggagttatgtcacataaaagctttttcgtaaaatgaaaaaacaagtagcacgaataaccttcaagttatctgatttatttgtcactttgttctccccagtttgatggccaactttttcatcaagggaggcatgttctgcaggaacatcaccaaatatatcatcgatactccaagcagcaataatgctcccatcttcactgatgcgtttctttaactctttctgcacggatggtaaattaatcaacgagcacacggcatgcgcaattttacagttggatagttggacaagacaagaatttcagataaaagctaacccattgatacatcctcgcaaggggcacgactgcttcacggtaatcgaaaaccgacaactcggtaaacttcagccacagatcttgcatttcagaacgaacctgatcaaactgcaatgcaaaaaaaccgtgataattagagcatataattgtcaaaacaagaatgaacacaaggagagaacagtaaactgaaacgatgctcaaagtttcagacctcagagcttgataaatctttaggacaagccctcaacttcttcttgattctgtcaaggatctcagctaattcactgcatttcctcctcctcatctctgacagggtctctgatttcattccaccaggaggtaggtttaacactagctcgatcataccatctatgctctgaaactgtaacatctcatcgtggcatgaatagccatcctgtgatgcattctcagttttaaattttccacacagttttgtgtcaagaaatgacttcaaattcacccatagatcgtccgggtgcttattgcgcagatgttccagcaaagatgcagtgtccaggaacttcttgcctgcacattggcccgaagatcgcgggcaaatccagaaacaccatgaaccgtgtgtcttggagaagcgccgcgcttcggagactgtgttcgccgcgatttggtcgatcttgctgtagtgttcgcgcagttcgtcgatgctgacggagaggatctgagattgcttctcgctttccatggatgcccaatcgtgtacggctaacaagacaagcttcttctgaagatcacagagttgtttcctgagggatgacaccatgtcgccgtactcttctccaatcgcaaatccgagggggatttcctgcgccgccgg

SEQ ID NO: 5444 - DNA, 9133 bp, Oryza sativa
caactccactccagacttaactcctgaagcaatatttaggagttggaactgtaccaaacaggccctaaaaaaattatataagaacataatcctggaaggttaattataattagaaaaaggaaaaaaaaagcaccatgccctcacccacaacattgggaacttatcctctaccattgaaactagaatggcagacagctatagtactctctaccatgagccattttcagccgttagattagatgtggatggatgagatcgatcgctacagtacctaacagtaaattaatgccgtactaacggtaggtattttacattgtttgtacagaggtttttaactgtagctgtggtaaaacactgtaccatccctcacgttttactgtttacctctgccatttacctctaatggcagtggatgtgaaccccacaacacaaacacgtattgaagaaaaaacaggagcttagaacaacccgacaagctcaactttgtccacgctttgtgttggagaaggcgagggcgagaaagaatatatctgtcgcccacatagtcccgccaacgtggccatcgtgctggctaaaagcgccaccagaagaggacaactgtctggagatggaattggtaggaaatggatcatcaaacaacgcctccaagaaggttatgatgcgacaacactaccaccatcacccgtcttgaggatcagggcgtgattttctcccaacaaaaccatcaggaggaatgagatatgccacaacagcgccctaacaggggttgggctaccgcaaaagcatcatcgctgccgccccagaacgggctaggctttcgcctagcaatctttctacctcaacctgttgtgaagtcctatcgaaaacagaaaagaacagtcattactatctaaagcacatttgttgacgatcgttaagtacaaattttgaacaccaaccagtacaatgaataaaggaaaaattagcatatgttacatgtatatcaacaacaaataatgtagttgtattaggattgggaaacaaatgtggatgtagagaatatacatcaaagtgaaggagaaatgaagacaacatgtgaagaaacacacttccgatgaatcacgtgcgagcacacagattaaaggactcacaagtcagttcaaatcgactcaaagtggggccaaccacctggaaaccgactaaggggcccacatggcagcctctcgccaaaggcggttttcctggtttgaccgaactaggtgttcaaccgaacattggctagcaccgctcagcctgatcctccacgtgtcacctcctcctgcgcacctgatggcagttatgcacggctggcggaccaataaccgtcatataaccatcataagagtgctataaaaggagctctccctcacttgcaatacacacctcaaagaagaaatcccctcttccgctttgtattcagtttctagtaggaataaagtttagaatcttcggtccaatagtcttcttggagttctgggtatgtctctagtactttactctttgtgtaagattatagttgaattaatagaattatcttctttatttatttatgctcatggtttatatatttctttatttaatatatgttctatgaatagtatatactttgtatatatgcttcatcctagactttgtatattggtccatgctacggtaacggtccaataacctttatagattgatttaactccaacttattcatccgtagggtgagagtcttgggggagttagtgatattgtttacttgcacaagcatggtatataggctaaataaatgttgttggatccgggtgtgcctccacggaaagtgaggtaggtggcaggtggtgatagccatgtccgtcctttttattcctacacattcaagtatgacgtaagaatgcataaatgccataaccatgctggcagactagtagtgagtggtctctcggtagtatctgtgtgctctagaactaagtcctatgttgttagcatgtatatgttaagtgtatactagaaatgattagtattcaagtatatatgaatcgtagtttcctaatgataagtccctactagatattcttatagaggtgaatcttctgtgtgtgtccactaccttatcatttattatcctaaccactatttagactatggtgaattaattaaaggttgattaagagatataaaaaaacatatctttataccacccccttcgctgtggaagcacaaatacgatacccttgggagtactcgtgggtgaaatgctatagcgatatccgtgcgcttgcgaatttatatgtgaccataagaaataccaacaaccttcagctcacaatcaccgcaccaacactttaccgtcggttggccatcaggcaagatgccccttcccgagacagaacaatgtgcccttctcaccgctagactccatcaagccgtcaacacgctggccacctccagtttccccacacaccaccgatgggcctcactagcttacaagtcccaccgccattgccttgcactgctaccttcttccaacttcacccaagagggatgaccacacgctgtcgacttctgtatcatgccactccatggtgcctccttgctgaatgcccaaactccaggtaccctgcctcctcgctgcacgtcggccttcaatgcccacggccacccttgacaccgtggctacaccgttttacgcctctctccatatcactaccggccaccacgccatgtctgcagagcatatgcccaccacccacgtcgttctcgtcgtcatcaagagttgctttcaaggatctgtacctctcactggagacacacaggatccgtctagaaggacataagatctggccaataggatgttgatctagcatccccaccgcaacctctatgaccattactctgccatcttcaatcacagcatgtgttggctcggcctccaaccgtccactggcctcactttgtgtggatctagccatggagactcggatcccccagcgccacctctgtcttcacgattgcctcagagccctagcctaatagcacccttgagagtagaagagagagcttcaccgctgccttccttgcagccgcacggttaccaacgggccattcgggtgatggtgatgcagaggataggaggaagggggttggtggtagtggacgtagagtcgctgttctgatcgcccctagggctggggacgacaaataagcccgcttgaccctagagacactcccttcatctatttatttttggaagtgaagtgtataatcaagttatagctcttttcggcaaagatctgagtattttagcaattccttttttcttctagttatccttttgaattcagcatgtcttcaaatttaaatatctaacttctttttgtacaaatgggaagttaaataatactccctctatactaagatataagcatttcagctatttaaatattgtattaaaacattattacttctaggatagttattccaatacacaaaaattcaagcattttcaatcaatgaaaagcatcgaaagaaaatatatacaattaagtttattaaaaaagtattttgaaccaataggcatgagatctgccttgattatattaagaagaggcgaaatatgtcgcaatggtttgcttagaaactacaagatttaaaatttgacctaagaatgcaaattacaactttagtttataaaatgtgactaaaaagatatctctttctgttaacagtgaaatttggtaatcggcaaagacgtcatcggcttataatcattatcggctgcaacatctcggaatcagccgatgggagttatcaagtcgccaatagtaagattcctgctatattcggttaagaaaatcaatctactaaaggaagcttatccctaagtgaccaagtttaaagaggatgcggcatggcagtttatctattaattaggaatagtttgttagtttccttttatctttaggaaagtgtgtttagtgtccgataaggactttacattttccttttatctttaggttagtttctttcttgtctgacaaggacttgtatcaacccatgggtataaatatgtacacccggggtctatgtaatctatcgctacgatcaatacaatttggcgcatcgccaccttttaccatttctacttttgtttttatgtttcggcgtgacttggcacctgatgcggggctgcatcggtgttcgatctccagctaaggggtaagtccaatgttccgccggcccaggcaattgtatcgtttacgtcggcgtcgttcaaggctgcatcagtacattcgacctcttggattgctctggtttggatgatatattttcctacctatttatcatatgtctctgttaatctagtcttagcatatcaatttagctctatcggctgcttctcgttttagggtttctgccggtatcggctaaatcgcattgctagattagattagcttagacatctaccaccctgaaaactcagtcaacggcttgattgtctagatatcatgtttcttttcatacttagtgttgcatcagttaagtttgatctagtaagtcatgcttagaaccataatctctagcctacttcttgattgccaataagggtttcatcggggtttcagccggtgagttatctggacgttgcatcggctcataaggattgcatatacatataagttgtattgagccgatgacaacaaaggtttcactgtttaatctaatcttgtggatttcatgacatcggacctccagccgatgtgtgatttaaccttcggatcgatgcttatttatcatatcattgctagccgattggtttatattggattatattgttattttattacatcatcatcagccgattgcctttatatcattatccacattgtacatatagccgattgcctaaaccctatcgctatcggctggtatcggcatcagctattatcggctatcggctggaactactccatcggcttgtcagccgattggctgctttgatctactatttgcatatctgcaacttgtcagttgcaggatcaaactgactggcacgcccgcatctcatcatatttggacctgcactggagttaagcagatctcccaggccggtgtgttcgattttttcgtcaacactttccctcaatacaacccccccccccaaaaaaaaaactaaatcagatgcaacaatcctaatctgacattgtccctgggcttcactgagcccacggccccgaggcccggaccaaaactagttgatcatctttccgatgtctccaactcagtctgcttgctccttcgcggttgccggagagagacaagcgagcgacgagccaggctaccaccaccagcgccgccgcggcgatggcggtggagatgatctatgatgtgaaaactcgcccatcttccgcttgttcctcacccagaggcggcgcttcgcttcctccaacaataggtaagtgatgccccgcccctcccctcattccttcttccagaaccataatcttttgcttccgcaatgccctattgcttcaaaactcaaaaatccttcctgtcatgtcattggaagtattaattttgttttatcaggctgacagttttgcccaaagcaaaatgttactccctctgtttcaaaatatagtaatttatagctatttatctagacaagcatttcagacatatagctaaaaattactatattttgataccaaggtgtagttaactgctaaacggcatgacatttcataactgtatacacaatggtacatttcagatggttagtaaatggcaattgcttttgtgaccgaagagtcttttttaatacagtatgtgataaagatgaatataccgctgacgggttactaggtttgatgacgggggacctttggttatctacgtgttttgagcatcgtacattcttaaaaaaaattaagtttgaaagatactactttatataccatctgactagaaaccctatcttgatgctcacatgctgtagaaggaacatgccaaattaacggttaggtttatatacatgatgttctgttggagggttggaaacctctctcctctgcacgcaaaacagagcaatagattaacgcatgattacttaaatattaacttaaaaaacttgaaaataaattaatatgatttttaaagcaactttcatatataattttttttcaaaacacgtaccatttagcagtttgaaaagcgtgcacgcggaacaaaatgtgtactatgttttgagaaataacatgtttgaaaagcgtgcacacagaacaaaatacgtactatgttttgagaaacaacatgttttggcaaaagctggttgtatatgatccaacacggatttgggcttttgccaactaaagggctaaggccagccatacaaatgggcttctctgcttatttttcttcaaacagtaaggttgttttgggcagaaataagttcatccgaggtcccttaacttgtcaatgaatctgatttccgtccttcaaccggaaaaccagatacaaaaccagtggaaaataagtctcaagccagtttagacagcggtttcagttgacgtggtgctcacatggctaatttaactcggtatttatctgacatggcacataaagcaaaatttaacaatttaataaataaaacaaaatatgtgggcccacatgtcagtcaaataataagattaaaaaatagtggggcacatatgtcaatgggccccacttcctccacctcatcccctctcaacttcttcctcttccctagatgtggcaggcacatgcatcgaccggcatgccagcgagcgatagcggaggcgtggggaggctggcgagcgggggtggcaccgggaggcatggaggtgggcgagccactcaccgtgagatggaaggcgggcacgacgactggggaagaagacgaccgctaacacaactccaccgccctagacttgagtgagggccgcacttttgctccccctcctcccctattcgttcccccatccacttctggttgtggcccctgacgtggctcagtcccctcctccgcctcctccgacgtacggtgagggcggagctggagcctgtctgggcatcgcgccaccgacgctctcgggcttgtataaggggaagaggaagagaggttgccatcaatgcgagcgcgaccgacagggtgcggccgaagaacacaacggccaagatgggacgatgcatcgctcaagctcatcagctccctctccctcacctccatcctctcctcatcgaggaacctggccaccgaccgtcttctctctctaggcgtgacgcccatcgtctctacttgctcctctcctaacggccgctttgcaccaccccttctccccactggccaccgccctttccccgccgctcgtcagccgtcgtgcctagagagaggagaagagaaaggagaggggagagagatgaagagaggggagatggggagatagaggaggaagaagcccgccaggacagaggcgatagaagaggaggtgccacgcccggaaattcactaataatttccgaactaatttgtgcataaaatcctcgtccaggaatcagccgaggtacacaaactgataatttaatatacaaatccatcataataataacgttacatacttacaaaagaaaagaaaacagcagcggaataacagtctagcgatggcttcagctccactcccacaggcagctcaactggggtataagccaaacgtcttctccttctggatcctttttctttaattgaggttgattgattattgcaagaatgagcatatgacatactcaacaagccacacagcaaatatgcaagtgcacaaggattccgaaggatggcataatatagggttcatttgcgaagacaacatttagcaaacatttaagagaagtaaaacagtagagtaatcaatcatcaattttaatcaacactgaatagcaccccaatgctgcacaggcccaaccaaacctgaacaaccaaccccggtcgtacagatcaaacctccaaaccaggagctaaacaaattattaccagttatagcatcaataattatttgtgagatgtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactagaaagtacccgaatagaggctgtgacaataccccctgcacaacacaactcaccacagtgcaccattcctgaatcataatcaccccctctataaatataaccagaggcatggactccccagcgacccccacggacttctcgccgcttctcagtctgatgccccgcaatgaatcatgctatacaaaaggtaaagccgttgcccacgctggcttgtggttggtacggttaatgtttcacaacagtagctcgcgaaccggtccttaattgtcatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaaaaggttcacaccacccggtgacattcgaaaataaatgcacagttaaaataaatagagaatttaaatatagaatcaacatgctcaaaggattgtgtttaggatctgtgtgacttgccttgcaataatcggtcttcaattaatcttcttgaacacttccgacgcactcacgaaccttcgcaacgacggaaacgacaagctaacacgcaaaacgaagaaaaagactaagaaaaaccaaataaacagtacaaaacaagcataaacagtacatgtggatatttttaacatgtagattttgattttagatgaatttagcaacttgaaccactcgaatccgagttacg

SEQ ID NO: 5445 - DNA, 2284 bp, Oryza sativa
atatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaaaaggttcacaccacccggtgacattcgaaaataaatgcacagttaaaataaatagagaatttaaatatagaatcaacatgctcaaaggattgtgtttaggatctgtgtgacttgccttgcaataatcggtcttcaattaatcttcttgaacacttccgacgcactcacgaaccttcgcaacgacggaaacgacaagctaacacgcaaaacgaagaaaaagactaagaaaaaccaaataaacagtacaaaacaagcataaacagtacatgtggatatttttaacatgtagattttgattttagatgaatttagcaacttgaaccactcgaatccgagttacgatgatttagttatgaatttccgaagtttaatcgattttcatctaataaagaaaacctagaaaaagggatttatgacgtcatcactgacgtcatcatcgccggccatggcacggttgtcacgaccaccggcaaaagagggctcggttgggccatccgaggacacctacgcgtagaggacgacgacgcgaactcaccggtgcaaagaacaacgacggacgacgacgaacgacggccggcgacgaggttcaatggcggcacggttcggcttgacggcggcgatggcgctccggtggtcttcggcggctgcgaaggggcggacggggttcctctcctccgtgcgcacccgacgacggcgacggacggcagcggcgacggctaccgcggcagcgcaacgcggccggaggatcgccggcaacggcggcggctagagcaaggcggcggcggctctacgggcgacgggggagctcgggagttggggcaaacgaaagaggacgaccaggggatgctatttataggcttggattgaagagatcggactccaaccgagaggaatcgaagccggaaaaaccgagggttagttggagagataaactcgaaaacgaattcgattccgcgttgatttcttcgggataaagtccgattcttgggggaaaagatagaggaggataagaggaatatttcccctcaactaattttgcaagcggagcatgggatgcggcggatttggtggaggaagcggcgtcggctagagcacaggacggcagctcgggcttctgtccaagcttgaagatgaacagtatacgggacgcaattagactttcgtcttgggctggctgaaaaacaaaggaaagaaagaaagagaaggggagctcggctgggccgacttgggctgcacagcacgcgcgcgaaggagagagatgttgggctgaaatcagcccaacggcttaggagaggatttaacaactttccaattaaaataatcactgaaatgatctttgaattgttaaaaatacttccaatgctcaaatagtttcaagaaaaatcctgaaaatacttggacactcaaagtacttaaaaaaattataagcagaccatttaatgattaatttaatatgtgaataattactgaaatgttctttgtatggttaaaattaagagttgagctccgaaaaatccgaaaaaattccagagaatataattaaccatggagaatttaatagaaattaaatccagccatgctttttatttagaaaattttatttcccacatttaacttctcttgtaaattaatgaacatttaatataacttctaataataatttattaaataatttataaatcctgaaacgaaaatcaggatgtgacaggaggggagtgagaatgacatgttgggcccacgcggacccctccattttaattattttttgttgtaactgacatgtgggcctacaatttttattattttccagatcacattgccacgtctttgccacgttggatgaagacttagttaaaggagccacgtaggcatcacgtcaaccaaaaccggggtcagcactaccgagggatctcgtttgcactagttttgtaaattggggatgtgttgtttccggttttttggttcaaggatgaaaatcgtattcggtgtaagttaagggacctcgaataaacttattccttttgggtacatgacatctcatatcggtgtttgctgtgtcggccttatgccagcatcctgcatcattattggtgttacttctgttattattgatatg

SEQ ID NO: 5446 - DNA, 8320 bp, Oryza sativa
  unsure (1)..(8320): unsure at all n locations
nnnnnnnnnnnnnnnnnnnnnnnnnnnnnnnnnnnnnnnnnnnnnnnnnnnnnatgaagacttagttaaaggagccacgtaggcatcacgtcaaccaaaaccggggtcagcactaccgagggatctcgtttgcactagttttgtaaattggggatgtgttgtttccggttttttggttcaaggatgaaaatcgtattcggtgtaagttaagggacctcgaataaacttattccttttgggtacatgacatctcatatcggtgtttgctgtgtcggccttatgccagcatcctgcatcattattggtgttacttctgttattattgatatgtctgttgaaagttggaaccatgtatttattgtatctctctgtatcctctttgatgaactaatggtttgtgtacatttctgaattcttatttatagccttatggtccagcttcagacatctgagactgatagctcagtcaataaattcagacaactcatctcacctcgtgaattgtgcagtaatttagatagtttaagcattatggatatgatttcgttactagaggtgtaatagcgtgttacatcgggtatattatatagggtatcgtatgggatgttcgggcactaataaaaaaactaattataaaatctgccagtagtccgcgagaaaaatttattaagcctaattaatccgtcattaataaatgttttactgtagcaccacattgtcaaatcatggagcaattaggcttaaaagatttgtctcacaaattagtcacaatctatacaattagttatttttcagcctgtatttaatacttcatacatgtgttcaaacgttcgatgtgatagggtaaaatattttagggtgggatttaaacaggcccataatctaacttttttattattatgaacaaaacaaggaccataattgaggtacaaaatgtgcctttttttctcttttacttatatcatcaaaaatatattttctcacattatccttatatcatcgcaaaccatcctttttccattattttgtgttctaacatgccaaaatcattttgtatttaccttctcgatattcgatagacatggaagtattatttgtattcgtcttcgtccttcattataatgttcacattatggcttacttttccatagtgagaactattcacagtccagaaattatacagaggccaatttgagtatttctgtaccaactatttgccttaatatttatgtgctattaatgaagcaccgatatgataggttctctagttacgagtgtatatttagtactcctgtatgttgattatttcatttggcaattttcaggtaattataaatcatctgcataagcagtgttatcccccgaccagtgattgacccggtcaggtcttcggttgaaccgtaggttttctttgcatacgttcattcagggattatgggcttgcttactttgacgttactaccaatcctattaaattttgatatgagtaaattgcatattcacggtacatcaacttagtaagttggtgcaatttagtgaaggaatttgagaaataagcatgctatgacaacaacatgctaagtggatgcaacgtagtacaacaacttaataaatgagtttatgggtacgactatttgaaaggtgggtgtgattttgatgcaataacttgagaagtggtgtaaaaacttaattatgtatttttggctatatgtaaacagtttttacttacccagttgttaataaacttatgtagatttgtacaagcatattttctttgtcattctagtaactaaaagtctgagtaaaaaaatttaaaagtaaaaaaaattactgtgtagaaattttctagttgatatttgagatggtaaaaaaaaatctaaatcaatggtgcaaattaggtgaacaatatattcttacagattacatcaaacattataagattaattatatctacggaattgctatgtgatgacatattaacatcgtgaaaaaacttacatagcactcattaaccaaggtagcacatatctagccaagttattgcaccaaaatattaaattatcaaattcttgtattaaagtgcacccacttgctaagttattgcactttagacgtcacattcttcttgtcctaaatagaacccacgtatcaacgtgttgtactgtgggtgtaatttactcttttgataaagtaaaaaactgaacttatacatatatagcaatgctatcttaccaatatttggtaactttacggcttactcggtttggaggaatttgaatccataggaataggaaaaatgaaggaatataaatgtttgtacacatcaatctattggaatttttctaagagatttgactggatggaataattcttatgtttcctctatataacttgtagaaaaggaattttttttctttggttttcttatacttcaatcatataaattgaatgacactcataagaattgatctttaggaatccaaattctttgtttttcctccaaaacgaacaagcccttacaagatttcactattgaaaattccctcaaattgtaaggttttaaactaaacatatccaacagtattaaaatttgataatgtacaaatgtggcaaattttagtagggtaaaaagtggctacaaagttaacaagcccttatatatgattggttggttgtatcacgtgggtcagaaaagactaggtagttctatgggttttcgctggtctaaatcgactcgactccagagatattcccttcgtcctaaaaaaactcaacttctggaatttgagttttatctcataaaaaatcaacttctaacactctatctactctcagcatataaaacgacaagttttatcccttaaataccctatacctacctatcactattactactttttctaataatgataggtattttggtcatttttactctccactactttcttaggattatagggtttgatattttgtgggactgagggagaagtctaatagcctggactgaacaggtgaaggtgttaggtctggccaaatcgtggtcctagcgtttcgagtgacttgaaacgataatttactcgttattctttaaaatgattttcaaattactaaactgttattgtgtgaaaaaaattatatagaaatttctttaaaaattatattaatctaattttaagtttgtaataactaatatttgattaaaattatacgctaatgacttatctagttttttctcagccaacactgctggagagatgcacatctctcccagttcgtaaccccctttattcccgggtaacgaaccggaagaaaaaatccgggattaaaaatggatttttagtcccggttggagactccaaccgggagtaaaaataaaagcgccacgtagcgctttctctttctcttttctttttttattttttttgctactttcatattgattttgcactgaagtcaataataaattcatccacacagacaaaatcattcaacatcacagattcatttgtaacttcatagaaatatctgaaaatcatccacaaatttacatcacaaaatcatccacaaatccacaaatccgtcagcggccgcctcccatccgcgccgccttctccctgcgcccgccgcctctaccaccgcgccgtcgccacgcggggccgctgtcacccgccacgcacaggccgccgcctccctctaccgctacgcgggctgccgtcgcccaccacggtcaccgcctgctgctgctcaccccgccgggcgcggccctaccgccgctggccgcctgcccgctgccgcggatgacaggaggggaggggacgagaggaggaagggatctgaggtgttggaggctctcaaatccaatcttatctagatattttggtgaggaggaaagtctcgtctgggacttaaccgaacaaatatggtagagaaatatttactcacggttagagttaccagccggaactaaagatggattttcagtcccgggagtaaagatctaaataatctttaatcccggttggtagtaccaactgggactaaagtggtgatctttagtctcggttggtatcaaccgggactaaagctcctcggccccctgacaggggatgaatcaggactaaatatcatctttagtttttaaccaggactaaatatcaaaaaaatttaaaccgggactgaagaacaccaaccgggattaaagatcaatttttctttaactgggactaaaaacattttttgttagaaccaaaactattatgaaaatcagccgacccagtaaagatcacttctcctgtagtgcaaaatgctaagtagaacttaccctaataacacaatacaccagtactgtacaaggttaaaagacccataaaattgtcctgaattacatgaaaaataataaaagtgaacagcgatcaatatttatgcgtataatatgatatttaacaagttagtatctgaatgcatttactttcggctgcaaaatgcaaattacaagttgcttttagaagaagcttgcacatatattttcacgccaaaattggaagtttggttgaaattggaatgatgtgacgaaaaagttgaaagtttgtgtgtgtaagaaagttttgatgtgatggaaaagttggaagatcgaagaaaaattttggaactaaactcggccttatatagactttacgcctttacttgccaggaaaatgctctctgttgtacctgggcacattttataggtgtatgctataaaattgtgcacatcttatgagtgtgttaagttcacgctaaaattggaaatttggttgaaattgaaacgacgtgatgaaaaagttaaaagtttatgtatgtagaaaagttttatgtgacgaaaaagttaaaaatttgaagaaaaagtttggaaataaactcggcctaggtatctacatatgtgaaagcaacaagctttctcaaaaagccaggtcatgtgaataataatagccttaggatgagagtaggaataaaattggaccgttggatccatttgtgttataccaatcacacatcaggaaagttccagattaataggtcctatgcatcgatcggtgtatatacatatagtttcatatggtagtagtgaaagcaaaactagtatagatggagagcaccagcagctcgtctcattgacccgcaactacagaaatccatccaccgtagtgccaattctattaggccctgtttagttcaaaaataaaaaattttatgctaccatatcgaataaattggacacatgcatggattattaaatgtaggcaaaaaaaaccaattacacaaattacgtgtaaattgcgagatgaatcttttaagtcttattctgccatgatttgacaatatgattcaacagtaaacatttgctattgatggattaattaggcttaataaattcgtctcgcagtttcctaacggaatctctacgtttaatacttcaaatgtgtgtccgtatatccgatgtgacaaccaaacccaaaaattttccccagttaaacaaggccctactcccttcatctcaaaatatagctacctttaatatatataatttatcctacttcacatattccttcatctcaaccaactacaaccattttctatttaatttcatcatatacttctttatcttaatcaaccataaccttcacagtttctatcaaaaacaaaaataaaacacaaccctcccatttaattttattgccctctccttaatcccttcaaaaaaacataaaggtatctactctctatctacaaatataagcatcacaaatgtttaaaatttattcaaaaatataaggatttatataataacttaccttcaatctaacctcccattaaagaaaaaatatcttactctcgactattttctcaactcctatcatttctcggtaaagggatataaagttttatatgatcgaacataatctttcttaaacaatataaaaatccttatatttgaaaacagagagaatagtctcacaaaaattatcctgtaattatcaagatcagtcgtcaactcctatatgctggttatgccagcgctcagggtcgcgcgaagcgggactgggtggctagtttaggtgcttctagctgcaacaacaaaaaatgcgaacgctagctgcaacaaaatcactgcaatgaaagtaaatctctgataccgatttctgggtctaggctcttgtttttcatttaggcgcgtggcaccctacaaatttagttagagctcactcaaaaactgccatgtgtgatgggtgaagtattcgcatcgaaagagatcgggaaaaaaaaccgtaaacgtttgcctgcgtgcgtgtgcgggatgggctttgcatctagctagactgtgcgaccttgggcctgggcctggccctggcgccccacggccttttctgcaatatgtaccgcagtccgcagtactggtgcatggcctcttcacgcagcggtaagcatgttcgttcaaaagaaaagggaagaaaaacagcgtgaaggactgaagtgtatagagccagtatagaacaaaataatagtaataaaaagaaaaggagaaaaactaaaaataataggattatgcaatcaactacaattactcaaatgagggaaagtcacttcatgttagcatcatgtgtttctagaaaattagaaaaaatagtgaaattaaatggaaaaaaatatagcagcagcaaggattgtgttaggacaatcgaaagcctccaaataaatacaatctagaatgtttacttcaaacgaggaaaatacctaaaattctatagaatggaaagaataaaaagtgaaattagatgaacagatgtattctctgttaaccgacaagttcagcactactttcctattaattcagagcattttgtttttcctttattaatcctcaccttatactttttctggatgctaggaatccatttattttggaacatgggtaagtaacgacaataattttgctatattttttgtttgtgaaacacaatgtagatgatatacacacgagcaccttttaagactaggccgtcagacatatatttggattgataaagatcggtaggttgcctatcattgaaacaacaaatagtggtaaaatgtaagaactcgttctaagtctataagtctattgacctgaacctgtataggcacggaacctaaccagctgagctgcattagaatagctggatatataaaaacaagataagtatctttaccatgtcgatgtccctttctctaaataaaaccagtataaataaacaggtaaccgaagacacattatatgtatttcggactaattatacaaactatatgacttgcaagtttataacaatcgcgttgaatattaataaaaacacatttttttcactaatatatatgatctttaattatttcttaacgtaaatattccgttcagcatgataagaccacaaattaggataattttactattctaactttcttttacaaacataaaatttgaaaaaaaaattaaataatcattttaaacctattatttctaaaagaaaatatacacatgctataaactagctagcgtgccaacgggcacgctcattttctagtgttttcctaaatgtagaactggtgtaacagaaagcagtttttatagagcgctgtagttctttaaaattgtagcaatgccatactggaatttttgcagggtggagttgtagctgggtcaatgttgcctgcatagtgcatttaatacagtccactactgatcagtactttgccaggaacatcaatgcatctgcatctaccagttcggaatatgcacgtaagtttccggtacacacctcgtacgcaactagcaaatatcatacttcctccgttttataatgtaagttattctagcatttttcatatttatattgatgttaataaatttatctagatatatatgtctagattcattaacatatagaatgacttacattatgaaacggagggagtataaaattttagaaaaaaacacacatatttccactaatatatatatctagatgtgaaatcttatcttcaaattcattatgttttagccttaaaaagacaaaattatgacatttttaccctcaaaattatcagatttttcacaaatataatgaatttgaatagtaggagattttacaaatatgtgtaatactattagacgtaaatgtctatttttttataaattttttatgacatttactagttggtgttaatgaatcgtgaaaaggaagtttgtatgcataagatatgtcccctaactagttctctttaggtgttgatatgatactccctccgtcct

SEQ ID NO: 5447 - DNA, 2468 bp, Oryza sativa
ggcgccaacagcgaggttaggtgccgccgccaccgcctcctcttcttctggcgccgccccatcaagctcaccaaatccggcctcaagttcaccggatctggcgagtggcaccattttgggggctcggcgcggtttgctcggggcggtggcctcgccggtgaccgagaggaggagaacgttggaggggaatagcatcatggcagcgcgcgaaaccacggagcgacgaggcgatgacctccacaacgccgcgcccccgcctttctccccgtgccgcatacctcgattccagcgaagttcgtgtgaccagttttggctccgcggctggctgacgtgtcgtcgaatattcggttctcggcaacaaggctgaacgacacatcctcccactgtgaacgccctaagagaaactgaaccgtataaattactgaaaatatgtctgaatgctttacatgagaaatataagaaaattaacaattttggtagcagtctctaatgggtagtagaatcaatcttagtcctattttctagatatatggtacatatctatctacactgccatatcacctaacagtagtaaaatagtttatttatgctggcactaatagccataaatcaatggtttaaattgtttctactaatgataataataaatatttggcagtgcttcaaagaagattatagatttgtagaaaggagtgatcttcttggcctccttaggaacacaaaccttaccaaaaaaaaattgcaggactttcacatggattagttcaatcctgtaagaactaagagaaaattcatgtgctacaaaggatccattgaaacagtccctagaatattcgccattgaattcctccatttttttctaggatattcttatgctaaagaaaacctaattcataaacatgcacgtgattggcatcttgcaaacactacataaccgcataatgataggaagttagggttagtgttagggtcaaggaggtggaggggggagggcctgaggggaaagctgggaggtggaagtggtggatcgagcttagaagcatggcatgggagatggcgcacaagtggtaggcagtcggtgtcaggaagggtgggaggcgaggcggtggtaatggcgatggcgatgccaccaaagccttgggtcggtcgcacgtggggggcaaagcgagtcaacaggtaggggaggaggccgaccaggcagagccgtgccgacacattgatgcttttcgacgccagcaaggccaggcggtgatggtggaggaataggaaatcgaagctaatttgtgtttggataacacgagagaaggagcagagggagttcgtcagagatatcttcgccattcccattgtccctgtcaccacagaaaacagtgtgtaaagaagataaggcagagagaggagtaggggctaatggattgggctatcgcaacgtgttcgcggtctacgaacacccgccattagacttacctttattgaaaccatgggatactagcaaacactaaataccattaattactataagtacgtaaaacatcttgctttagagcgttttgacgaactgtcagaaacattttggcggcttatcagttgggcccatttgtctgtctcagttggtaaaagtactcccgtaatagtgtctgtactttgtactggtccacagtaatagcattcattgtagttgtagttcacacatggagcttcagaccaaaaaaaaaatagtttacaagaattaaataagtctcgtcttatgaagtgctgtaattcgggcgccaatgcagaagttataaagcagacatagaaaaaaattgcaattatttcattgaaaataaagatttgcaatcttttggaactcgaaacggaaaggaccatttaaaatttggacttcaaatgggtggtaggagtagaacgttttgacctttgaacgacgaagtcttgtcgtgaagggattgcgtacaagagcttcgtggcctttgagctacgcaattcctactgctgaatgaaggcaaacctcgaagtcctgaacaagagcaaaggaaaaccaaaatcagttactctgatgtctaaaatagtaatccctccggccatgaaaataagacgtatttaatttattttatttcgtttggacgagacgtggaccaattataaaaaacataatcttaaataattctaaataatgacattatttttatgcaacaaaaattatgtccatttaaagtaattattaatcaaagcctaatcgtaacaatgttttaaatagcggaataagacatttagcggttagttttctcaaacagatatagcagcttaattgtacatgagagcaaatagctagaaccatttacaaatggctatagccggagagattgtaacaaccaaaatacacctctataattttcaacggagtgagtatccgacatcgtgcaaattcttgaaatttacaacttcctgttaaattcgaacaatgggga

SEQ ID NO: 5448 - DNA, 1129 bp, Oryza sativa
ccatttaaagtaattattaatcaaagcctaatcgtaccaatgttttaaatagcggaataagacatttagcggttagttttctcaaacagatatagcagcttaattgtacatgagagcaaatagctagaaccatttacaaatggctatagccggagagattgtaacaacacaaaatacacctctataattttcaacggagtgagtatccgacatcgtgcaaattcttgaaatttacaacttcctgttaaattcgaacaatgtggagattttcggctacagtggaatttcttacatgtactcggggtaaccttaaatccgaaaatcccaaaagattcaaaccatggtggagccaaccatttgtaatccttattattactagtagtattatatttccgtataattacacatggcgcgaacccgtgccactgccacaccctcccgccaaatcaccacaaaacccacccgcacacagccactctctctcatctcatcatcatcatcaaatttgcctctcttttttactcctcttcatctctttccccctccatgccaaagatcgccactgtgcgacaccacatggcaccacgccgcaacgcgccatgctgcctccactgattgcgtgcgcgtccaggccaagctccgtggcacccatggccgcgcctaggtagcagctactagccgacgaagccaagccacgccccaccgagcgaagaagacgacaatggtggcgccgcgccagtgcgccgacagtggcggcgatggcggtgatgatggcgacctcctcgaacgcgacgcgccgctgcggctggcgctgtccgtgctccacgacctgctcggcgtggccgccttcgccgcgtcccacccgctccacgccgcgtacgcgctcttcttcgcgcgccacctcctcgcgctcgcctgcttcttctccccgctcctcgccaccaccgcgctcctcctcgccgtcctcgtcaccgtcgccccctgcgccggcgcccgccgcgggggggactcgccgcagaaacagtgctcgatagggtggaccttcggcattgccgtaggcgcgctccgcgccgagctcagaccggaccccgacggcgctggcggtggcgcagtcccgctccttgcccag

SEQ ID NO: 5449 - DNA, 2690 bp, Oryza sativa
aagaaatgcgagcctcccgcgaaatcgctttcttcggtttctcgaagaatcttgcagtggaaggcgcaggcttctggcaatttcaagaaagttcttgatgaaatggaggagaattcggtggatttcagtttggagaaagcctcgttcctggatttcaaggaatgcaacaaattggatggtggagcttacactgaaaaatgcgaagttgaagaaattgcttctgttgcagagtctggcatgcaccaagaagaacaagtattcaaggatgtgaaagaatgcgtgcaatctgaagctgaaacctgcactgagaaatgcagcaaggaccagcaatctgaagaaagcgtagtggtggttcagtctgaagaagaatggcaagaagagaacctcaaaattgttcttcctgagccagaaatgcaagatcaggagtacaaagatgtggaacctgtcaaagaattgcaggatcaggagtacaaatttctgcaacctgaagaagaagaagaacagcaagaacaagattctgaaaatgatgcacaacctgaagaacagttacaagagcaagattgtgacaatggcgtgcaacctgaagaagaagaagaatcgcaggagcacgagatgcgactgcaagaatcgcacgatgatcaggaggaggagttcaaggacgcggcggaccaagaatctccaagggaggatcccctccggccgtcgacgtcgatcgcgcggcgggtgcactcgcggacgtcgtcggagcacctcctcgtcgtcggcgaggggtcgccgcggaaggagaaggagtggaagcggacgttggcgtgcaagctctacgaggaacggatgcagctcaagctccgccgcgaccgcgccgtcgtcgagtcgtccagcgacaacatggacatgctctgggaggcctacgaggtcggcggcggcggcggcggcgccacctccaccaagggcggcgccagcaaggcgaaacgcaagcaagaacgagccaccgtcgaacgcaagcaagaacacgcgaccgccgacgaggaagacgacgacgacgacggcgacgaggaggaaggctcggtgaggcagctctgctgcctccaggctctcaagttctcgacgaggaagatgagcttcggcggcggcggcggcaagccgagcctggccaagatctccaaggtgctgaggagggtggccgcgttgtcgaggtccggatcgcggcgaagcaccaaaggttgaagaagaagaagaagaagaagaagaaacaccagcaatggcgatgaatccatccaatccaccatggactcaatgcgttgcatcaaccagcaatggattgctcactgtatttgtgctcctttttaattgctcgaatttttcttctttttctttttctttttctttttcttttttgaagtttgtgtagatatatgatatatgtgtacccaatggtttcagagagattgggtctggtaattacagggctgtcactctggcatgctcaatgtaataaagcttaattgggtgtgtgttacttttgttagctttgtgtaaatttctccatgggagggactatgggtaaggctttggtgtctagttcagatttcaaggaggcaaaaggcaggctatgcatcatttctttctttgctttctgtgctcaactgatatatatacatatataaattctgaaaacaagaatggccaatcttgctcatatgatttatgcagattcagtgccatttcaacgcaaagatttttaacatcctaaatgaaaatccacatatttttgacccgacttctcaaatagcaaatgcgctcctgattgatcactttgtttttatatagttcaaatgttttatatcaccggactataccatcaaacaaagccaataagtttttttttactttagataaaaaagtatatccttgaaaaccgattctaagaatatagtacaattgcatgtaataccaaattcgtacaaaagcatcatatactattactaatatactaatagtgaagccaattggaacgtacgaagataaccagtactgagttaggctttattttttttggttattgaaaattatcatcgtggcaacaccatgttgatcacttttgagttacaatatctgggttcatcctgaattcttacagtcttaacacaatggcagtgacaattatctgaaacacagagggagtggcaaaatggcattgtttgctagtagaacaaaactctgaaggcagcatttgctgtcacttctcattgctccttgcatcccctcagctctgcatgtctcacagttgcaataattcaagggcagcaaaagggtacaaggaagggaccaagctttggttcttcatcctccctaatcttttgtgcatcactgtgtgtcctccttttcggaagcacctctctgttgcaattgaaggctttttctttatcatcatccaggcccatcctctctctctctctcagcctcagaagtgagtgagctctctgttcccgctgacactggacactgctggccctgggcagcagctcagcatgctcctcctgcaaacattatcagtggtgttgggcttttacgacacctgttgctaatctgcattttgcacgagttgtgccgcttccaaggctccaattacaaaatcatgtcaattttattaggaactataatgttatccatttgattgggggatcctctag

SEQ ID NO: 5450 - DNA, 14971 bp, Oryza sativa
agtggtgttggctttttccgacacctgttggtaatctgcattttgcacaagttgtgccgcttccaagcttccatttacaaaatcatgtcaattttattaggaactataatgttatccatttgattgattgagtccacatatcaatcataaaaagagggcaaagttacagttttatattaaaatcattaaatatatgatccgtattttagaatgtaatagttctttacctactagcattactattttttcctctttatatatcttttgcaagagccggcgccgcatgggaggttacaatggtccattgtatcccatgcattgtaattatcttctctatattaatcattgccggttgatatgcccttgtttttttaaggttgacatgcccttgttttttgtaaggatttttcacataaaaaatgtgtctccattgtgcatctgctttcataacaaaaattgtttgttattgttgtagttttgtggatattaagttagaattacacttaagtattatttttgataaaatgtttgtagttttgtgaattttgcacacttgacaactccctgtcacacgtgcgcatgaataaaccctcgttggggcgcctacatgccctaattgtagtctcgtagataatctacaccgagcttatataagtaacacaaggcacgtataaataagatggagatgatgttgagatgttaagtgcagagaaagttagaatgatttttccgtgtggtcttaagttggaggattggtggaaccctatttgtgttctctctttcacaatggttcgccatggtattagtgcaatttaatgcctctataaaatctatcctctctcttctttgacattaaaaatgctgtcaatttgtattttatacgtagtgatatcttgcggccctcatcttttcgcttatgcttatatttatcagtcaaaatttgaattttcaaccataatttttcaacctttattgtattgcactggtaactagaatatggcatacaataagttctgaaaaatgcaaagctgtttgttgggatctattaaggacaccctatatatattgtagaaccagtaccctataaaggtggctggccttaggatggtcgtagtatttttgcataaataggatgagtaaaagagattattgctggaattattggtgtaccttgcggtacatgattattgtaggctatatctactgtcgacgtaaggtcagaccaatcatgcatgttgttgttcacatagaagcagcttgctgaatgcaaacttggcctgtgcatgcgtgtcctagcttgcataggaacagcaggtctacacacatgtacagtcagggaaaagtgcatggatgctcaaaagttgatatctgtctgtccgtcatcgtgtaattttgacagagttgactttttttaaaactttgaccattggtaactttgaccctcgtataatgccgtgtttagtttgtgtgccaatttttttaaatatacggacacacatttgaagtattaaacatagactaataacaaaaacaaattacagattccgcctgtaaactgcgagacgattttattaagcctaattaatccgttattagcaaatgtttacagtagcatcacattgtcaaatcatggtataattaggctcaaaagattcgtctcgcaatttacatgtaaactgtgcaattaatttttttcgtccacatttaatgctccatgtatatgtccaaacttttgatgtgtcggaatttttagaagtttgaaggaaactgaacactgtctaaggccccgtttggcacagctccagctcccaactccaacttacctagaattggagctgtgccaaatggtacatattctttatttttcagagtggagctagcagagttgctccataaatttgtactacgggggtggagctaggtttgtgctgctccacaactcgactacaccccaaaagacccacaacactttaatttttcaatgtatttacacaaaaataccactgaactacccctctacacacctctccctcgttctctctcttccacatcttcctcccgaccactctctcttcctccgtcttcctcccgacgcggcgaccggcggagggctatggtggcggcgtccgcgggcgcgcgtcagagtggtgaagcggcacacggcggcagcagccagcaggtcgcggtgacggggacgcacagggtcacaggtggcggcggcgcgcgaggtcgcaggcggcggcggcccaggcggcggcggcccgggcggcggcgcgcgaggtcacaggcggcacgacgtcggaggtgtgccggctgaccggctgcggcgcgagtgcggagcgacgtcggcggcgtgtggaaggaccggtggcggcgtgcgtgcggcaggggcgccacaaggtgttcgataaaatgtcgataagggaggtcgtggcgtggagctgacaaatctagccaaacactttgacaccaacctcagcttctattggatccagctgttggtatttcttacgatcacagataaatccgcaagcgcacagaataccgctgtagcacttcaccttcgggtgacccaaaaaagatatcgaactcagggaacgtgtgtaatctacctaaggctaagactatccaaggacaacaactgatggtaggtaggctaggctagagatgactttctatgagttttaattatctaaactaagcaaaggtaatttttcaactgatggtaggtaggctaggttagagaggattttctatgagttttaattatctaagctaagcaaaggtaatttcctatttgttgcttcgggtgccgacccctgctagtctgctagcattgtttcggctatagctctatgatgtatccgaacgtggaggattaggattacttggacgggattcagggctgtcaccacctgccgcctacctctgacaaatctgtgggatacacaacaaacaaaggtatctctaacctagacaccatgtctaagttattaattactactctaatatttgcgcaggaacttccttctctatccggagtcctagtacgagagcacttagtatgaatactaaacaatgaacccgcaaagatggaaatatatcttactcagactaaataattaaataacataagaaaggaacacgaatgcttactttatagaagttctccgaacctagagcagagtgtaccgacagctccggtactcctccagaattcctcctaggaagctacactcgttgaggtagaagtcggatgagcgctaaacttccgggcactcctccagagcttcccctcactctctaccttattctaatgtacaaaagatacaatagagcctcttgtaattcagctcaaagttgtgtgtcttggaatgaaagtgcagacctccttatataggctccaaatgacggttaggggtatgggaaatgaccaaaacaccctgcaactgccataggggaggaatccaagccgtccacgtggaagcagacggtgaaaggtcgcataacgggtttggccgaactggttggttcggccgaacccaaaaagtgtcctcccggcctctcctttggctggtaggttgcttaatgggcctctaataacctgcactatgtttggccccaattctaaatggtttttattaacttatggggcctctaatccgtgtaaacgtgttttgaatgaacagaggtgcattttgtcgtatgacggatgtgttttcacctcaaatgacctgcatacacatattgcaccaccactagtggtaatgattagtaataatacctaccactaagttggacaccatgttttatttcattatatatacgcaggtattgacggtcagatattatgatttaaggaccgtcaacaacacccccacacttaacctttgctcatcccgagcgaaggctatggactctacaatagagttatgacttccttactaacaatcatgcaaacaaattattcaaagtcatacctgtacttggggatctttgtagtgtctaccatgcagtcctgggcaattgagaaatggaacaatcttgattcaagtcaccctaacttttcaggaagaacaacttggggtttttttcaagtaagacgaatattataactttgctttgctcctccattgattctctcgatcactcaaagtgtatgattcctcacaaaggcatatgattgtgccttttcttttcctaccatctaataaggcttatgtggagttcagggtatggaaaagagtagagcattgcttgcatcacatatattgcaaagtaaaataatggatccacggaaatacaagacatactttctggtcaagaatgtgcatgtgtatgtgtatggtaaatttgtgagtggaaaaaggaaaatgaaaataactccttttgtatgcctcctcctccatttattttctcttttgaaatttgggagagtgcatggctatctttttttttcttttttttttctcatcatcatgctccatacttgtatgagcacttttttttcatagccatgcccctctctctctctcttttttttaaagaactttggaggaagaggcacaaatgacatggagtatttattttgtggactatggatgaaatgaatgacaaatgaggaatgctaacttccagtgtataagtcaagcatatgtgcgtgtatgtggggtgtgtgtgatcttgaccatgaaagtatgaaaagcatttcactagggtcacaaaacttgacaacgctttatgaaatgacaagcagcgtatgtagcaagctaatcatgaatgatcaacctatggctctaataggaataaaaagatcaatgaggaatttagcatcattatatgtttttttttctttttataaaattcccaagtgtacaacatgaagagcaagatttctatcatcagactatatcacattcatcaattaccttgatagcatgggatccctattggatttgtcactacaagaaacaagtaatgagcaaagaataataggcatgcatgttattttcagggagaccatgaactctaattgtaccatccctagcttgagtttaattatcttcgatattttagaattgataatcaaattaaactcaagatagaatggatgtcccgaggaaattgtgcaaacctgagccctgtataaaacagagaacgattcatgatagaggtggttcagttgaactggaggttcgactgtcccctcattggttctgactgcatcaattccccttgtgtggttcgtcatggctgatcactcctagggtgatcttgctttggtttcggcgttgatgtgcaagatcacccccacacatgtctttgtacctggggctctttattggacacaaaaaagaaaaacaaagacgagtgaagcaaaaaggactcacttggttggaagaccaaggagccacatttatttattttgttttattttcttgtattttctttttttatggcaacgatggatttggcaggatgaaaacatgggatgaggatgcacaagttgttgaggattcttatcagataggtcttaccaagctttgaacctcaattgaatgcaaactgtttttcatatgttctgcttggttccatgtgcatctctttcccatggacaaaggagcgtgatataagtgtttgaagttattgtacactgctccttgattgtcattttatttcctgcaaaaggttagtggacaaaaaaaaaatactcgaagcactacaaagattttatcatagcctcaagattaattgttcatatccatgctaaaatgaaattagatttaaaacttaagaagcatggatcccacaagtttgccaagattttattttattttgagagacagtccttttattctgaaacatttttttttcaaatttttattattcaccaaattttcatttaagcacaactcatacatggctgaggtaaatttgcatgatcatgctaaatgagcaattagtaatatacgcaccgtgcaccttgataggtgatatgtgtctcctttgcatgttagcaattgatttgttcccggccctgacctacctctattgtgaattgaacttgaggactcacccatcaatttgaaaactttcctgcaggggttagtccacagaagatatatatccaatgtctatgaacaaattaactatgagagttcattaatcaaactcgactccatgtctaatttgattaaagtagactagtttaacctaagcaccatgcttaatttaaaaagcctatggatgtctcgcgaaaacacccaaaacagagcatacgcaaaaagacataagaaacataaccatgtatactcaagtctcattcaaagagagataagtatgagtaaaagatgtggtgaatttttctgcctttcgtatacctgagtgcacttactgccaacatgatgtgtatgttgaaatctctggagcggtggtatggccacatatgattgttgatttctcctccacctcaatgcagattgtaccggaggaaggcgctttgaccataccaactcaggcaagcagtttggtcatgcacacacctcgggtgcaagaaccttatgccttgaaggcgtgattcgttggcacagagacgtaggatgcatctatttctgggcaaatatgcaagtgccaactagagtggagcagcaaacacctagaaaagaagagggcatctcctcttgcctacatgcgtgtaggtgttgcgggagcgagaagttgtgcacagctagctaggagtggataaagtctaaaccaaggtggcacatgagcttgagagagggactgggagtaggcagcatgattgctactagcgaggtgtatcgccatatttcaaagacacgcacataatgcggtctttgatccaaatgcagctcgtcagctctcttgctcttttcttcttctcccattttttcttcttcttttcttctgtctctcttttctcctcctttgttttattatctttttttagcaagctaggactaacaccaacttcaaactaagatggccctagttgatggaactcgtcatgaaaagctcgtcgaccttcccccccacacttggacttttgtgtcgcaagacatcaaaaccaagtgtgtgatgtcggattctcctatagagtgtgttccaataccaaggatcaccaaagtgtacagttgatgtagctaccgtgttcttaggcattgcatgaccctcgttcttaatctcaatctgaaatgattagtgaccaagaatacccgaaggtgcatattatcctaagaactggttcttgcttttattattaaggaaacttaccatgataatccagggtatctcctgacagtgctttgtttatggtcaaaagcttgaccatcggaacatcgcttctgcaagattaggccacaaacaagtacgagatttgcagtattatgataaatataagcattccacaaccatccttctaaacatgttagaaatgagaaccgaaaggtggttgtggtcctcaaacagggaagtggtactaatcaaacaggactctggggatttcttaagcgagcatgaattaaggggaatttcaaaataaaaactttcatgctcatatgtggaatgttttctctcgtcctccagagtcgatgtctcaagcttgtccgtggcctgaaggttctccttcacaactgatgcatcgtgcaagaatcgggttgtttcttggtgataaacaagaaaaacgttctgagggccagagggacaaggcttaggcttgatcgagggtgatgagagtcgttcagtttcatgaagatgggaaataggtccagaagaaacgaacgaagatacaaacatcacctcctcgaacggctcattcttgggatgagccttcttttcgctggaataattcagggtattctcataattttcataaagatcacccctgaattggaatggaatttccggggaatgaatttcttcttcctccggctccagcgactggaatgaggattcgacagttgagtcgggtttcgactccatgtgcagaggatcctcatggataatctcgatctccgggatggcttcgctttggccgaaagaatcgttctctaagatcaaatctaagagttctcttccttcggcagttgtcttgtgtgcgaacgatcctccgggggaaatatcgagatttgcggcagactccttatctaacccgtatcgaaaatgttgtaacaacacatgatcgggtagagacaagtctgggccagactgagttaacagtgaaaacctggcccaagctgcaccgagagattccttctcgttctgtcagaacgaaaggatgtctaatcgaagattgattacacgggttaatggaaagaaagcaaggcagaatctacacttaagctcctcccattacccgtggaatttcttgacagacaaagtgtaccattgtttcgcttcatctctaagagaaaaaggaaacaacttccactttagagtttcatgtgtcatgcctacgatggatagacatgaacacactagctcaaagtcccgaagatggaggtacgggttttcaccaacactaccagagaaggtttgatctcgaatgatggctataaggccaggactgatttcgtagccatcagaaaggattggttttgaagaacaggacggctcacaaagatcagcccgaggagcagaaaggttttgaattgcgggttgctccatcaaggaaaggaataagagaagaagaaataaaaataaagatacgagtatgacctagactcggataaattagcaaccgttccccggcaacggcgccagaaatgcttgttggtatttcttacgatcatagataaatccgcaagcgcacggaataccgctgtagcacttcaccttcgggtgaccccaaaaggatatcgaactcagggaacgtgtgtaatctacctaattatctaagctaagcaaaggtaatttcctatctgttgcttcgggcgccgacccctgctagtctgctagcattgtttcggctatagctctatgatgtatccgaacgtggagaattacttggacgggattcaaggctgtcaccacctgccgcctacatctgacaaatccatgggatacacaacaaacaaaggtaatctctaacctagacaacacgtctaagttattaattactactctaatacttgcacaagaacttccttctctatccagagtcctagtactagagcacttagtatgaatactaaacaatgaacccgcaaagatggaaatatatcttactcagactaaataattaaataacataagaaaggaacacgaatgcttactttatagaagaagttctccgaacccggagcagagtgtaccgacagctccggtactcctccagaattcctcctaggaagctacactcgttgaggtagaagtcggatgagcgccaaacttccgggcactcctccggtgcttctccccactctctaccttattctaatgtacaaaagatacaatagagcctcttgtaattcaactcaaagttgtgtgtcttggaataagagtgaagacctccttatataagctccaaatgatggttaggggtatgggaaatgaccaaaacaccctgcaaccgccatagaggaggaatccaagccatccacgtggaagcagacggtgaacggccgcataacgggtttggccgaacccaaaaagtgtcctcccggcctctcctttggccggtaggttgcttaatgggcccccaataacctgcactatgttttggcccaattctaaatggtttttattggcttatggagcctctaatccgtgtaaacgtgtcctggatatgcagaggtgcattttgtcatatcacggatgtgttttcacctcaaattacctgcatacacatatttcaccaacactagtggaaatgattagtaataatacctaccactaagttggataccatgttttatttcattatatgcaagtactgacggtcatatattatgatttaaggaccgtcaacaccagctcccactggagttggagtttggagcactaccgaacggggcctaagtaaggtttgtgtatatagctataccgctatatcgtgcaacagacttcaacaattatatttaaaatattcgtaacctcattaataaaatttagctataaagtttggatgcaaatatatagtgtggtggtagctggtaagtatctttttttgtaaaaagaaatggtgataagtatatctgagaatggaaaagtgccccttttcatttagaattcatgtttgatagtgaaagttgctcaaaaaaatctggcaaagattttttttttaagataatggaatgaaacatcccggcctttgctcaaaagagctacatcccattattacaagagtagcacactaaaagagcttagtccaaaataaagcaaatataccaaccacgaataaaagaaaagcaaacaagacaaagagaactactcgagtctgttggtgaatctctagccatggttggcgaaaagttgcataaccgtcgtctcaagattacgacatgcaacattcaagaactctccatcttcctcacacttttgcagttgagcccacagccgaagccaatatgttgctctgaaaattacctgcatataggaaacagatgatgatttatcaaaaactctatcattcctactcaaacacagagcccaacataaagcagaggcaccaacaagtatcagtttactctttttcttgtccacccccaaagccaaccataaaaaatatcagatatgcttctaggaaggtataatccaaaagaaaactgaacagctctccaaataaacttcgcataatgacaatctatgaacaaatgatgaatagtctcatttttcatacagaaactgcatcttaaactcccattaaaattccttcttgctagattatgtttagttaacacaactccctttagcaagtaccacataaagatcttaatctttaacggcatcttaagcttccaaatgaacttatttctatcaatgtaaccgttatttattaaatgtaagtacattgatctaaccgagaactgaccattctgatgataattccatctaaaacaatcagaagaatcatccaactggatatgagcaatagaagcacacaattcataccaacatgttagattatgtccaactaaagctctcctaaagaaaacattaagcggaacagagcccataacacttgcaatagaagcagttttccttctgacaatagcctataaagatggatatttatctctgaaggccctattccctagccatttatcctcccaaaatcttgtttgttccctattattcacaatccaagaacccatacttaaaaaagtatttttgacattcatgagtccctaccaaaaatgagaatcaccttgttttctgtcaacttgtgttatagacttattataaagatactttctcttcaataaatcttgccaaacaccattctcattaattaacttgtataaccatttactcaagagacatttcttttgaatctctaaattatgaacacccaaatcgccctggtctttgggttgacaaattatatctcatctagttaatctttacttttttcttatgatcatccccttgccaaaagaaacgtgatctaaaataattaatcttttgaagaacccctttcggtatctaaaagaatgatattataaacatagctaaacttgaaaggactgaattgatcaaaaccaatctacccccgacagacaaaagtttacctttccaactactaagttttttttctcaattctttgctcaataactttccaatctttgttactcaacttcctaaaatgcattgaaatcccaagatatttaaaaagaaaaaaccccagcttacaacgaaaaatactagaatatcgatcataacactcatttgcctggccaaaacaaaataactcaattttatgaaagttaattttcaagccagataaattctcaaacacaaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattggtgataaaggatccccttgtctaagacctttatgtgtttgaaagttgtcaccaatttgatccttagctttaataccagcatgtcccccttggataaaagaggatatccactcacaccatttgggagagaaacccttcatcctcaaagtctgttgaacaaatgaccattttatcttatcatatgctttctcaaaatcaatgttaaaaattactccactcatatttgtacgatgcaattcatgtaatgtctcatacaaaataaccacacctgcatgatgtttctcccaggaataaaagcaaagatggtggcataacatattttttgagaccctctagcgtgcacgtatgtgcgatgcgtgtagcataataaccctctaatgccgttatgtcaaagtccatttctttatgtaatttaagcaaagtccattttttttactcttgtataaaaaacggctttgtagtttatggtgaaaaatggaatttaagcgacgttcaatgagttaaaacggactctaccattaattagttttgtgattgtgctagtgttttaaggggggtctaaacagaggaatttttatcctaagtagaggcttaaaaaaggatggttactattaacacatttaagcgctgtcagatttggggcaatctatgtattcgattatttttcaattgtaattaattaattatttagtgttcgtaagccggactgtgcaaacatgcatattaaactaaaccggttagatttcttatattgaaacttatgtgcttaatttaagtactagatttaacactgatgctttcatgtacaactaatcatttttcattctttccgtgtttgccgacgtagccatcgataatgaaacatctccgatgactttattaatctcaaaatatcccggattaatctcttggaggagtttctataggtagagcgtacatgtgtatattgagtttccacaggtagagcgtgcataggtatattaattagtgtgtgtttttctgtatatggaagcatatgcgtctgtaaaaagatattaagcatttaacaaacgctttgcaggtagaggacagaaaagattgatagcccagcccagcgtcgccactgggccctttggtaccatttcatgactcggccgatctgctaggaggttcgtccgttcgtgaatggaataagttcatctgagatctgtaaacttgtcgacgaatccgattttcgtccttcaaccagaaaaccagatacaacgcgtctctcaattgttaaaaccagtgtaaatgaggtccctcggcggtttttactgacgtgacgcctacgttgctaatttgactcggtcttcatttgacgtggcattgacgtggcgtttatgtgacaattcgatctgcaagacagcaaaggtagccagtagccatgtacataattttttaaacaaaaatcttctcgaggaagtgatatgttgatcccaacgataactcctttctccttctcctctcagaaccctctccgatccctcctcgtctccggtggttcgccgccggcgatgggggaagagaggttgggggctccttttctttgtagatccgtcgtcggacttgtcctgtgtgtcaaattttcttgtagttgagagtttcctttggtgctcgaggttgtagtcgacgctagtcgtcctcatcatagcgccatcgcgactgcctccggtggttttgccggagtttgctcaccatgtctctacctttcttgctgctatcgtcaattgggtcatagtcagatcggatcaagggttggtaacgccgaccatattgtccctctccggcatgcaagaattaaaggtggcaaccatagcacgcttctacgttgaaaaaactgcagtaatgaagcttctacctccaatgtttggaggccccagctatggctcagctcctaggctgatccaggtgtgttgctttctctttttatctctgagactctgacagtgtatttctgtggtaaggctgagttccatcaggtttgccaaagccaaaacctcgttgagggattgagccaaggcaaaatctggtgcagctttgctatgggcaatcaagtcatctttgacgacagatccagcaaggcatgcatggaggacttgattgcttttcttgtactagcctagagcccgtacgttgcaatggaaaataaattgagtttctagcttattaaatcaattaataaaacacttatttagtctaagtaataatatgatttttcttattgaacaagtaggtgattttgaaatttggagtgagtcaatagggaaatagggaagtactcgctaaaatgtggtgtaacactatagattgtgggacccacatgttagtggtaggagcggtgatgttaagtgtacagattttctatagtcgtttgctaaattcaggacttttatgtatgttctctgtacccaaaagggaaagagattctgtgacttaactgctgtgcagttgagtcactgacgtgtgggccatagcaaagtaggacccacatatcagtgactcaactgcatgtcagaggatctgcttccacccaaaaggggttgtcctgtaagattggctatacgagcccagtccttttaataaactagtaatcgtgcacgtgcaaggcaccttgggagaaaacaacacttgcaaaagtctgttcacacacttaagttagaaatatttctagagcatgtttccacactgaatttaaatatatttcaagtgcatgttcagacaataacttggattttgtaagtacatatctactaagtccattatagaatcaaatagtttgtgt

SEQ ID NO: 5451 - DNA, 24317 bp, Oryza sativa
  unsure (1)..(24317): unsure at all n locations
agggaccgtataaaatatatgcagcctgtgagtttaggtgaaaaggaagaaaaaataaaatgtaatttccatgactgatataccaacaaaatttttgagtatggatgaccatggatgattgatccagaatatgcagttcagcagagaaaagcatatatctttattttgatgtacatgcattatctaacaatcttgagtggagtttgctttgtgcaagaatggatgtctggcaatggcatgacaagattgtgctcgatcgatatgattggatagttctacatctgcatttcttgaatctgattctgctttcgcttcagactaacaggtcatgaatcacgtctaaaatagcttatttggctgatcaagttcaatgaaaaaaacttaagaaacgtcaaaacccccaactgcatgttgtgcaccaaatgtcagatctgaacatcagtttgaagtcaaaataaatggattctattcgggtttcagttaagcacctgatgtcaacatatcctacctctgcttctctgcagagttcttcaagccagcgaaaagatgacagagtcatccattggtaagctgcagtcatcgcatcaacacattcagctggagaaccagatacgagggcttgagatccaaatataaaaacaccagtgcatccctagccatgacgttgtcacttagtcgacaagcaaagggcctccatactcaaatttgatcaattaatattagaaagtacatttcatcaagaattcgctacattccgtaacagccatcctatccattgcatcaaaatatcattaatagaaacatacaaactgatagataacagctttgacttatatatttaattaaacagtgcatattctataccaacggcagcaaaccataaaattgagcttaaattggttatacgttgataataaagaatatggtttaattgatacctacatccaacaaccatgaatacagtacttacatgacaaaatttgcatcaacaaggagcatatgagctaactaacaatttgtattgatgaaaattgtatatatctacaaaacaaaacatttagaacaatccatgcacacaaacttttatagaagtatttctgaaagtaatgaccttcttaatatcagatgattcacattgctagtgttcacattgaaaagtatttcagaaagcagagaggaagaaattaactcacatattgttggcaaggtagacattagtgttgtcgaagaagccgacaaagccgccgcggcctgggccatcatcgagggtagtaaatttgtggaagaactcgtcgagggcacaccaagcttctccacctccaaatcatgttgtgaaggcggtggccggtgcgtggatctgctgcagaggagcgatgcgacggctgtgtccaatgcacgtcttgcggaacttgctcctatcttgagacctattcagcacatggatggtttcaaccgatgacctgaaaatacaataatataaccaaagcaacaaagaattagatccaatatatattaggtaaagatgattagcaaagaaacccagatgaatttattaacctgctagtaaatttaggcagcttcgatagttggcaacggaaaggtcatgaggcaaaggcgagcgatgatgcccatcaagctgtgcgagatggcggatcgatgatgtcagcagcctcatttgcagaactggccggattcggaatggcggagccgtggaggcgatctaatcttctctgcctgaggtggagcggcacggtgccagcatcgaccgtcggggaaagagcaagtgcgcggaggcggcgatgtgatcgagcaccatgggaagaccttcctgctaagtagccgtgacgaaggcgggaggtgaaagcatagtcgctgtcaacgtaatgtagcagctccaagtcctctgtgttcagatgggagtcaggaatcaacaaggaagtactgctcaccattcaatggtaaaaaatggaccaaaaaatgaatcccatcttacccacatccaatgggaatatagtatctacaaatgggaatataatcatgagcataaagtttgattgttttattctgactttgtgtgttccaattcatactgcaagctgccgttatgtcatgcaataactcgcagcaaaactcttgctagaaggctggcaaataagcaatgacagaacctttctccagatgttcaatttcagacacatggtcccctttaaaaaaatttagaaacattgctgtccaaggatataaaattcatatagaagacgatgccaaattcagaaaaacaaatacagtggagaataaacccgcacccaacaattatccatctacctatccactaaaacaagtatatgatatttgctaccggctttcagtcaattacctcatctctcaaatgacatgctttgaactatccctcaactccagtgtattttgttaaaatcatgtgattcttcaattatatatcgagtgcaaaatttcagtatgcagcattctatttactaattggcattttttttatcgatctgtatattttattggcattaaaatttcatccattgagatatgaggtacataactgttcgtgaccatactgttcatcatcgtgagatgaacaaaagttcatcgtttgagagatgagatacataacggtatgaaattgatacaagagaagatttccatgactcaccttggagagagcggagagcacaaacgattctgatggaccatgttggggatcgtgagtagaggaggaacgatggatgacgacctggcagtgagtggcgaaggggtggcgtgatgggacgatcggcgggggctcggtcaccgtgaccccgaattggcggtcaggaatcgatggtggtcgcgatggcaacggccgtgaggagatcggctatggcgtctgaaggggagagcagaagaaccgcgggcgtggagagggagattgcggaaggggagagcggaggaaccgtgggtgtggagagggagatcacggaaggggagaggggaggaaccgcaggcgtggacggcgatgtggcaacacccgatctaggggaatacggcaaatcgcggggggcggcggcaatgtcgcaggggtgtcagcactggcaaggtgtgggtgtggatgggcgcgtcggtgatgcgggccagcaggagcggcgcagcgatagaggagcaagagcggctcagcggcggcggaaggaggaggaggcgcagcggcggttctgggtgacttttttttttttttggcgaggnnnnnnnnnnnnnnnnnnnnnnnnnnnnnnncgctaattgcagggttaatccggcgctaattgtaatcgcggtattaattgcacctaacaactcgtgctttttatattagtctataaatcaacggcaattttctaatttttcattaactagtaagggaacccgcgtattgcgcgggcatgtatttcaggatgcgtttgaaaaatttagatgggcgaaatatcaacaggatgataactgccatgtttcaaaagtactatttctacataatttttctaaactatttgttagcttttaaaaaatatatatttaattcattcgtataaatagttatctatcatctgtataaataccaaccatgtttcaaaagtaaatatttagattgtttggaaacttgtcggacaaataattaaacgtaaactaaaaagtaaaatgttttgtcttgtttaattgaatgtttggtagccttttttaacaaatcctaaataactattattattagtaaacatgctttccttatttgtaccatcaagttagttctcttttttgttggttcagattcatacaagctgagaggggaggggacggctagtgttctgttgtgcccatgtgagaggagggcgaagtggagggggtgttttgttcaaaatgatttaagtgaaaatcgatgatcctgtttcttttatcaaaatttctaatatcctttttttctaaattttaagatgtagcacatgacagcttaagattttctctaaaattatatatattggttaaaaataatggatccacctattaagtacaaattgatggtcacatgtcttttcttacaatttgtaaggttttatttttaattaagacataacacgtgatgccttaagtgtgctacagaagatgtacattgatttgaggtgatataatacttgtcgacgtttgatgtcgcgattccggtatttgcatagtatggggatcgttggtgctagggtatacgcgagactgaggtaaaagagacggagacgatgatttttatacaggttcgggcccctgaattgtcaggtaataaccctatatcctgttggccgaagccggtattgctcttattcaccataatcacaccagtacaatatttggggtagcctatctaactgttgtcgacatagcggtctgaaggtctgactcgtagtcgacaacagggtagccttcctcctcgagttcgtgcccggcgagatcagagacagcgcaatgtctctcctatcagtatccggagacaccgtaggggactagccgtgcctatccctgaagtcgatatccggcgtcttgtcttgacgtatgttggcttctgttgttctgtagattgtggtgggtgttgattgtctatgttgatcgtctccccctcctagggggccttatatttatacccataggtgtccccttgtctaagtaaaattagggaaaccaatatggatacaatccgagtagtccttgtagtttacatgtagaactctggttgtctttccttatccggaactcctcctatattcgcaggttatttccgtataggacatggtatgtggtgggtcctgccgagatttagtcaactactattaggtatgtggtatccataatcctgacagtagcccccgacttcaatgcaaatgaacgaattcatattctcaaccacgcgcagactttggagtaactgttatcgagctcatgtgaccgttctcgatgagttcagagataacgttagacttcctttatcaacctcgtgcgggcacctaaagggtttgtctgagtcaatctctgatgtcaactaagaaagtagagagcatacgactaagtctcccgtcttgctgtaatcgagaatttggattgaagtcaagaaattttatctcggcgggtacaccatctcttcattccgtactccttgtcgagatccaccaaccgttctcgagtaatcgagtaggcgtagagtctgcgacggagccttgtcaacatttgtcgtactcgccttagtcaatcttggtgtagaaccatagagacatggagtcttcgataatgtcgaatagaattttccaatgttttgtatatgagcgtctaccgacttcgatcagtcagtttgttaagttatacactctccctagcccccagccttgtcatcggagaatcgttctcggataatgaggctcttggacctttgacctgcctcggttgaacaagcactgatcctagcccccagccatgaagttggaaaatctatttccgattacacggcttggttaatacgcacggcgagaactcttacacgactagatcttacatggtctttcgtctctgaagaatccgaaaggccttatccgctctgggcgtccccaaccaaagttcccttaggttcctcggaggccttgtcaggacgacgtaaagggacattaggataggtttcaacgctaggtgtctttgtggtaagggatctctgggtaaaacacttggcgatactgtgcacctgatatcaactttgttgaagtagaggtaatgggagaatcgctacacctctggtcaagaaccaggtagtagtcgtaactcaaccactagaagtaaatgtacgagagatcgctacgattgactagttgagaaccagtgagtaggtatctctcgatcatttgaagtcgtagtacgaggaccgctgcgttattgctgtagtcatacctcgaccatctgaggttgcaccaatggaagcgttagagttggtttattacatgtgcatctcatgtggccagcatgactcacacacccaactagtagcatatccggatgtccgttcgcaatcatgtcgggtgatcaaaccgacaacgttcacaaggaattatccgttaacaactttttctcaaatagtccagccatggccggtgctatgagataggtcatcggtcttcgttggtaggttgggcacgacgactctgcatttgtcgagatcgtcctcgataatgcggtgtacttgaccacaacctactcgagtgctcaattgttcctgcaaaatattttctagaagacaagatatatagcagataatatcgagtatgtactcaaaaaactgcatggatcttctagcattatcaggatataacgagcagattaaatatcagggcattatgtaaaccgtaaataagcatgatatatacataggaaaatagagcgagcccccagcattaaaccgttgtcgatttaacatcggggacacttgcacaatatatattgtataaaaaacatgctttaggtaattaaacataataaattatagatctgacaatgctgtatgatctgaataggtatgataaattgcagataaaatattgtgtacctttgtagatacatgccggatgtatctatgaaattagtagatcaatttaaaaaaccaatctatcaattaccttgtcacgtactcgttcgatatcatgcgatctgacatcttttggtacgtcgcgtatcttgaggcttggtcgatctcgagagatcgaattgttgatgacgatggttccgatctcgtcgggagatgtacttagacaggttggatctccccacagctaaagtcgtcgagtagcttgttgtcggagagtccatctcttaaacccatctcgtcgaaatcctgaagcaccaaaatccccctacctggtgcgccactgtcgacgtttgatgtcgcgattccagtatttgcatagtatggggatcgttggtgctagggtatacgcgagactgaggtaaaagagacggagacgatgatttttatacaggttcgggcccctgaattgtcagataataaccctacatcctgttggccgaagccgatattgctcttattcaccataatcacaccagtacaatatttggggtagcctatctaactgttgtcgacatgacggtctgaaggtctgactcgtagtcaacaacagggtagccttcctcctcgagttcgtgcccggcgagatcagagacagcgcaatgtctttcctatcaatatccagagacaccgtaggggactagccgtgcctatccctgaagtcgatatccggcgtcttgtcttggcgtatgttggcttctgttgttccgtagattgtggagggtgttgattgtctctgttgattgtctcccctcctcctagagggggccttatatttatacccataggtgtcctcttgtccaagtataactagggaaaccaatatggatacaatccgagtagttcttgtcgtttccatgtagaactctggttgtctttccttatccggaactcctcctatattcgcaggttatttccgtataggacatggtatgtggtgggtcctgtcgagatttagtcaacaatacttattgtcattttttacaaagctctgtttttttatatttggttagcatgcaaaggataggtgtgtatgctcaaattgtgtatttctttatttttgtaaagtgaaatatgagtgatatggatcttgaattatttatttaattataaataaaataacaattcaaataaactaaaaatcaaatataacataagaatcataattatttagctttccaattattgatcatttttatattatgttgttaattagttaaaaattataagacagatgagttgagtgagagaggagatgaagagaaagtcaaatgggacaaaatatgaacactacaaatctactaattttattattgatttattatactatccgaatgggagaagtaatttttttggaacaatagtcagtgttattaggtttactttacttttgtcattactttattgtgaacttatatacaatgataaaacatatatcattatttttcataattttataattgtttgaatgacatgcaaaagtcagaaaatataaccccaaatatgggtctttaaatgtaaaataatcaaaagacataagaaaaatattacttgtatgatttaggggatcccatgatttatggtatagctgcttattttttagcataactcttgctttctaactaaatattttgggaacattactcatagttatttttattttacgtttatgattgtagatatcatttaattattatgaagtgtataatattgttattatttcatatttttacaatttattgaatggcatgcaaaagtctaaaattataatccaaaatgacatcttttcctcaaagttaaattattgtggaaatttggtctttagctgaagatttaatcataaataattttaaagatataagcggataaatattagttgtttgatttaggtgttataattgctgaattatttaataaaaaaatttttttttcaaactctaataataggataataaatatgtaaaaaatatgaagaaatcgagggaagtatgggtggaagtacgtactatcctataaaagaaacgtatgtaacgtacaggcccatggtataccccggtttggggttaggtaggatttttctttagataaacctattgttggaaaataagggtccacctaacttaatgaaaatcagtggatagatattttgttttttcttagaaattttataaatttatataatttattatagtaccacgtggcggtttatgagcgtctgtaggatgccacgtggcggtataggagtatcggttgccatggctacttacgggacaatggtgtaggtggaaggatttgtttaaattgatctggcggatgaaaatagtgggtccaccgacttaagttaaaatcatgggataaatattttgtttgttcttagaatttcttggaatttctctattttttagagtgccatgtggtggcttgagagtgtttgtaaagaataaatggattaaacgggctagggtatttcaactctttatgtggtactatgtttgaacgacttgcaaagggtcaaaataaaatgaatgcaatttttacaagtgcaattatagtcaacaggtgtatcaaattttaatttgtgattttaatcatgcataaataacgtaatgatacaaatagaacgtataattaaaagttaaaagatgttatgattatttaaagtatccaaaatatttcttataaagaatagccaaatttggtctgttagaaattaaagaaacattcgtaaagagaaaaacggagaggaggtacataccaatgtgcaaaccgcacacaccctgcatccacgggaagagggacaccttttattattaagaaagagaaaaaaatgtaatccaatggattggagtggtgagtctattatatttagtgaaaatcaaaggctatttgtttcttttttcttagaattcctaaattttattctaatttattagagccgcacgtgacgctatagagcgtttatatgggtggcatgtggcggtttaggagcgtttataggaagtataatagatttttagtatataatagatagattggatatcatcaatataatttgggacgtgtttgtagaattatttaagggtgacataatatatgttgtcaactttttataattaaaatatttcctggttatattttgttgcgatgcaaagaatatggcccatatatagaacaatatgaatcaacaatatggacattgtttaattataaatataacaacaataaaaagtaaaacatgtgacttaaatttaacactgaaattagagattgggaaagggagtacgtacaaacctaccggaggaaattaggtaacgtactgggaggggaggtggggacaggtgtttattagacctaatgttggaaatattgaccccaccaatttaaagaaaaattattcgttatattttagagtgccacttgacggcttaagagttttttaggacgccacgtggtggtttaggagcgtttctgaaaagtttaatgaaagtttaatgtactttatataatagatagatttattaataataactaatactgtattgtttaaactaaattattagtaattcgtttggacgatttatcaaaatatgaccaacaagtccacgcgggatcgtgcagccagaccagcaatacacgaccagacgagaattatagaaagaaaaacctattgcattgatggcacagcgcggaagaaatcattcgacctagggttggggattgccggcacattgccctctcccccttacacatagatcctgccgcccctccgacccctccccctccccttccccctccccccgcgcaaggatttgctggcggtttcatgcaaggacgatgatgatgaggatgacggcagcggcaacgttgtcatttggattccagggttagggttttgatttttggaatttctttttgcgatttttcctttaagcaatcagaccgcttacgcgttagcattaaaaaaccgattttcgcatgcacttgttctacacgcatgcaaaatttttattttcacagatacatacgggtcaccctcccgcatgtaaaaatttgtttttatgcaaggaagaatcttttacatagtagtgaagtttgtaatcaaataatttttttatcaccacttccctgaacacctttgtgaggtacacggtacccgggtatccaacgataagctttgggccgcacctcatggggtgggtcgagtgtcctaggcccatgcgacgtacttgtaaataaagaaagagagattccctagataagatataaatcttagggatcctgcatatcttttatagatatagaatagagagatttgtagatacttttcttgtaaccctccccctcatcctatataagagggggcaggggtcccgagagaggaggtcggatcatctccacaacccgacatatctcctcttcttggcttctcagttcatttttccacataggtacagagaaaaacacactggatataggacactggatatagggtattatctctttccaaggacctgaaccatcataaacacctacgtcaccatctctgtttaattttgcgcaccccattaaatatattgtcagtcataaaaatcgaccaccttgctaatggccttatatggtcaagcgatcccacggtgaggtaagaatattttattttatagcatagaccagaaagagagaagaaacagaaaaaaaaaaacgtccgagcggttaggtagcagcggtgagcacacgcggcagtcctctcgtacagaagccgcactactgtgtcagaacagctccatctttataaagtcaggagaactatgccaaagtccttgccaacgtctccgtgcactggatttaataataaattaaaaatatgcgtctataataaattagagatatcggtttaaaaaccagaccggtagtattggtgatggtttttctttagaacatcactaatgtatatggcaaaataatccatatagatgggttctatctaagtatactttacctatagcaatccttacaatatatatagacacaaggtatcattagtagaaaaaaagagatgagtcgagatagataatattatttattttcatatggatagtccatatgtatgtaagtattttttttgttattttttctatatagactagttgcacaatagtagtaagtggtatatagaatgatgattcaaatgcaaaagtaagataatatgactttatgagagaagaaaattaggaagatagtttggaccatatattaatcatctaagagttaaaaacaattgaagtgatatggatcttccttttctcattctcagctgcgctacggtgttctcccctagaaccgtttgagaggaagattggcaaggtcaaaggggtgaatatataactctggagtctcacgtaaactggttttcagaagtgctgggagtgcaaactcgtcctcatcaagcaaaagcagggtgaacaatcgaatgaggccattccgccaatggttgatcgatttgatggtcttcaaccccttacttctctctccacaagtggttgggggtgttgttgtgtttgcttgtttatccatcggcgtaggtgccttctcctatcttattatacgactctcgtcttttattttatcttctcttgttcgttaagtttatatatctattgttatttgggtttccttctataagttgacaggtgacagggttttatttgtctttatctttacctatgttggtatttcttaacgacattactagaaatataattaccagcaatggcgcagaaacactcgtggtatattatggttacaatttcatctgcaagcgtgcggatatacaattatatcatttcacctaaaagtattccaagggtatcgtatgtgtttaatcccgagagaaaattataatagagagaaccgagctaatatttatatgttacttgtaataatcaaagtctaggcatgggtcagtttaattcaaagggtagggtgacacgaatcagaagcattcactattctcatacatactaattctaggccaagtggaaaaaatatgaaaaaaaatcatttcctatacttctaatatacatacacactttagtcgatattatctactacctccgtcccaaattagtggtcactttgacttttttatgcaacgtttgaccattcgtcttatttgaaaaattagtgcaaatataaaaaatgataagtcatacttaaagtacttttgataataaagaaagtcataaataaaataaataataattctataattttttgaataagacgaatgatcaaaagttacaaacaaaatcaaagcgacaagtatttgggacggaggtagtactatatgattatatagccaataccccttacgatgccatcctggtatttcgagataccacccctggttgccgagttccttgcgacaacccgtcatggtcatccaaccagggctaaatacggagaagtaccctccccaggaaagtaacttaggattatatacacacgcggtggaatacccgtactgagttgtcaccatcaacggcccatcttgacgtatccacagcatataaccgcaaataatgatattcaatagcctatgcacctcgcttatctaccaaatactactctacaatcaccgtcgtgactcaagagtattcatataaatgaacattatacccacaccattgcatctcccgagtaagctagctagacaattatatctcgaataatatcttataaagtcggtactcaaataatcacagtgaagtaaagtactgtaaatatattgagaagaatattctataaatagtacaagtcttacaaaagaaagaaaagctactagagccatacccgaactcttccgaagactccggggactgaagattctatcctatttctattccactatgctctagagactatactaaacttgagagaatgtatgaagcttcttgcttgagatgtgtcttgaaatagagggagtgagggccttttataggctggtaatgacatttatggcggttggaaaggtcggtagtaccctccaaccaccatagggaagcaatccagaccatccagccaaaccctgcatcggatggcgttacggctggttcggccgaaccctgggctggcccaatcggcccaaactttggcaggcggcctcctcttccgctcctctccgcagacttgtgaattttggtcttcctgggtcttgtaaatttggtgttctcagcccatttgtcttcaagtctgattctcgacagcgtaggattgatctattgtatggttttgctatcgaatctcctctatttatgtttattctctgcaagaggttagaaatcctagttctagtggaatatatcttattttgacacaatatgcattgcaagcatgacttagttctcctttattttggtaatattgacgggcgaaactgatcgctaacgaccgtaagcaatctaaaagattaaaatctgcttccaaccaaaaattagttcgtccgtccaaaattttccatacatcgtgcatacgtgtccaatccggccccatgctcccttcctctcccgcggctttctgctggcgcctcccctccctgttgccccattgtcccagcactcctatcctcccgtgcgccccctcccttctagcagctatctcctcccagtgcgccactcttctcccgaccctccatcccttctcgccagtgcgtcctcccgaagcacactggcttcagcgctagggaagatgatgaatattgttagttgatttctgtttgtctttcgttcctccctcgtgttaactaaaacggaacccccctcactcggaaacacattttgacacattcatctggccgtgttcactatcagagatcgttgttgttgttttccggggaccacttcattgccactcgtgttcttgctatcgttgtcaaccgcagcgtgttcaaggaaaacggaatcccctcatctcggaacgcgttttgacacactcacctgtccgtgttcaccaccagagctcgtcaagttgctgtttctctaccgggaccatgtcgttggctcccgcattcccattgttttggtaattcagttttcttcgatgccaacaatagcacgtccaaggaaaaaggaatcacctcattcacgaacgtgttttaacgcactcacccggccgtgttcaccactagagctcgttgttggcgtttctaatcctgttaggaccacatcgttgttggtcgcgtttctgttgttttggttttctttgttgccaaccaccgctatctatggacgagtcacatcgtggaacacatccggacactttcctcgctaccgtttggtgaattggaaaattttaatatatgtcaaagaaacgagtacccgttcaaaattaatatttcatctatgggctaaaataagttttttcaatttctagctaaatttagttttcagttgtttttctatttacagtatttgttttactatttgatccaataaaaattattgaaacttatatttttccttcgcattgaattatttatagctatatgaataaaaggggactttagcattatattaataattccggtcaaaattatttgtagtgtcatgttgttatttctatgattatatttcctttattatttatgctcagttgtaatatatggtttaggatttttatttatgttgatgaatgttatttaggacatgttgcaacgggaggcattacgctagtctcttctactacttaaaaaataaaaagtgtttccgtcgtccgtcaaaataaaaaaacagcgaaaaaaatatccgattcccaaagtggcgaaaaagccaaaaaaaaaacacgctatagatccaattcctcctaaaacggcaaaatataaaaaaaaaatcatattcctataaaaggggaacagaagtggtgaaaaaggaaaagaaaaacataggtctgattttccataaattggagaaagcaataaaaaaatccgattcctataaaaggagaaaagaaaaaaatcgtaaaaaataaaaaaaatagaaaaggtcggactccctaagaaagtggcaaaaaaaaaggtgagaaaaaaaaagtaaaaagggcggaaaaaaggcgcggcaaaaaaaaatccgatttctattcgttttaatagtcattatcatctcttctctatctctaatctaatataatctaactatttaaaaaggaagtcagaaaaaatgtgcgagaaaataaaaacgcgtgagaaaaagttagaaaaaagagcaaaagaaaacacgatagaaaaaattttccgttgtccataaaaaaagcgcgggaaaaaaatatttccattgcctgtaaaaaaaagcaaaaaaaacatgcgaggaaaaaactgatagaaaaaagggaaaaaacgcgccatttctaaaaaatggtttgaaaataccgcacaagaaaaaaaaacatcggtcataaaaaaaacaagttgctcttgaaaaaactgtaaagaaaatgctaaattgatggacgcttggggtcggatatgatccatcatttttttttcatctcctacctacctagcttttgtttctttatctattctcctgtattgaaaaccctacatattctgtaggcaattattagactattttttaagtatagctactattttggataacatattatatgaaaataatattaaaaaataaacatattttaattgttatttagagaaaagtacaaaataactctattttgtctagaattgaccatgcgaggcactgtaggatttgattgatcttattattggttgcaagaatgacattggaagagtattttaaattatatgcatggtgtcatataaataatccaattattttaggtaaagcaaagcatcggtaaagttgtcatcatcaaggttgggccattacattgaagatgttctaattttctgattgttttagctataaacaatctatataaatattatcattgatatggttatgcatgaaaaacgtatattgtaattagaattgtttcacccgttgcaaatgtacgggcatttttgctagtaagtaaaaaaaaaagaacagcaaaaatgtccgagcggttaggtaggagcagcgagcacgagtcagtcctgtgtccgaacagaagccgcagtactgtgtccgaacagctccatctcccttttaaagtcgcgagaaccaatgccaaagtcctcgccaaccgtctccgttcactgccctcgattgcaatccacgttcgtcgtgagtgacgatgggaagcgccggtgcggcgccggtggcgacggcggccggcggcggcggtggagacggagacctgcacgtggtgatgttcccgttcctggcgttcggccacatcagcccgttcgcgcagctggcgcggaagatggccggcgtcggcgccggggtgcgcgtcacgttcctgtcggcggcggccaacgtgccccgcgtcgaggccatgctgggcggcaccggcggcacgtccaccgtggcggcgctcgagctgccgcgcgtgccggggctccccgagggcgcggagagcacggcggaggtgtcggcggacggtgccgagctgctcaagctcgccgtcgacggcacgcggccgcaggtggaggcgctgctggcgaggctccacccggacgtcgtgctgttcgacttcgccacgccgtgggtcgtcgacgtcgccaggccgctcggcgtcaaggcagcgctcttctccgtgttcgccgcggtctccggcgcgtacgtcatggcccccgcgcgccgccgcctccccgggccggggcgcccgaccgtcgacgacctcgcgtcggcgccggaggggttcccgccgtcgtcgccgctcgccaccgtgccggcctaccaggccgccgacttcagctacgtgttcgagagcttccacggcatgccgtgcgtgtacgaccgcgtcgccgcatgccacaacgcctgcgacgccctggtcatcaagacctgcgccgagatggaaggcccctacatcgactacatcgcggcggagcacggcaagccggtgctcgtgacggggcccatcgtgccggagccgccgcgaggcgagctggaggagcggtgggcgacgtggctctcctccttcccggacaactccgtcgtgttcgcctccttcggcagcgagaccttcctgctgcacgccgccgcgacggagctcctcctcggactagaggccaccgccctgccgttcctcgcagtgctcaacttccccaagggcacggacgccgaggcggagctgaggaagctcacgccgccggggttggaggagagggtgaaggggagagggatcctgcacaccgggtgggtgcagcagcagcacatcctgcgccaccgcagcgtgggctgcttcgtcaaccactccgggctcagctccgtcgtggaggggctcgtcgccggctgccgcctcgtgctgctgccgatgaagggcgaccagtacctcaacgccgcgctgttcgcgcgcgagctccgcgtgggcaccgaggtcgcgcgccgcgcccgcgacgggtggttcgggcgtgaggacgtgcgcgacgcgctggcggcggcgttcgccggaggagaagacggcggcggcgaggagaagaaatggcgggagttcttgatggacgacgccgtgcagaggaggttcgtgcgggagttcgtggcggagctgagaaggctcaagggctgaaaacggaacgtcacgcgtcgttaatcagatcgacagctgtcacaactctgaagaaaatcggactctgttctgaagactgtgaagagaaggaatcaacggctgtgattgcttgatactgcatcgcggttctcgctctagggagtactacatccgtcataaaataaaataagtgcagttttgcactggttatatccaacgtctgacttaacgtcttatttataaaaattatttttatgattagtacatatcactgtgtaatactgtgctacatcatacttttgtcattttctcaaactgtccgccgcatatcgcatatatagatggccacaggacccgtccggcacggcacagcccggcccaagcacgcgctaggtacggcccaccagtgatcgggccggcacggtacggtcggcacttcgtgccgggcagtgccggcccaggcatggcccattcgcatataagtgcttctcgcagctgcaacctggaacttgtatcgatgatgatttgaaacctaaaacctactctctccgggttgataatacttattattttacataggagttaggtcaaactttagtatctttgattataaatcatttttataatatttatctttcaaatacagtgactacatatataaattagttttaaaaaaatactttaataaaatcacatatttgttaaaaattttacacatattaaaataaaaaataatggttaattttttttaagaccatgctcatgtccaaaacgataattattatcaacccggagtgagtactactttattctttgtcttgcggtgattaatttcctacctgcatagttttccttctatttaattacgcccgcctttcacagtgcgagtacatgtcgactagccctagcgcgccaatttggatttacgctgatgtgttgactccgcgcgagctcctgctgagccgcaacgcattcttcgaccgcctcgacggcacgtggcgtgaaaactcgaaccacgcctgtgctgttgtaacatcctaaaaataattattttctaattcagcaccttaataaccttctaaacctaggagaataattagagtaacctcctcaaactaaccaacatttaatttctattgtgttttttatttaaaaatatatttggctaaattgatgaattttgtgattgaattttattttcgaatttcaaaacttttttagactaaaattcctttatttaatttaattgaaaaactttttacttgtatgaattatggtctaagaaatcctctgatattgcccttgaacttcaaccaccgtaattctgatttcattcgaattaatccttaaccaaaaccttggatctagagttatctctaattctcctctatccaatttttttatataaatattccaatagtcaattcctatctagtctgtaatttaatttctatagcttgactccaaccttggcagaagaataatatttttagaataattgcaagaaaatatattttatcctcccatcccaaatccaaaacctcatttagcccataattaattctctaaatattccactccctccattttccttccacatactcaaaagtatatccaaaattaagagccacatcgtttttgggccttgagcgttacaaatggtatcagagccgaccaatacaactatacatatatatgaacatgtatgcgggcatacgttgcatacgagatgataccgaagtgtcatggttggcatcgtgtcacggacagaaattcgcttactcgaatttcaagcagaatgtgtattaaatctctatctagatccacgttttacaaaaataacaaaataaatctcacaaatgcaacggaaaaaatgaataaacaagacttaatcttcacgaccaaaagcatagcttccaccataaaccacatgcaatcttcgacgtccagaacaagataaaaaaatttggtttattttgctgtttcagtagccttattgcttgtatttcttgtatgctttgttgtcgtttagattccgtcagttccggagatccaatttatttccaagtggttgccgagattcagtcagctcaagagcaaggcaagtcatacatacatcattgatcatgttgagtctattttacaaaatcccctactttctattaaattgcattgttttagaatgtcatgtgggatggatgcctatcgtactcagcatgttgaatatcttatgccattgataacttgagttataattgactaggtgattggtttaggaatgcttagccatacttagatcaattagctcacaatgggattcattataatttagtccttaattgtatgatgatgtaccaccatggttacggtttaattaaactaaaatatgctttaatggtgggttgtgggtacatgcatgattttggaagtcgtacccatgacaattaaggaccggttctcgggaatccatggaagatatactcgttcttatcacatgccagcatgggctccaggcttaatctagagtataacttaacctagctaacataccatggcaagggtagaggcgattgtgcggttcagacctagataattgtctctgttgtttccggatttacctaggcacgagaggggattgcccgacttggcataaggagggggtgaaacctgagatgggtatgtttggttagggagagttatatgatgggttttgtcacgatttccccctttgcagtatcgtggcggtacttcagggcatgtgatgaggacatcactccttcagatacatacaacaatcctccaccggtcattcaaggaccaataacaagagctcgtgcgcgacaattgaatttagaggtgagctcgttcctatattcttctttatatgattttgagaatagattgctacctaatgaatatattgtgattaggaataaaggagaggacaaggacttagagagggacttagaggcatggaggatcatcaaggacgtccaagtcaatatggaggcccaaaccaggtcgacttcgagtacgattcagagtccaggaccagtctgcactaaaacaggcgcccaagtcgcatatgtgcacggattggggcgttccttatatggatggaaaacttagaacataacctttccaatggttctggtcccacgttcaaattctttccaagtcaacgggaatcgaccgaacaatttaacgtccataatctattccggtgctgcgtcatcgtatttgggcgtttaggccgtgtatcgtgttggaacccattagggttgcgtcaagggttgtttacacgaccctaaattctatatatcaatacccgtcgtcatatttagggtttgggttttgcttagattattctgtcaagaacagtttcgccgctagatcggtttgtaagaccccaactcgtgagctttatcatttatttgcaattttggttgtattcttctttgttcttgtttgtgttcttcgattcgcaaacagggatttgccttctcggcgaggtcatccgtgtttcaacacgggtgataaccagaggagacgtggtgctgcgattgcggggctcaagagcgtgtttggttagaagccggatcgaactgtgtcgtgactccgtccaaatcgactacctattagaacctttccgaagatcgggaaccctagtcaacataagcatggtaaatgtgtggaatcatgtcttgtgggtaaagttgtacacctctgatcagaagtaaaactatttaaatagcgggctttcgggtatttgggtggtcaaccagttcaccgtgattagtcccactataataatatgacttatagaactggtgtagttcaggtggtttggttggacctgttgcaacgtggatttagcgttggacaatgatgatttaatactacttaattatacactgtttttactcattcaaaataatgatttataaatgttgcttttattgcaaatatccaatgagccactcctttgagaataccttgcatcataccttcccgttggtatgacttgttgagtacagtggttggtactcagtcttgttttatcccccccacccccacccacccagaggcagaaattggttcagatgatgagttctctgaggattgagcttgttccggacgtcaaggattgcctgtagtttatggaggaagctatacttttggtcgtgaagattaagtcttgtttatttgctttttccgttgcattttttagatttattttattacttttgtaagacgtggctggccctggacagatatttaatacacattctgcttaaaattcaggttagcaatttctgggcgtgacacatcgtctgcaaccgaaggaggaagacacgcgacgcggaaggtgtagcgcgcacaggagcaggcgacgcgagcacgggcgcctaacagcggccgtgtcggacagctacactcctagccaatgataagtttaattgagattggattgttatctccacattttcctcattatttgttaggcattaagttagatttgtaagcctatttacagggcatttgggattgaaatcagcttgcaagattccactttgtttcccatctctttctctgttttctcatctcttcttctgtgccactaccacgggtcgccgatcttctaattaagttgccgaaacctcagccaccgattactcactcctaccccattagatcatacaccggagctcgtaacaaccaagctccaagaccatggtgtcagaagatctctccatccacaaacaacccattctcaaacccaccgactcgcccaccaagctccaagaccaaatgtcagaaggttccagggatgtgatcattgttggcttccaagcacgatctagctgatctcagtcggaccgttgcggtggccacatcacgcatcacatccctggaacaactccagggcacgatgtcatcatcgtcgccacagatcgcaccttgtttgggcggcagtggcatcctgggtacgcctgccgtgacgggccaatcgccgccattggtgacaggaccacaggatacgggcagcgctaccagcgttcctcgtttctacaaattggagttccccaagtatgatgacaaggacgatccgctcaacaggttcaaccactgtgagcaattcttctgtggccagaagacgcatgacagtgatcgtgttgggttggcaacgtaccacctcgccgacaacgcacaggaatggtactttcactatgaaattcacaaggggcctccgacgtgggatgagttcaaagacctctgccatggccaattcggtccaccgatccactgcaactcgctcggtgaactgaagcggctgatgcagacatccacggtggctgcctaccagaccatgttcttgacgctcgcatgctaaatgtctgaagccctctccgaccagcagtaaatctagctattcacggcgggtttacatgatgaactggcgatcgatgtcgagctcgaccagcctgatgagtctacgccacggacgagcctcgcatgtccctgaacaagctctccggcgttgacggcgctaacacccctggttcggccaaaccctggctaagccccctgacagcacctttcatatgggtcactgcctggtgggtcctcatgtcgttttggggtgtttggacgaagttgaggcggttcacctcctggtgtgtgctctttgatccatgtactcttctcctcattggttggaattatgttctcttatttgtgttttctcttaatttgcacaagtaatcacttgcatacaaatactcaccaataattatggaattggttagtacgtaataaatccataccgctagatttggtggtagactttggtaaaatttatgcaggaattgatggtcaaatttggtagttgaggaccgtcaacagcgacgatggttacgatatataggagtaacatatttgggtcgggtcatttctcccagaccccaattggtcgatgtcttcctcatcggaaaattcgtagcagcag

SEQ ID NO: 5452 - DNA, 1958 bp, Oryza sativa
cgtaaggtatatgggttgtccattgtaatctctgctcctccccctatataaggaggggtccggggctcctagggacatgacttttctcccagattgtcagatcaataatacactcagtggaataaatcctcagacaggagtagggtattacttttcattgagaaggcctgaacttgtataaacatttatcttctaacccatccacttttcaagcttgattggcaccccttttagtattgccgaaatcttgtttcgacggaaatggagaagggtgcctcttgcttaatttactctgctttagatcaagtttaagttgatacgggtgtctaagtttatattaggggtgcacacatggttaaaattggtgaggtatagctaaaaaattttcttgactggttcctgtgcaacccggcacccactcctatactctactgtgcacccactcctatactctacctccgtccctgattgtgggtgtctcaagtagcgagcatcaactttatagtaatattggatttgccaagcaaacattgacccggcccattaaatgtgtgctaattattgatttagccgtgcccttaatataggagaatgcccagcatcggttgaccgggggaggtgggaaaatcggtccctccccctcccccacgtgctcatctgttggacccacccacttgtccctctcctttttccaaaaagatgtttcacctagtgtatttacaatgtttcactatttatatatctaatgttgcagtgaattaaaatattttttacaacaaaaaaacccacatattttggaaaccctctattaagggaatttggtttattttttgttccaccaaaaatgtttcactatgtttaatttggtttttttccaccaaaaatgtgatctgaaacattttttcgctatttgctgaaacattatttttatataaggtgaaacaacacccgatttaaacgattgagacattttcaatctacttagtgaaacaattccgatatacctggtggaacataatgcaatatttaaaaataataattcaataataagctatttttttcatcggaatatattcatgtgtgatcttgttttgaagatttaattacaacgaatttaatggtgcaatcggattataatttatataaataatttaagagaaaaatcagtttaaaataattttgcatttaaatcgacgcccgattttaatccccttccatcgggcgcgaaaccggagtcgcgtcccgtaatatggtaatgggatacaaatacttctcactgaaaagcaatccccaactaagaatggccggtgtggatgccacggccgccgccggcgacgaggccggcgaaacgttgcacgtagcgttgttcccgttccttgcgttcggccacatcaacccgttcgtgcagctggcccgtagcctccttaccgtccgtggggtgcgtgtcacgttcctgtgatcctgtcggcgcctcggcggcggccaacgtggcccacgtcgaggccatgctgcccgcggccgtcgccgtcgcggcactgcatcttatatgaagacaagagcacgacgtggggaactcaccgaggtgtggcgcgacgatggacgacgacggaagacggaagacggccgacggcgaggcagaggcggcgacgttgagtaatttctccgtaattccttcctcttcaattccccctaatttcccccttgagtagcgccctcaatcgcccggaacggccgcgccatccccggccaccttccatggcagccgtccgcctttcttggcgccgttccgccctctcccgtgcccggctagctcccctccgctataaaatgggatccccttccaccgttctctcgttttagcctcctcccgcgtctccccgtggtcgcaccgcctcttcccaccgccctcctctctctcccgtgccgccggccacttccagccgcctccccctcctcgc

SEQ ID NO: 5453 - DNA, 757 bp, Oryza sativa
ttagcataactcttgctttctaactaaatattttgggaacattactcatagttatttttattttacgtttatgattgtagatatcatttaattattatgaagtgtataatattgttattatttcatatttttacaatttattgaatggcatgcaaaagtctaaaattataatccaaaatgacatcttttcctcaaagttaaattattgtggaaatttggtctttagctgaagatttaatcataaataattttaaagatataagcggataaatattagttgtttgatttaggtgttataattgctgaattatttaataaaaaaatttttttttcaaactctaataataggataataaatatgtaaaaaatatgaagaaatcgagggaagtatgggtggaagtacgtactatcctataaaagaaacgtatgtaacgtacagggccatggtataccccgggttgggggtaaggtaggatttttctttaaataaacctatggtgggaaaattaggggtccacctaacttaatgaaaatcaggggatagatatttggttttttcttaaaaatttaataaatttatataattaattatagtaccacgtggcggtttatgagcgtctgtaggatgccacgtggcggtataggagtatcggtggccattggctacttacgggacaatggtgtatgtggaaagatttgtttaaattgatcctgcggatgaaaatagtgggtccaccgacttaagttaaaatcatgg

SEQ ID NO: 5454 - DNA, 249 bp, Oryza sativa
cctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatatta

SEQ ID NO: 5455 - DNA, 16143 bp, Oryza sativa
gctcggtacccatatcttggtcatacgaaccccgaatcgacccgttcaagtcttttaatgtttgttataacctaaagaaccctatgctttctttttatatactgttattgcttctttataggcttgtagctttgcttgtgtgcttcgtgtagcttctttcgttccggaggttcccgaagcgtggctcgtggtcgtcgccgaaggttcagaaggccgttctctctgagcaaggcaagtcgcatcatccttgagcatattgaatcccagtttataaaattattttgatttaaattattgcattatcgctttatttaaattcccgcgttatcactgtttttagtaatacctattaatccttgttatagccttatcattactattgtttattatcacctcgcttaccctaggaaaacaaaaccccaactagtgggtactgtattaatggttccactagtatgaatttaggtagatgcttcgctgattaattatgccacactagatggttttataactgattaattagttctcatatcatttggacattatggaatggttggcttgtggatggaattgaacacacaccttcccctctattcaaactcctaaatggttgtaggctgggctcgaggtgcatggttttgctaggagcacctcggccaccataaggaccggtcttcgggcctctgttgcaaagcactaccgtactaaccatatgtctaatgggtaaggcttaactcggtgctcagtctagtcctgaacaaaaggacacggatagagatggatgaagtcgttgagacgatggatatctctgaggcaaatgaaggctacgtgagctgcggcttggtaatcgagatgtctagacaaatgaatgctacacgggtcggtgcccgttagtcgagatgccatggcactagactagtacgcgggtggtctcacccctatgtgtgtggcgcacccggtctagatcctgttgctaggggctcaatcctggcctgcctatctaggatactggccgtaggcagggttgggtcggtacttttgttcacggctaggatgggtgaagggttatgtcacatgtttacgacgagttccaaggccatggaatgtggagtaaagatatgtcttgtgggtaaagatgtacacctctgatcagagtaaatctattcgaatagccgcgcccttggttatgggcaagcctagcaatgtacccaagttagttgtttaattcttaaaacttgcttaacaactaaaatgtggaatggttggcctgggttggcttgggacgagttgggaccaggtcaggttgccagttcggtctgaatcatcgtaggccttgggttaaggcaggttcatgtgggttcacggccttgattaataatattgtgtagctctaggatcgtgtttacaaaatagctttgggcaactaagtgacttttaaatgctgtttactgccaaacttaacccctattattatccccttgtacccccttgcattaatcatgcatctcctggtgtggcttgctaagtactgtggttgtactcattcttgctctatctttccccccttcagtaagagaagctttggagaagaagtcctaggtggagtcatggcttataccccagttgagcgcctgtgaacatggagtcgtaggctcgctagtccgctgctgtttatttttgtttgtcaggcctgaagtgcctttgtaataatgtaaatattatcaatataataaatatgtactttttgtatcatatttgtttggtgtatcccggcttttcctgggacgggtattaatacactagtgttctggaaaaggtatttttccgggcgcgacaaggctgtgactaagaatggaggcatgacagtcattgaaaacttgaagaacgacttgatccgacaacgcactataacgggatgatacgttttcaggccctggggcgttacccctacgtatgcacaagagccgcaacagaagctaaatagtgcgatcagagaagtcgtgaaaaaataggtcttgaaactcctacacgctgggataatatattttatgccgtatagagagtgggttagcctggtgcaggttgtgcgtaagaagggaggcatggcggtcattcaaaactcgaagaatgaattgattcgatgacgcattgttacgggatgaaggatgtgcattgattacagaaagctcaacaaagctacaaagaaagaccatttcccgctacctttcattgatgagatgctggattagctaggaaatcatcaaattcccatctatgccgatgatcaaagcaagacaatgtttacatgtccgtcgggtcccagaactaattacttggatccgactatgattaatgtatcaatccctggatcagtaaatattgatacatacaatataactggttcttaattgcatacattaaagttctacaatactaagggttttacaataataggtactcacctaattaattaactagaattaatacacagcggaagtttatatacattctgactagagaggtataacctttagggattttctaaattatcagggtcatcgtagtaatagtcataggggtcctcctcttgacccaaatctgaaaaagggctataagagcaagaatgagtattgacaatactcagcaagttatcatggaaatatgttatgcattggcatataatggggttctttgtgaaaagcattaataaacaatctagaagagttatagcaagaatttataaatatatatatagactttaaatttctaaccagggtaacatatgagtcctggtactcaattccatgagtacggctattcgaatagtttcaaagatattctactgcagtagatgtacgctttacccgcaatccacaacttgctgataatcatcggctatagtcatggcccaatattaagttattaacaattgtggcacctattccatgaacttatatcctcatatgctctgaacgtattgttaacagcagcaagaggagttctggcgttcccgagatatttaaggggaactaatcgtatgacaccacgtcatctcgattagggtttagaaatataccatataatttatactcgagtatcacaaaccatttacctgtacatggtaatggttaaaagttgcctttcgctgctatagttgcctcctgcgcgaggacttaaaaataagaaccactatacagaggtgccatattgttaattaacataataactaggtctatccccattctagaaactgtggtcgtacccgttcgttcgacataagtacctggtaaaaactatatcgatcgagacagtactagccacccagaaatcaaccaaaccttacgtactgtcccaatctaagtttaaggaattttaagcagattgtaagcaaagtaagcaatactaaattatctgggtttctatggttgaattatgcatataaaatagaatattgaaaagaatgctataaataaataatttgtaaaatataggcttaaatgatcaaaaggtatatggtaacttgccttgctcgatgtcctgagattgattgctattatctagtgtgtcaaaagattcctcaagacctagggttagacatataaaattcaaattcaaaaggaattcagatacaatccaaaaataagaaaaatagggaaaataaaataaaatagaaaaataacaaaatgggtctcaaaagatagagaatgattttagaagaatattggtccaagtttcaatggaattggacctatattttcaaagatatgggtttctaaagtttgaaaatcaattaaatgtgaaatggcacggtgtgcgggtcccacctgtcagtctctctctctctctctctcttctcttcttctacctccagccgatccctatttacggctggcggtgctaggattggcgattgcggcggtgatggaggagaagaggggttgcggccgaggatgggagggagctagggtactcccgccaccgtgagcggcggcggaggggttaatttggtatgtggttgagctagcggctagggcgggggtgggcaatagttaagccgtgaaggtgatcaggggttatgtgagtttagacatggctcggggaggggttctagagcatctatcaggtacctagaaaggtttaagcagcttgccgaccttcggcaaggtgtggaatatattttgccgacgagctcctccattggcggtggccctgctcacgtcgcagcccagagggtggcatggtagaacaaacccaattgctaaaatagaatctagggagtacatagatggttaaaacgaaagaactcaccgagatcggttgaaacgacgggttgcggccggaaaaactttgtggcgaggaagaacagagcagcgcgggggcggcggtgctcggcttggtacggcgaggtaaaactcgacgcagagcttcggttaggatctagtatgctaaaacatggtaggatataggtgttctaaggggtatataaggtggaggatggatggaggggtgtggagtcgatcgcgcacaaggtgttcgatcgacggacgagggtggttgatggaatggattggtgaaacagagcttcggagttgcggggctatggttattgatgatcgatgatggacaaggaaagggttggggtcctatttatagggccaggggaagtggatgagttcggacgccatcatcgccatggatgagctcaaggattggatatgtcaaaggtggcagaggctgtgagagggtggccaaggtcaatatgagtggcgggaggccacgtttgaatacttaccagcgaaggattggcttgaccgcgagtagaaacggctggcgacgtgttggcgccaatccgggcgtgacgcgcagcggtagtgagggttaaaacggtcggcttgggggtgaatggcttgaattgagagaggggaaaccaccttctatcttcaattcaaccgtgtggcaagaattggcgcgattcaccctgggtagaatcaaaatcggactcggcggcggctttggacgggaacgcacggcatcgagcggcgatttcttgcggcggaggtcatcccggctttgtcgtcgtcaagattggtgcggcggcggcggcctgagggcgtcggacgggcgacgacacgccaaggcaatcgggcacgcgcgacgggtcccgaggccgacgcgcggcggctcggcgcgcggcaaggtagaaagccaggcagcgcgcgagaaggggaggagaaggccaactaaaccatggtttttgagtgggatgtggtccccaaggatccaacatagactttgcaaaagattgggtagagattgggctgagttagctgggctaggcatttcatcgagctccttgtgtgcgatgaacagtgaaattcaacaattttgaatattttccttgagaagatttgaatttaaactatgaatttggaaaggtttcactatggtttggagtatagcaaatccttactaatattagggtaaattaaggaaataatctaaagattgaaatttgagagaatttgctcaaatttagtaaggttcggaataaagggtataattagggtaaattagtagggttctaaagaagtaatacttgaaccacttaggaatcaaatagatttttaaaacacactaaattaatcaaaagccagcatgatgcagtcaaattttagttttaaaatttgaggatgttacaatgtccttacggaatgtacgcataccagcggatgtcgttcggttgtgtaatgcacccgtgtcgttccaacggtgtatgatgtctatcttctccgacatgattgaggaaatcatggaaatcatcatggatgacttatccatctatagaaagagttttgatcaatgcttggagaacctggacaaagtcttgcagcggtgtcatgaagaggacttggtgcttaactaggaaaagtgtcatttcatggttcagaactagtaaaagtgccacttcgtgaaaaggattttgtgcttaactaggaatagtgctcgaacatcgagtctccgaaaaagcagtacaggagtacaaagttagaattgtggtaatccaacaactccgacctcctataatgttaaaggggtccgtagtttcctgggtcatgcggggttttattgtcggttcattaatcatttttctttagtagctagacccctcaccagcttgccagctaaggatgctccctttaactttgatgattagtgcttaaaatcttttagttacctaaaagactctggcttacaactctataatgtatccgaatgttaaggattaggaaagagggacagggttgtcatcacctaccgcctacccctacaacccgtggagcacacaacaaacaaatgtaacctccagcctagacacaatgtatatgctattgattactactctaatctcggtaccaacttaagactaaagtactctacctaagtagagcaatgaatccgcaactatgagaaaatatcttacttaaataagaagagtaaatacaacaaagaagtcatgaatgcttacttatatgaagacaagtttggagaagagtgccgacaaaccttgcacttccccaggagaagaatgccgacagcccagcctggcacttctccagacattctcttatttactccctactctaagaactagctaagtagatcttcacctttggaatgtagcaatgatttatatcttggtgtgtgttgagagtaaggaatggaggcctatttataatgtggaggtgatttgagagaatattcctcctccaactcctttcaagccacagcatgtcctcaaaccgacattctatagcggttactcaccgtgagccttgcaccaacgtctccaggagagagataattgatgctatgtggaaattgtgatagaggggagccacccctcattcgaccgaaccctggctaagccccctcgcgccgccttttatctgggtcactgcctggtaggtccacgtgacggtttggggtgtttggacgacgttgaggcggttcacctcctggtgtgggccctttgattcatgtactcttctctcattggctggaatttgttttctcttacttgcgttttctcttaatttccacaagtattcacccgcatacaaatattcaccaacacttgtggaagtggtttgtaataaacccctaccgctagatttagtggtagactatggtaaaatttatgcatgaattgatggtcaaatttggtagttaaggaccgtaaacagcgatgatggttacgaaatattgtaataaaccccaagtcgtcgattctttgtcatcggaaaatccatagcagcggtgtcatgataaagattgggataatgatgattccgatttgaagtggtgtgtaattcagtcgagtcatatctcctaggtctgaagtcgtcgaagattttttgttcacgcgattcgcctcttggacccatctcatcgaaaccttgaagcaccatatccccctacctggcacgccactttcgacgggctatagccgcctacggtatttgtagaatatggaaattgttagtgacatggtatacgcgagattgaggtaaaagaggcaggagatggggacttttatacaggttcggaccacgtaactaatgggtaatagccctactcctatcggctgaagccggtgttgccttttatatatcaatatcacacgagtacaatattggagaggacttaatctagtcccggtcagcttagcaacatagaactctcacatgtggtcggcggctagtgtattctgcctcctcgaatatcacacggcgagattgaaattgtattgtgtggcttgcctagatccgtattggttttttcttcgcctcccgtgtgtgtcgtctctcctactgggggtcttgtatttataccctcaggtgtcctcttgtctatgtagaattagataaccaagtatggatacgataagagtggtgcttgtcgtgctcaagtaggactttgcttctctttccttattcggaacaccgtccgtaggtgaggtatgatttcatgtaagacttgtatatggtgggtctcgccgagccaaaaaaaatattaatgatgtcttatctataacattcacttttcaagattgaacgaaattttaatgaagcttgattctttattcttctgcaaatgcgaatgaattgccttgtatatattgagtctgcaagatgttagcttgaagcaaaggtatatagcgggaaacacgcatgtggataagtctgcaaaatacatttgcatgcgcaagttactaatactcttacaagaacaaccaggattctttctgaaatactttggccctatcatatttaggacccaatgcgttacttttgtacgctgtgttatcactgcacgtaataattagcaacaaaaggcgttcatacagtatatgtactagagtatgtcatttcacctaaactgatagctacatgctaattgtgtatatctaacatgcgctgacggcattggatagcaaaaaagtggaagaaatatttatggatggtttaatttctgaaagatcatttcacctaaaattgacagataacttctctaatatctataatatatatttaaataatgtgaaaataatgatttgatattgcttgcatgttaattttaaaaatacaacaaaattgttaatgatatgtgctaattattgatttagccatgcgccatccgcgtatatatagatggtaatggggtacaaatgcttcacactgaaaagcagtcccgaactaagcatggccggtgtggatgccacggccgccggcggcgacgaggccggcgaaacgttgcacgtagtgttgttcccgttccttgccttcggccacatcaacccgttcgcgcagctggcccgtagcctcctcgccgtcggtggggtgcgtgtcacgttcctgtcggcggcggccaacgtggcccacgtcgagactcgagaccatgctgcctgcggacggccgtcgccgtcgtggcactgcatctgccgcgcgttccggggctccccgagggcacagagagcacggcggaggtcgacgcggacggcgccgagctgctcaagctcgccctcgacggcacgcggccgcaggtggaggcgctgctcgcgaggctccgcccggacgtcgtgctcttcgacttcgtcacgccgtgggtcgccgacgctgccaggcgtctcggcgtcaggtcggcgcggttctcgatcttccccgcggtctccggcgcgtacttcatggcccacgggcgcggcctctacggcgcgcgcccgaccgccgaggagctcgcgtcggcgcccgaggggttcccgccgtcgtcgccgctctccacggtgccgacctaccaggccgcccacttcacccacattttcaccagcttcccgggcatgccgagcacgcatgaccgctccgtcgcctgccacaacgcctgcgacgcgctcgtcatcaggacctgccacgagatggaaggcccctacatcgactacatcgcggcgcagtatggcaagccggtgctcgccacggggccactggtgccggagccaccgcgaggcgagctggaggagaggttcgcgacgtggctctcctccttcccggacaaggccgtcgtcttcgccttggacaaatatagaataatctgcatggaaccatggacaaatatagaataatctgcatggcaaaaagtattgtttttggacatggtactcacatggtatttgttattgtaaacgatgctgatgccatggatcaagttctgcaagtaaatggagatcacaaccataatgcctttccttttaatctcaactttgatgccgatgaggaagacctacaaatacatccaggtaagtcatttaaccgacatgaatattagacttaaaaaaaatgataaaatgtggttttacccaaaggatcattgaagaataatattatttatctgaaaccatgttttaaattagaagttagtaatattatatcatgccaactacctacaatagtacgtctagccatgtcattggttgtattagttgcaataacaattaaggattgtaaattagacatttcagcacatagtaaatcacaaataataatgagattgaccaataaatacattgatatggtgtatttacatacaattgtcatgtcaattggttcactaccacatccccctgaaagaaagcacataaactaaattgtgtcaatgtctctctgtcgcacttagatctaatatgtatggttaaatcatattacaaataaaaccacgtggtgaacctaaaaagttgtgccataattttgcaagaatgttgatacatgacaataaaatattaaaattctgaattgatacagatgactaaccttataattgttgttgtagacatgcaagagtacggcgtgtatgcgggtgatgtggaagttgttttcgaacaagaggagttggatgattcaggttaggaagatgaacatcaaaacaaaaatctgaccaaaatacaaagacaacatatatatgctgcatttgctggaaaaactaacaatggaaccctaagaaaaaaatgttacttcctccgtttcatattataagactttctagcattgtctatattcatatatatattaatgaatctagaaatatatatatatgcgcctggattcattaacatctatatgaatgtggacaatgctagaaagtcttataacctgaaacagaggtagtacaactgaagttacagcaatgtttaatgtgaaaagggctagagtgcaagctatttggcgaagagtgaagcaatgtcttgcccacggaataccaatcgatgtaaggtctaggaaaaaaaagaattgtggttgcaaaaagaatgaaatcaacatgacagatgttgctaatgttcccttgcaactaaggggcactttacggtcatttgcatcagcctctggtataccaaagagcatgttgcataggatgttgaaagaagtgctgctaagatgtcactcaaacacactaaagccattgttgaaggaagagaataaaccatcaaggctgcggtggtgtctttccatgttagattggcatactttgccaaatgaacccaagttcattgatatgcgaaacactgtacacatagataaaaaatggttcaatacaactaaaaggacaagaaccatttacatggtccattgggaggatgatccatacagacctgtccaaaacaaaaattctattgataaaatgatgttcttggcagcagttgctaggcctagatacaatgaagaaggtatctgcacttttgacggcaagataggcttgtggcctttcaccagaaaggtaccataacctcttcatatatgcatttttacttagtgattttatctaaattaattgttaatctaacttgattattgtactacttaggaaccaccgcaaaggacaagtcataatagaccaagggggactctagtcaccaagacaatcaaggttgatcgagataccgtaaggtcatttctaattgctaaactcctaccagctataatagcaagttggcctcgagaagaaacacacaacagtatatggatttagtaggataatgctccttctcatgtcctagtggatgatcctcgatttgcctatgcagtttcccaaaagggtttgacatccgactcatgcatcagcctcctaattccccatatatgaatgcactagatcttgggttttttgcgtctctacaatcattaacatatagaaggatatccaggaatatggatgacctaatagataatgctgagcatcaggcctatgatgagaacaagctaaatagggtgttcctaacattgcaatcttgcttgttagaggttatgaaagctaatggtggaaatggatacgagatccctcatatgggtaaagagaggctagagcgtctagacattctccctaatacccttagttgtggttttgagctatataataaggtaagaacagcattagccaaccaagtgcagtaaatcatgcaatatggtaaagcactatcctggtttcaacttttggttaaatgtcaggttgtatatatgataagttaagatcagtgttacgcaagtaaatgcaacaaaccatgtaatgtgagaagttttatgatggtttcagcttttgaaatatgtaatatgggaagtttatcatggtttcatattttgggcagttttcaggttgtatatatgacgatgtaatatcagcattaggagtaaatcatgtcatgtgggaagctgtatcattcttgagtttcataagcattgcatgcatcatcgtcatattgtttgtaatgttagaaacatcatattaatttcatttaccacaataaacgatcatattttaaaataattttgcaggataccattcatcaccactcatgtactaccataattacacatgcttccatatacaataccaaaagtccatgcctgcaggtcgatactatgttaggccatcattcataaccaccaaaccagcataaaagcaacacataatttaatcattcatctaaattttgtgctcttaaaacattccggaaaattctttaccgatttttccaacgcatcttggtcttgcatgagttcttctaggccgctatgattgtatagatcttgtgcatatcccccaatgaccatgccaacatcatcgtcgctatccttcatctccttggtgctcccctcctcactaatcacatccttagcttttccactcatatcctcaatgttgatttgcccgatgagtgccttctcaataggagcttgtggtcgctatcgtcttccaatattgtcctggaaaggataaaacacagtaccaatacaagatgggatcagttgttagagacatgaaccttgtcacacttgaaaattcactagtaatttctgaactaatttgtgcataaaatccttgtccaggaatcagccgaggtacacaaactgacaatttaatatacaaatccgtcataataataatattacatacttacaaaagaaaagaaaaacaacagcggattaacggtctagcgaagctccggctccactcccataagcagctcaactgaggtataagctaaatgtctgctccttttagatcctttttcttcaactaaggtttgattaattattgcaaggtgagtacatggaatactccgcaagacacacagcaaatatgcaagtgcaaaaatataccaaaggatggcataatataggctcatttgcaaaagcagcatttagcaaacatttaagaattgtaaaacagtagagtaattaatcatcaatattaatcaacactgaatagcacacccatgctgcacaggcccaaccaaaccttgacaaccaaccctggtcgtacagatcaaacctccaaactaggaataagccattccaaaccagaagccaaattaattatcacattattatcattaatgagtagtgtgggactaatcacgaaaaacattgctcaacttgcccatgaccacgggcatagctattcgaatagttttactctggccagagatgtactactgtacccacaagacacaacccattgtcatgtcaccgtgtccgcgcagacacgtcaccatggcgagtgattgtgacaagacccctcgcataactcaactcaaagcaacgcacctttcctggatcataatcacctcctcaataaccagaggcatgaactccccagcgacccccacggacttctcgccgcttcacagtctggtgcaccacggtgagccttgctacacaaagtgtccagccgttgcccatgctagcttgtggttggcacggttaatgtctcacaacagtagctcgcgaaccggtccttgtcatgagcacaaccatcaaaaccatatgcttacaactcaccattaatcaagttttagttgacaagtaattaataaccaatcacgattgaccatcgtgagctaccattaaatatccatcattaagtaatagtgaaacattaatcatcccaatcatgtgctaatgtttctaagcatggctaagcaattatactaatatctagtcgaaccaatatataaagtccaactagtcaaattatagcccaaggtatcaagaaataggataatcaatgaaaattggccatagcaaaggtataagttcacaccacccgatgacattcgaaattaaatgcacagttgaaataaataaagaatttaaatataggatcaacttgccttgcaataatcggtcttcaattagtcttattgaacacttccaacgcactcacgaaccttcgcaacgacggaaacgacaagctaacacgcaaaatgaggaaaaggactaataaaaaccaaataaacagtacataaaaagtaaacaaacatgtagatcatgattttagatgaatttaaagacttgaacggcctcattctgacttcatatgaattagtcataaattttacaggatttaattcaattaaacctatttaaaaaagattaaataaatttataacacaatttatatataattttaatatatagatctttattttatacacttttgcaacttgaaacacattaatctgatttacaatgaattagaaatggattttttaagattaatctgattttaaccttatacagaaaaggatttatgatttatgacacaattaagatttatttttagaagggaaaaggggctttatgacgtcagcatgacatcatcaccggctgcggcttgggacatcatggtcgccagcgaatttggcagaaaggcgcagcggctcggactcggccgagcggctggaggaaggaaaagaccccgacatgtgggccccatatgtcggcggctgaaaaaaagaaggaggggcggcttggcctgggctgacttgggccgagcgcacgtgaccggggataaaaaagggaaagctgggccgactttcggcccaaagccaaaagggagattttaaaaaccttttctatttaaatttattcatggaatgcaattccatttattaaaaatacttccttggctcaaataaatcccaaaaaatccagaaactaaagaaacaagagaaatatttaccaaagttttatctagaccatttttacattgagatttattaaactaaacttagagcttttcttttaggattttaagatcatttataataactcaatttataatttaaggatttttaaacaaccaaaacatttaacaaaattacatatagatcatttaatgattagtttattgattaactaattactgaaaaaatctttgtattattaaaattagtaattgagctctgaaaaaatccgagaaaattccagatagtataattaattatggagaatttaataaaaattaaatccagtcatgctttatatttagggaattttatttcccacatttaacttcacttgtaaattaatgaacatttaatataaattctaatgataatttattaaataatttataaatcctaaaacgaaaatcagatgcgacagacccccaacatataaataaagtatttcgatttgtgatgtaaaggtgaatctatcaccgaatcaatcaatgtctaaaatgtagtaaagaccaaagggactgatcatggcaatgatagctaaaaatcagagtacatcagtgtgtgtgtatatatatatatgagtaaattccctgtgtacccctgaaaactcactcagtccctttcgtacccctgaaatttacccgatctcttctatacccctgaaattttaacttgatcccttccatgcccctaccgttacattttccattatttcactattacatttggttgcaaatgtctttttttgcccttgatgctataggtttgaatataagcttaaaagcgattgaaaattttgtttgagtgcacagtacgtgcattttatgaaactaatgagactaaataattagtgcagaaaattttgacataaattttggaaataaaaaaggtaataaattaaaatttttatttgaaattttaataggacaatgattttttttgatcgggagcattcataaaaaaattattatgaaaattggttgtcctatctttgtatgaatgatccttttttttattactttttttaaaaataaatacacaattttttatttcattatctaaaaatattttttggg

SEQ ID NO: 5456 - DNA, 1687 bp, Oryza sativa
catccaaagggtaaaatggtcatttttatagaaattagacggtcaactaacaatcaactgacgggaggggtatggaagggatcaaaatcaaattttaggggtatataagaaagtaagcaaaattcagaggcatagaagggattagttaaaatttcaagggtatacaagggattttctctatatatatatatatatatatatatatatatatatatatatatatatatatatatatatatatatatatatatatatatgtgtgtgtgtgtgtgtgtgtgtcctagttaatggatcagagccagggacttgtattataaccttcgaaaaagagttgcgctcaataaatgttaagcatccatgctatttctcgtataacaacagcaagattatctagttaattttttttgcggggattatctagttaagaatggcaatatatgaaaaagctactcctaactattcgtgggtgcagttggactgttggagcaagctgaagctgttcagggcaaggtttcagaactccttactgattattctactcttactgttactagtagttttaaaataaacaggtcaagcaagcaacagccgctagctagttagctgcagccagcaggggtcccaaattaatcatgtcatgtcatgcacgagggaacaaaacaagtgtgacaggctgcattcatggacaccagtatactcctgtaaattagtttcagctcaactgaaaaagagagggcaacatggtatagtgacctacaaaaatgaggggtgaagtgaacccaaagaccgcccataggccacaacttaactaatatttgtggacatagagagtattatggattatcgaggtaagctttgtaagttacaatcttcccatgaattctttgcctacaatcagtcattttttttagaaaaaaaaacttatcaatcttctaatattttttcagagacccttctaatatttaactccacctactttctactttcttaatactttctaatatcaattatctcaataaattggtagaaactcaacatatataattaatcgacaccggaaacatagattgctttaaacatatataattaatcccatattaacattgcaggagattatatatactcgtaattatatgcaagataatacaatatttgatggaacatgaatgttgaaataactgctataaagaaagcatgccaaccggcacgctaatgttctagtacttactatacctaacagttattttcatacaaaaaattaggtatgcaaccacccgccgtgcatatgtgctacatccaccattgaaagcagttttcaatgccattcaaagcagttttcattgcatgagaagaacgtattggtggcagggagatggagcgggagatacctttggtagcagaatggattgtctacctcatcgccgccaatgtccccaactattggcgccggaattagaaaaggaggttggtaagccaccttctacgctgctgtcccctcctgcatcagatccacgggcgctgccacctccttgtgcatcacatccactgccttgcaaacctccaatgcctttgccgtatccgaaccgcttccaccccccgccgtcgccaccaccttgcaaagctccgataccgctgccgcattcaacccgcctccaggggcggatccaacgtgggtgcaggggggact

SEQ ID NO: 5457 - DNA, 2102 bp, Oryza sativa
aaactaaaggtctctaaatggctgtagattgaagaaactgtgtaagtgagccccccacccccccctaaaatttttgttcctagatccgcccctggccacctcctactgtagcctcttgaatcagaaccgcaagccggcacgccttcttcgcctaagctcgcgtatctttaatcaaaactatatttttttccgccgcttccacgtaggggtgggcatataaaccgagggccgaaaaccgacaccgaaaaaaccgaaaccgtaacctaaaaaaccgaagtcccggtcttcggtcacacgatcagaaagaccgaactaacttcagtgagttcggtcgttagggccagctaaccgaagaccgaaagtaccagcattgcaccaggcctccagcccattgatccctcgcctccagcctattaatcccttggctaatcccatcatcatcagaacagaagtacacgaccaggtcaccacaaaataaagaaaagaaagagtcagatcttatcccctcgatctcgccatctcggtaactccctcgtctccatgaccccacgctgatgccatgttgcgctgttcccgtatcccgtcgaggcgttgtgactggcggggttggcgtgcggcggcgttgctgatggcgacgacaacggggacatacggccgtgatccaatcggagcatccgacttcgccgcgcacgggaccacgtcccgccctccgggagccagctcgtcgatgtcgttgtcctctcttcctcgagccaatcgttgtcttcttccccaccgaggctctgcactgctcgtgcctgttgaagggtttctttccacccatgccgccgcgtgcctccggtctgccctctgatgtcttctccgctgctcttcagggctccgacgcggcgacgcgtgcctcccggctgccgcctgccgttctctccgccagctacctaggctccgggcgctacatgtagtgtttggtcaaactcggttgagaccgaagaccgacccgaaagctcggttaaccgaattgtcggtttctggatttttatggacaacttcggtcatctattttcaaagaccgatcttttaaaaaaaccgaactacccgacccgaactttcggttataaccgattgcccagccctactttcatgaacgttgctaccgagcaaaatccttcccaccggaactgtctcctttatcggatctaaaccctcgcaactgtctgccaccacatccgagcggccgcatcctggtgaacgcagaacatcgaagggagaagcgggagcgaggggaagcgacgtggagcacggaggggcgtgcggggaggatcaggaggaagggaagcttgcggcttcgatttgacatctggaggtgcggagaacgagagagagacgagaggaatacgcgagagagaggaatacgcgagagagaggtggcaattccgggaaggggaagagataagggccttgtttggatcctccgggctattaaatagccctccggaatcttacgatttaggagtattaaacgtaaattactgacaaaacccattccataacccctaagctattttacgagacgaatctaacgatgtatattaatccatggttaacatatgattattgtagcatcactgtagcaaatcgtggattaatatacctcgttagattcgtctagcaaaatagcccaggggttatggaatgggttttgtcagtaatctatatttaatactccttaatagcaagattccggagggctatttaatagatcggaggattcaaacaaggcgaaggtttctgtggtgtgagaggagagaaaggtaccgccctcagtactatggcccacagatagatgcgatacataaaatatctagttttttaggctggaatcgcttctttgtgggacaaatcctcccctccagaaatcgcctctttctgggacggagggagtagtatagtagattgtgttcgctaccactagttgggaacttattccagcgcacggaaaacagagcgatccattagcgcgtgattaattaagtatatgcttttttttcaaaaatggatcaatatgattttttaagcaactttcgtatagaaaacttttgcaaaaa

SEQ ID NO: 5458 - DNA, 15974 bp, Oryza sativa
ccccctagttttttaggctggaatcgcttctttgtgggacaaatcctcccctccagaaatcgcctctttctgggacggagggagtagtatagtagattgtgttcgctaccactagttgggaacttatctccagcgcacggaaaacagagcgatccattagcgcgtgattaattaagtatatgcttttttttcaaaaatggatcaatatgattttttaagcaactttcgtatagaaaacttttgcaaaaaacatactgtttaataatttgaaaagtgtgcgcgcggaacacgagcgagatgggttgggaacccatcctaccgaactatgccttaaaaagagtgcaagagtcaaaattcagatgaagtaagaattaccagaaatgggaggaaaaaaaacccaaggaacatacaagagcaaaaggcggcttcttacaaagggtggaactctcaggcttttttttctgagatagaagtaaagtacatggtttaaggtaacatctccaaaggggttggagaataacatctgttatgcttcaacgtcttgtcctaccatggagatgttattctcaacagaagcaggcgctgcggcggtcaggtttgcaggtagcttgggcagcagcaagccagcaacagcaggcaacggtgacgggttgggccgacggtagcagcaagcggttgtgccttgcggcttggatgacagcaacaacaggcggtttgggcggcaatggcggcagcattaacaggctgtttgggcagcagcaacaaagccaacacatactacatcactagcagcaggaactgctaggaagattttgtgacctcgtagcaatgttctgttgtgtagtcagggttgtcaattgcaagattttgaatgaatcatatgatgtgttaatctttcaatttcatgggaaggggtattcttgtcctaattttcataaaaaccaatcttctaatggtgtttatctaaactgtcagtccaatagcaagtatattgaattccaaccattttgatggcaaatatgcaattacactttttacagtggcaaatccacgataccggttcaaactagtggcaaatatgcaattggcccttttttccttccatttccggtaattctggtcagaatatctccttcatcgatatatatcctctacgtctctttgatagatgacatcattggcatcgccataacattcgccgtattcaaaatatataaataccacttattttgttgtgacgtgttttatcattaaataaactttacactttagcatatttatattaattttttaataaaacaaataatcaaatgttactttcgccagtttatattaagaaactagacaacataattgactttcgccagttttaccatttgccgtattcaaaatatttatataaatatctcttattttgttgtgacatattttatcattaaataaacttttaaatatgatttacactttaccgtatttatattttttaataaaacgaacagccaaacattatttttcaaaaccaacgttgtcatctactattaaaataattaatacagagctagtataaggcaaacttcttaccttctttttttaaaaaaaaataaagaacaaattctgaattatgactgtagcgactaaaccgcggacggcttgacacgagcagatgattcacttgagcattatgctttgttcgttcctgggagacctgggagattgagagagaacatctcgttttccacgcacacgtttcccaatatactaaaccgtgtatttttttgaaaaaaaatctataggaaagttactttaaaaaataatattaatctatttttaaaatttaaaatagttaatactcaactaatcatgcgttaatggtctcaatcctcttatctcctctcaaacgctcatatatgggaggaagtgtgaatggaagtgtcatatagttgactcacccactagatctcattgccaatagtgatactacatactactatattacataatacgttaaaacggtcaatgagaataccgaaaatactttaaatcggtctactactatactttattgtggaaaaaatcggatgctacttatactttatgtgtctatttttttctcttcacacctccagcctagtgtgtgcttctgctcacacgtgcaacctaccatgtgccttatgtgtaataaaggataaagttttattacccaagttttaaatacctttttttttttaaattaacttcacattccttttttggattcatttaatacccttggaacttaattaccatttaactttaattacaagatttaaccaggataaaattggtcaaaattataattaaggtttccgcccgttcaaattcgatgtttcacgtgtgaaaagaaaagagaatctttcagttggaatccaaatatgttgcacattgaatgttttagttggaatccaaatatgttggacatttttaatttttcatgttataatcaatttttatctattgttgtacgtggtgttatgtggatgtgacttattttgatattttgttgattcatttgttaatgttgcaccttgtattatttggatgtttcagtaaatattaagtgatgtttcaatcgttacaccccgatgtttcatatagtatataaaaatgtttcaattaacaatattatcaattgttctcataatatggtcatgcttataaagatttaaattgaagggtgaaaatgaataaaacggcgtaatcggattgtagattgtatcaatcatttagaaaactagatttaaaaaaaaagtttgcatagaagtgaggcaacccgacccatgagaggagagaaaaatacaagctgcagagaatcataccccgatccgtagttatctcctgagaatactaatgtccacgaaacaacaacccaaattcaacctaacactatttaggaaagacagtcaataagcaacgagatgccatgcagcccaggcaaaaaggcgaagagacgctacggcaaagagatgatatttgacccatgccatttgagatcagatcgtaactccaccactccaccgggctaaggtcgcacaaaaaatatgacatacttttcagcaaagcatttcactgcagattgatagtattaattaatgcagataacaggttcagtagttctgaccacatcagttctttttttcctggatagaacttaaccatttaaccaactaaacgtgcacatgaacccccatcggactccaaaatacttacaaccagcacgacatataaaagcagagcatacgtagatacggagtaaggatctaagcaccaagacatcagaggccttgatgccttctactcaaaagcccactggttctccctgcggatctcctcttcctcctcaggggtgaagtcgttcttgatgttgaaggtcttgcggatctcctcaggagtcttccccttgatcatgtcagcaacagtctggcaagtaaggtccagcaaccccttgatgttgaggtagttcgcggcctgtgggatttgagaatcaaataaacatggtataagaagcagtaatcactatggctaaagcacagatcaacattcagccacaaaaggaatacatagttcaactttggaatataaaagaaagcataaatgtagaaatgagaacactatgaactgaaacaaattactttagcacatgattgtgtagcaaatccaaattaaaatgcagaaatactagaaatgggtacatgacaccgtgggatgagaaacaaacaacaaagttagaaataacagatatatgtaaaaacttcaagaaaaaaggcgagtgtgtagcaaatccaaattgaaatgcagaaatactagaaataggtacgtgacaccgtgggatgagaaacaaacaacaaagttagatccgcaatagtggagtacacaaataaaacagtgcatgtgaacaaatacggcattttacaaaaaagaaaaaaaaaaggaccctccatagaaagaagttggtatacaaacacttgagcaacaagttaaaacatgatacattttgttttgcaataatttaacatgcactgataccccataacccgtctcattgtaaaattgcagtgttgttaatagtccaccaccatcaagcaacttaatttagatagtaaattcttgtgacaatcaaagaaaaaaatgagactgccatcatttctcttagatcaagagaagtgttaacaattcatgaaaaaagagcagaaagaataaatgaacaaaataacagaactgtttacaattcatgaacaagagcagagagaatttatgaccccaaactgtagtatgcaatgaattgatcaagagaagaacgaatttgtgatcacaaactgtagtatgcaatgaatttattactggatatcaaagaaatatcacagtgaagatacagagacacaattactcaatgcctgaaacatcataaattagagatacagaacaagtactaaatcccttaagataatgcttcaccattttagcaatacagtagtcaatcatacataaaagatgcatcacaagactacatcaatgtaagatcattatctgtaacagccctaatttccttatgaacataatcataaggaggctgcatcaatgtaaggacataacaaaagcaattgacttatgaacaggaaagaaaaacattacaatcagaagggagagaatttattacaacatagaactacaaacatatatcatgcttgatatatgaatctcaaattcttaccaacacgaaaggaaataatgtataacaacaaacagaagggaacaaatttaaagcttgacctaatctaccaaattggcaagcatgcatctaaacaatcaatttcatactatatcatgcttgttatatagagaagcacaaaatccttatgaacagggaaggaattgtgtaacagttaacaacaaaacagaaggggacgagtttattacaacatggcactagaaacatatttcatacttcaaatatatacaatcgcaaaactgcatagctctttatgtatttctttaactaaatgttgtatttaataaaaacccatggtagcaatacatcaaccgatcataccaaaaaatctgcagaatatcaattaccacatctacgcagtcctgatttacataattaccagtatgaaacaaacaaatagcagggcacatttatccaatcatatggtacaatcatcgaccatacagatgaggatacagaatcataccgttaccccatctgcacaaagtacacttgttttccctaatgatattcacgcaaccatgatttccacaactgacatgaatgaatgcgtgatgcatggaaaccacatccaacccagtaacaaacataccggatgaaatacatcccaaaaagcttggaacagaatgcacctcgagctattgaccaagaaaacaaatccagatctagcaataaccgcagatctgaatccccatcaagaaaaggtaggggcgcgatgggggagggagaggggggggcttttataccaggatgaggtcgaagagggtggcctggtcgaccttgacgaagtcggcgtcccagttcttgaggtcctcgccggagggcggcggcacggctgcggcggcggacgcggcgtcgtcggcggccttggaggccgcggcggccgcggcgtgcacgtgcttgttgcagtactcgatgaccttggagaggatcttggagttgacgttggggagcgggatgccgttgtcggcgcagtcgtcctcgatcatgtggcggatcgtctgcgactccatcgccaccgcctcctccacctcgaactcctccccgtcggagctcttcagggtgatcatcttcttctctccctcagccgccatcgatcgagccctccgaaatcgctcgcggtctcggtcgtcgccgaggaggtgaatcgcacgaaaccctagctttcgcagcggcggcgatggggattgcggcgagattgggggttggattgggggtgggtggggaggtgggggatattattatataggagaaatgggagggcgagggctgcgtggggacacgtggagggcggaggagccgtcggatgcggaggtgtggacggccacgattgggtgtgatggtccgggccgcacgctgggtggggccggccgagcccatagaatccgttgccgaataaaagaagaagaagggaaataataccactctatttgtacttggaataggaataatagactccgtttgatattgtgctttttttttgtacgttttactagggttgggcaaatattccccttttttttaacctctatataggctggagatgggtggaattattgcatgaaaattataccggtaaaattgtgttacggaaatatggggacaatagggccagaaatggtaagtaatagaatttgttttcatattgtttattaattgagtaaataatgaaaattattataattacatattattctctttagtgataataaaatatttgatatttagaataggttagggcgaacttttaaggcttatgttatcaataacttctcaaagtgcatagttcttaaaaaaaatggtataagcatattatattaaaaaatattaaataacattaaaaattattagatgtaatatgaattgatggccaaatttcaaaactttgatgatatcttcgtcccatcaaatatttatgaccatagagagtacaacttaaaagattaagggtttgttcagtttgatgctagaattaacctttcaacaccaaaatttggtaggattgaagtgtgtgggttttacttggtttgctaccaatgccaaatattcttatatattgttatgtgcaaaagtttctagaaaatcaccaattttttaggatggtaagatatggtagattatttggatgtcttcagagtatatagcttagtggatgctacgtaacataaataataagtacttttatagcatagtacttgcaattagaggggaaatttcaaatccatcatccatatagacaattatggtttgttaagatagccaaatctgcattaaataagtgggggaaaagaattattacctgctgcgaagttcagaacaggcttctcttctcccttcatataggtctccttgatcattcattaggcatcgattaaatcacgtactgcgctgttgggctagggcagagaaatgacaggaaatatgctaggttggcgccaatacttcacgcctagcgacgatgcggagagcacagagaagtgcatcctcattgtggaaatagggaatgaggtcatgtaaccggtggcaggaggagagcaaagaaatatgggttgtaggatacaacatgcccccaacggtagggttttatgtaaaaaatgcttagccagtagttttgtgataggtgtgcctatttactcttgagaataagaatatggggattgtgtcaatgaccaattagcacaattttgagtaggtcctctcccaaagatccattttttatgtgtgttaagctaaaacaatataatcacgatattattacaaaattttgctaacatgcttttatcatacaaattgttcatatgttcccgtgcgaggcaagaaaagaagatatggggtcgagcaccacttaaggctgcgttcgagagaaaaggttgggaacttctctttcatacacggaaaatgaggtggctcattagcacatgattaactaagttttaacttaaataaacttgaaaccggattaatataagttttcaaaaacaatttcacttaagtttttattttgcaaaaaagttgcattgttcagtagttcggaaaacgtgctacggaaaatgagatattagaagatggaaacttgtagttccgaacgcaaaccttaggcaatgtctggcattgcattttggtaactaatcctccaagcaaaacagaaggactcattagcacaagtttaattaactaaacaaacttgaaaatagattaatatgattttttaaagcaactttcctaatttttttaatagtttagcaatttgaaaaatgtgcacacgaaaaacgaggaaacataagttaggaaaaggagtatagcacgcaagtatatgacatgtttaaggaaattcagtcatttaaaactcaatatcaaattacatttttaaaaaactcaagaatgaatagttatgttttggttggttcggtccggtctttagtcataaccgaaatgtgtggtagtaaaattgtagcaacttttctctctgcagaacatatatgttgacaattaaatagcacatataacacatcaactcatcaagagcatcaatcatagtaatctagtatacttaaacaattgatccccactaactgtaatcaataccaattctttgttctctggtgtaatcaatagtaccaattttttgttctatggtgcagccacatcatcttactttatgctaaccgttggatctaacttgtgtgtctagattagctcctaatcaccaagtagcaaccagccatatttgatcttctgttaatgttagaccaagcctagcccatctacacttctttacaccggccggttcctcttctattgtcatgcatgcatgcaaccattacaacagatgatcaattgatctcctgaaactgccttctttcctcttctgaaactgccttctttcccctatgtaatacttctggtcattaagtgatcttcagagattgcagttactttttctatctcttagactataaaaatagttagactattgcataaacttctcacttcaaaccacatattgccctccgctttcccttcaatgttagtacatgtgttctttgtctgacttttatattatatatgcatcaattcgatcacacgataccattgatttggtgagttagtctcagattttaaagatgttctgtttttctccccatttgagattgctcgtgggtgtttttctttggcaaattggttgcttgattttattttgtgcggttactcattttgcttaagtgcaacacactctatcaagtaggtttacattttggtacgaacatttgggtctgtcccatgcaattcattttaattttgaatttactatatttttcaaccattcttacatgtttacaacggtcaacgatattattatggtagtttgccttttaccgcattaatggctaatgcactaaactttgacagggaattttttgtttaatctgtaatgatgtggatatgaaaaggatatatgaaaggacaagaatcagctagccctaacgaagaacatgggttatatagatcacagatttgttatccacaatcaattttgtttctttggtacggagtatgttttttcatttagtgtacaatattgagtgttgtggagcataattaatatttttccatatgttcatcctatagtgccgcagcaacacacatggcttttgactagatttaacttacaacttaacaccgatcaagatacataattaggtctatttcctaatgtcaattaatcgagagtgctaaccgaattataaccaaattaatttcggttggttgaagagcctaacaaaaatttctgtctatgagcaagttttatagaagaggcaaatgccacccctaattttatccatgtaagttaagttgtaactcctactctctcttttcttctcccctccaccttaccatattagtttagatagcatattacttgctctaataagagcatctccaacaaaattggctatttttgtggaagagggtattaacctgtaggctgtaggagtcggtgtggattgggcgacgatggcagggctcttgatgacggtggaaaccggagagacgacggtagcatcgagcgcttgatccggggccaacaactttcagtctggggatggcggcggccacaacagtggacgatggcgcggcgatggacaaggggcgtagcagatagacgccggtggcggcgcgcaatagggtcatgcgttggatctaggaaagggggcgatggccgtgcgctcaatcgcacactagatctgggaagggggtggtggcctcgtgctcgatctaggagcgcagggagggtgctcgatctgggatggaaagacaatacatacaggaaaggagaaaggggaaaatgtgtggggcccatgcgtggtaagacaactttgtcattttggttggccaactttagctaacgcatagaggactttggccagtcggatggttttcatccggttggcaagtttgttggattaggattttgattcaaaaatatcaaaatttaatttgaagaatgagatagccactctgttggcttcaagttttaacctttatttttttcacaccgcggccacaccgcgtccgcaatgcctccatttcttcctccaactcaaataacccaataatacatatagtccccagcccagcctgctccatccgaaggcccaaccccgctcgcgccagatccccccaaacccaatcgatccccatcgatcaccgcgctccccccggcgccgccgcggcgagaggtagggtttgctcgacgacgcgagggggagcgaccaccgcccgcgacccgataggagggatggcggcggccgagggcgagaagaagatgaccagttttatcgcgaagagctccggcgccgaggagttcgaggcgggggccatccgccgcgcgatcgaggacgactgcgacgacgacgacagcggcatcctgccccccgacgtcctctccggcgagggcctcgataaccgcgacgccggcttcccggtaaagcctccccccccttccccctccccattcgtgcccttctcctcgaatccgaagggattcggattccctttcccatcccaaattcgtgcctcccttctcgaagggattcacagatcttgctggaatagttcagtcaggtttacgtaatagctcgaggtgcattctcttcgcagcgcagggatgactagaaagagggtgggggttcggttgagttctgtggaaaccaaggccaatttcagggagctgatataactggatttttccccccattttggaataaactatgctaattgaattcttcgactgaaagatgccctgttgggggaaaacactatattgagatggtttacatgtgtcatggattcttgctagttctgaaaagtgcagtgcaatattctttgtattaaaggcgggtgaaagaagaagcatagaatgggaggatcagctttgaagaactgccagaaaagagtcaacaaccagaaaaggaaagggagaaaaattaagaacgctgctatacatacgacgctagcgttagactgatgtccgactccgttacggcatcacctgcgcatgtcagattctatcacggagtgagacatttgccgtctgagcctttcattgtggccatggtcgtacacagtagccggacaacaaggtcatacgtatatcattttcaaaaaaggaaaccaggctaaatctcgtgacagtgattactgataagacaacctaagaaacttaatcaagggattacaacatcctgaaacaccactcaggatagatagatttaagagtttagccccatgggcgatttacatgcataatgctagaaaagagtgatctaattctatggattgttgcaatgcattatcatttctgtatctacattttgaagaatatttgctacctacacgttattgttatctcatcacaagtcacatatgcaatactcctgcttgtgtagtgttaggagtaggttaccaaatgcataaaaaacgttattaacaagtgagctgtgcattttaagttcatatcaaagtatcaaacatttatgcctgtttgtatccctgctttgagctatgcatgcttttcaatggtttaattttgtttttgatgaatcttataatgccctgtttatttgattctgaaatctcacagccttcacaaagaagcgcctccaagatcacgggagatcgcgcggcggtgaacccggcagccgctgatccaccaatgcccgttccagggttgcaccatcatcctaacatccccgctgcaaaccgccagctccctcctgccgctagactactgatcaactgtggcatcttcctcgtcgccactgccgggtcctccatagttttccacactgctggagacccttccgccatcgacggtcctgcatatgcccttgttgcattcttcttcgtcctcctcggcttgtggtttgtgctgcttggacccgtcgccggccagttccctggagccacgagggtcgccgttgccattgcgaaagcgctcaagggttacctgctcggcggcggcaattgatcaaatatttgattcattctttatataggtatagctttgctagctcacagtagttttctgtttgtttgtatgtcgtgtctataggcgttgtagcccataaactcactgtaaagtgtgaagtgtatatacgtgttcttgtaaggccctgtttctttcagcttaggattattataatctagattattgagttagattactataagctagattgctataatctatagtagaataagcggttagttgtttctttcctagcttattagagcctagattattgggtttttaagtctaaatagggagtggggtggcatggtggataatttttcacccaataatctggaaaaagcttacctaaatgagcttatcagattataataagctgggctctagattataataagctacttcaataagttgtttgtttctttcagcctactctcaataatctagattataataatcctaagttgaaagaaatagggcctaattacatctgtacatgtctgctctgttcaatccgacgttttgataaatattagcttttctgtttctcttttaatgttcggtttcaattatggatacacacagttatttaaaattggtaaagatcgctttaacgtacatgtgtctcgaaagggtaagagtgataactgattatgtcaagaaaaaagttgaaaagagagatgatgctaccaatggtttctctccaaagggtaatactgattatgacagtaacttgatccatctgtagattgcatcaagagctcaggcctgaccttcaattcaatttgtgattggacaatttgaaagggggatcttcggttttaaatcatgaaattctcacaattgttggttcctggttgatttgtgatgtagggcaagaggactaggaatgatggtgttagtccttctcacaagtttattgcaatcataaggaaagttattttcccctcaaaacaaaaaggaaataattttgatttgattggaagaagtataagcccaaaagaagataacccaataagttctttacagcaacacaatatatattcttttttaaaaaattatcgagtctgttgaaattagattaggactggagttttcgtgtgaaatctatcgagtgaggaaaaaagaggaccggtatcgccagtgtgccaccattgatttcaatggatcttaccaggcctaatctaattccaagaatttctttgatttcgatcgccagtcaatagaatataggagtagtaggaatgatcatagtcttgcaagcacaactgttttacccatatcttcacactagtaaaccattgctttaaaatccgaaccactccgctccacacagtaaaataaactatgaaaccaaaagctaacaaactcagcatttttaattctcatctgctacttcttataatatcaagttctcaagttcaccacataggaccaatattattatgaatctactccctccatctttaaatacaattgttttttacaatttaaatttgtccaaagctaccttttaccatctcaaccaatcacaaccatgtaccacttcactatacttgttttcttaatctccatatatacctctaaagatagctatactttgggatggagaaaatagggaaatgtctcctagatcatatatctactaattctttagaggaaaatttgcaaaactcaccccataaaattacttgaagttttacgttcccccacataaatcatttgttgcaaaaacctccctaatatacacatatttaaccgaatcaatttgttttcataaattgtgagcagttaacgtgatcttaatcaaagctaaggctgtgttcggcactacactttcctaaattctactccctcattatccatgcacacgctttccgaactaataaatgatacatttttttaccaaaaaaaatcgtataagaaagttgcttttcaagttttcattaaatcactttttaagttttcaagctaatacttaattaatcatatgctaatctaccactccgtttatgagctggggaaagtttcctaccccaagagaaaacaacctaaatacttttaggtactgtttggctaatgggataaggaaatgatttcccactcaccaaaagacatctttaaatcataaccattcattctctctcttccatttaatcctaacccttcatttattttctaatcccaatctcccctttatttcccattatctaaacacacccttaggagtataatcttgactttatttttttttgagattccataaataaaattgttgatgagagattaaacaatgtcgcacttatttttgctatgtcggtaaaaaaatcgatgaaatataaagaataaatcaaatacaagtacctcgataagattgactcagctagcttagtctgggggtacctctacagtagcaataatagctgatttggttaagccagtgcgcactgggtggttgttacatcaaaactaagtggagtggtgggcatttgaaaaataaataaattacaggatggaatgccaaactgatggtctttataactttccatcattgaaaattttgaaccgtgtgttcaaaccaagtagagtggtgggtatttataacaaagtaagggtgtgtttagttcacgccaaaattagaagtttggttgaaattggaacgatgtgatgaaaaagttagaagtttatatgtgtagaaaagttttgatgtgatataaaagttggaagtttgaagaaaaagtttgtaactaaacaaggcataaattacatggtggaatgtaaaactgatggtttttatagctttttccatccttcaaaaagtttgtgccgtgtgtttggatttctcccacaagggctctcgtgtcaaaatgtgccgtgccagtgtgtgggggcagggggtaggcaggccacacccacaccaccgagtagagcgagtgtacagccaccacgcgtgtccacccctcgcacgagagtctctccaccactcgtcgccgactcgtgcgagcgagagagaagccgctgactgcaccggaccgcaccgcaccgcacgcaccccaaacgctatccaactcttatccccttcgatcccccctcaaccacgccatggcggcccttcgcccccgggccgccgccgacttcgccgcagtcgcccgcccggtcgccgtacgccgaggcggcgtctcctcctcatcccgctggaagctgcaggtcccccccccccacctcccgcctctctacgttctcggttcctctcttgcccgtgatgtgtaaatccactaggggggatgcgtggagtctcgtggttcctgccttcattgatcgttggtgttcatggcggatgatgattatgatgatgatgacgtggtattttatatttaggggcggtgctttgcataccggagtgattgatttgagatgaggtgtagcaaacgacctcctgcgctgcaattcttcccactcttgtttttggaagttaggagctttggttacgacgtacctgtactgcctaaatgagaggttttacttctcaagtaggctgtttcaaactggattcgagctctttacttaaactgagatgtgtgaaaggagataaatttctaatgtctgtttctattaagttttagtgtttccttgttactgctcaatagtagtcttagtttttatagctttagagtg

SEQ ID NO: 5459 - DNA, 12355 bp, Oryza sativa
tctattaagttttagtgtttccttgttactgctcaatagtagtcttagtttttatagctttagagtgtatgtttatgtgaagtaaaacttatactttagtttctcttttttttttatttgtcagttgtcgtctttcttctatcagtatcctatccactgcaccgtcaaaattgttttccagacaagatatttcaaaaattcactagtccacagccacaacatgcatctttgattcttaccgaatttagtctgatttattcatgccctctgcattagtttaatctagttgttgcatcattgatttgtgcgtgtgtttcgcctagaatattgtcataacaattgctgccctatcaactttgcaacacagggaagtatgttgaattggaaatctaaatgcagtaccagaagtccacggactacagttgctggtgcaaagcctgatgactctgaatttgaaagtgtcaatgcaccactcgagccccaaacgtgggaaggaagcttcttgtgtggtttgttgaagaaccagccacaagtactcccagttgctgcggcaaagcaacttcaagaactatctaatcaaagaaaggacaccttgatccgctgggaacatagcatcggttctcctgaggactgccttcacaggttagttacaaatgccctttgtcaaaagtgtttagtggtctcaggaggtcgacatgctgctatccttattttttccccattcaagttctctgttatatttcaagcgtaaattgtattaattaattattaaacagacaacgttgcacttttgtgatagaataaaaaacagcattcacttagaatggcattttattttgttgtgctgatgaagaacaaccaattaggtgatacctcttcagtccataagctacctgttatttggacatatatgttggattagaaaatttctcaactaattacagaaataaaatataggttgggttaatgaaatcatgtgaatattgtagattgcaagtgaggcttgaaattataaaagctagcttcaatggttaaatgatgggagacaacctggagctctaacgtcatttctagtctttttaatatgaatcatataggagcgtcacttataatatactagtaaatctacatggaagaatatggagggtcaggtctttctttaatccattctagttgatactgcatcgatatttttgagtcacaagcttcattgttaaaaacttaaaatttaccaaatcatttcatgtagctagcataattgtcactgcaggtgatctatattcggcactaaaaagtctatattgtttgctccttttatctttatattgtatttgcatctgaatattaattgatttgttgggacttctacaaataggaggattgctgaaatgaaggagcatgagtgccagactgctattgaggatatcatgtacactttgattgtttataaatttttcaagattgaagttccattggttccaaatctatcaaagcttatcagcaataaaagactacaaatatggccaccaagggaggcagaactagaatcaattcatggacctgaggtgctaggtttaattagggaacacttgaccagtattatcagatgggtacatagaaatggtcccaagatcaatcgctcaacacttagaatcaaaagaatgcaatttagtcggatttattctgcttcaataatgtacggatactttctgaaatctgtcactacaaggcatcgtttggagctgattcttgctcagtcacaagaattttgcccaccaattcagtttctgaatgcacaatttaatagcacccagaaacaagaacaggaagagtccattggaggttctgcagaaatatcatcttcctcaaaaccgagttctgttgttgatctgcatgacttgaagagttacatgatgggctttgatccaaagaccttggagttatgcgcaaggctgcgctcatgcgaagcttctaatctcattgagaagcacagttgggcactgttcagagaaagcatgaaagatttcctagagcctgatgaggcagtgatactcgatccgtcatccctaaagagattgttgcttgaagccattgcatttggttcctttctttgggatgttgaggattatgttgacgagatttacaagttgcatgatagctgaaaaaagtacatgcaggaaactcctgatgccttgtaaatattcttgaatcttgtatatatgattagatatttagcttcttatgcatgtaaatcttcctgtcaaaattttgctatttctagcatcccagattgccagggtgctgaatgactgccgtaatttgctactcctataaaggttttggtacgatttctggagccaggtacacctcgtacttgtaatttgtgtttttttctccaggaattcctaactgccgctattcattttttacatacggagtatagtttgcagtcttttacataagtactactgtaaaactgaagcttaactcgatgtaatcgtttgaaagcttgaaacatttaatactactaccatgttgtgactctcagagcacctgataacttcagtagtgtttggattggacccagaaaatatggaactgactgaactcatgcccagaattacaccaagcagcatcactgctggcaattggacaattttctcatttgtgaccacatgagcgacagagactcgtgatggcgtatgagagaaggatgctctgctgctcccctggtaaccactgattagcaaatggatggtccagatctgagccaccatgaaccccaccacccctatggttcaatcattcaacaaaattgcacaaaaccaagaatctcaaatgagtttccaaacatgttcagagctccccaaagtccaaattaatgtgtcaaatgagcttcacaataaagaaagaaagaaatcgaccatgaatttttccaaacatgttcagaactccccaagatccaaaaccaatggtaaatctgaacttatttaggctgcgttcgtttctccaacaagagttggatgaaattttggatactcatggcacgttttttaaattgctaaatggtgcgtttcgtgggaaaattatatatatataaaaattgctctaaaatattagattaatatatttttcaagtttgtaataattaaaacttaattaatcacacgttattatcacctcgttttgcgtaaaacacttaatctttatctttatctacagagattcaaacaccaccttaggtgatgttcttttctcctgaagatgaagattaagttttttacgcaaaacgatgtggtattaacgtatgattgattgaattttaattatcacaaactttaaaaatagattaatataatattttagagcaacttttaatataaagctttcgtatgaaacgcaccatttaatagtttttaaaaatatgtcacaaaaatcttaattttcatccaattgaagaaaagaacgggacctggtaaacctgggccactctccttcgatatttgctcctccattgaacagctccagaaaggacacaatggcaggtgcctacaactggctgtctggcactgcattgaatgcacctcctcactcactctcacacacacacacacacaagagaggctctgcctctgcctcctcctccatcaaggaaggagtacatcacaggatacagatccagactccagagccccatagagagagaaaattcagctactcctagatgagaccctgagtgagagaagaagcaaagaaacaacaacaagaagaaagagagatctccctcttccatcaacaatgccaccaccatcaatcaccaccaccaccaccaagctgttcttgctcctcctcctcctccatggaggccactgcctgaagagcttggacatggccatggagatggagatggattcagaggctcacagcaggatgctgtgggagtccagcagcagcaacggcaggaggtacatcagctacgacgccctgaggagcgacgtggtgccgtgctcgaggcagggtgtcccttactataactgcaggatcatgaccaccgccaacccttacacccggggatgcgagaccatcaccaggtgcagggatgtggatccgtgattactactgcactgcctgcttgttttgctggatgatcttgccatgagaggaattgcaggagtggctacctgagatgcaaatcttggtttttattttttttttgtttttcttttaccctctcttctgttctttcttcttctttatgttctgcatttgctgaatcattgtaggtgattcatggatgatttacatgttcaaagatcttatgagtatgtatatgtaagatctggttgcaagctataatattataaggaagcttggatcaggggaggtgtgctgctttgtgcttgaaattgtcggcattgataagatttgatgccatcaattgacatggaaattgctccttttcttcgtttgtacaattgtactggtatgttaaagttggtatacgcaattgagcacgttgaatcttttcggatgctcatcgtttcttcaattttttttaatagctagtcgtgtgatgaaacctggttcgttcttgtttaataaagatattgctttgcagtgttttcaggggaaaaagactcaaatttcaccaattcattattcatggtgtgattcctcctcttttttcttggtgaggaaatcatcagtttgtgtatcaacttccgaacatactgaattgtacagaagagaagggtataagtctgaataaattcagaaagcactcttaatagattatgactggcactgttgcttcataaattcacacatctacttgagtgtctcagtaacaaaacaatgagcattactccgaagtgctactatgttagatattgtaactacagacaagagatatcacatgaatttggatttttttttcgagggagattctttaaagaacagagattttggtgagttaaaaaaaaaaagaagaagaccacatgctgacctgtagtcagccaccaatccttaatgcagagatcacatggatgcaccgacacaatcacacaaatgtcatctacccacatttctcccaccggcctgcgctgcactccccaaatagtgccctactgccctgacaagaaattgactgttgcacagtgtgtttgtatcgcaggtcaatgacgttggcatcgccatggctaaagtgatccacatagatagacccacgtaaagagattttaactatagcaatctccacaatgtatataaatacaaggtagcattaggccatcagcaatgggcacctcctcaacccgtgtctctcctcacggccgtccgcctcccgtcgctttttgaggctgatctgttccctagcaggggagcgcggcgcctcgcaggggacgcggctccctccgcgccttgcctactttttcgtggggggtctgagccaggcactgcattgaagcgtggggagctcgtggacatggcgccctaccccgatatttccccttgtaccctcgccctcatccacagccggcggccggcgacctcctcgtcctcatctgccgccgctgtcgccaccggtggctcgccgttgaccacctcgatgggagagagggagagggatagggagaggcaaatgacggcagtgagagggagagaagaagaccagatctggccacatctcgctgttgaccaccgcatcggcatgccagatccgcgcgtggctccccgtcggtgacaggcagaggaagaggggtggcggcgcggcacacagcctccagcgatgaccccacgacgagagagagagagagagagagagatggatccggtggtggagtaggcggccctcctcgtcgccctcgccgattaagctccggcggtagcggcggcctttctaatctccctcgcactccggccacatctggcgaggaagagtggatggcgagcggcggcggcgggagagagaggagagagaggcgagcagcggcgggggagagaggagggaggtggtggtggcggcgagatgggcgacgacgaagcgaaaagaagcgagaagagagggcggaagaaaagagaaggaaaaggagagtaggctggcaggaaggggtatttggggatttttcatctagggatactttgggccaagacacccattgtgggctatagtatcctcaccgggttgcttcagattttgaggagcccatccaggggtatctcccagtgtgagctgagttcccctacgagtgttcatagttagtgacactctaggagtggctcacattgtggatgctcttaggagatgagagagaaatagagatagatagtattatttatttatgggtagtccatatgcttaatggatatcttttgttgttttctctatatggactagttacataatgttaataggtagctgaataaaatataatattatctatggactatatttgcatcacattgtggatgcctaactgtcgaaggtttcgctggatttttgtttcccagttcatatgaaagttgaaccaattttcatgaaaactgttggaagaagttaggagtattgttcttttcagctatttcactggattaattttgtggattatcgtattgcttagttctcttgttttaagctatttgttaagtatattcatcaaaatatttaatttatacatataatcatctagataatcaactgcaataaaaccggtcttggctggagatgtaaatgagcaacatgaattagaattacaagaacatttcaatggggtaaaatattttttatgtgaatatctgtaaaatcaaaggtgtttttttggttattattctatgatgaacaattgggcattggagattattggttttgttatttggaatttattcacgaagtggtttttggaaatatttagattcacaggtgatcgcaggatttattatttcatgtgaccggtcagaccgggctgtgcatgccggtcagaccggcggtggtcgagcggtcggaccggccagctcacggtctgaccgaccgacgctgtgtcggtttcggtttcgggttgtttgtttggatatccgtgattatttcatgattatggcttctagatggatactatacgtatgtaatactgttgtttgctaactcgatgcctcgggagagtatttgcggtgatggaccgggagtcggcttggggataagacgacgtctgtggtggtcagagatcatgcgagatacttaggctagagttaatgcacgtggttgatggagattccatatggcatacgatggaggtattgtgtgcgtatgagatgcggagtcgaatttggaaggactccaaatttggtacgattggttatgtaaagtttttttcttgtactagagggtttcctaaggtgtttaggactcttagtatgagtttggttcgtgggctttaggctgcctacctcgggtatatatagagagggagtgtgaggcttcccggtatcgctttagagagcaattgagttgagttttgagttatggtttcgagtttagtcgaaatttttgtaaggagtgctgttggtgcactttgtaaacacagagagaatcaataaagtcgtcatctactttaagagttcttcgatttgtgtttcatcgggtttcggcggtctaaccggcgatctaccggcggtcagaccggcggcatacgggcggtcagaccggtggcagcgacaggggcggcaggcttctcggcggttcgaccgatcgatctacatcggtcagaccgacgttcatcaggcggtcagaccggcgcaataccttcggtcagaccgcaatccatcaacttcgaggataacttttatttccgctaaaagttttcggtttttgggtataccaaccattcacccccctctggttggcttagttcttgtgattcgatcctacaatatcatcactatatggccataaatttgtgattagtaataaaattacttcaggttcaaccgttcaatggtagcagaagtgactaaacaagtttgttaaagagtcgcaaaactgtcgcctgtcggacactggcgcggcatgagctggggagccgtctacacgctttgaaggattttcaaagagaaatggaaatgaagtgacagtaatatttgtttaggatgtgtttggaactacatgttttcaacttctattttcttattttacacgtacacgtttcccgaccgtttaattgagtgtattttttaaaaatattctataggcaagttgctttaaaaatcgtatttataaaatttctcaagcttttatagctaatacttaaataatcatgtactaatgagtcatcacgttttacgtgtgcaggagagaaattcccaaccttctctctagaaagcacccttaatccttctcccaatagtctcgaccaatgaagatctaatctcaaagaaaacaacatgaattctacgtggttatttgaaagtacagtgtacccctacaaaagatgacacaagcaggttcgacatcgctagaatatctattatgttgtgatgagaaagcaagtttgattgcctatgtgagtgctcagattctaatcttggtaggtatctggtatatttggtgggagaaaattggttcatggtgagaaggtgcaagaaccaacgagggcggcaatggctattggtgtactcccctaaactattgaaaagccaacccgaggaatataggcattgctagatcgggatggtgtcaaccataagagggaatggttaaattgaatgtagatgccattgccaggagatgttctttgggatgataaagtagagtacatagcattggcaaatgatcgcatggagtattactgcggagattcatgccttgaggaatggaattttactagctagaggtcaacaagttgatcgaatcatcactaagttagattgtatcgaagtcatcacaatgatgcaaaatggagggttctcgacgacagcagctgcggcgatctataatgaatgtgtggttctttctgaagcttctacattggtaactcttgtttactgtcctagagaggctaatttagtttctcacgagcttgctagagcagcctggcttaatccaccatctatttggttggaggagccagtagcttcaattaagcggttagtgagcgatgtaactgctctttgatctaataaagttatgagagttttccttttctaaaaaaggacggcacgtaaggtaaaaaggttacgtgaaaagcacatcaatgttgttgtggttgcagcagcggtgccacacgctcctcacagcatgtgtgggcaccgccaggccagaccgtcctgtacagctagtgtaatggctttctccctttcccttccatggcgagacctaacgccgcacagagatccctacacaattaaacgctagtagccgccaacgcgcgacgcgtaccgtcacgttgcaatctacagcagtcggcgtattggcaatgcgctgcacgacagtggcacatccatgtacccaactctgaaaaattccagcatttctttttttcgtagcttcgcacagtttgatagtttagcaatcccacagaaaacacaaggtaggcagaaatcaaacggattgattattggcaaatacttgacattccatgattccaaaaggcacagctcctagaaattagaaacaagaggaggaaaaaaaccgatgggggatgaggttggcaaccaaaccagaggcagcagcagggtgggggagagagcgttttatgaaacctatcatctcgatgggcagacaaaatccgtaacacagggccagcttgtgccgaggaagaagatgacgacgacggcggtccacgagagcacagctggtcgacgattagcggcggtaggaccatggtttgtgtgtgtttttgttttcctactccttgtacttcatgctgtcgagggtgaagccgggcatgtcgaaggaggtggcgaacttctcgacctccagcttgaggttctcgatgtccttgttgttcaccaggcccttggagaagtccttgaggagcttgccgtgctccttctggatgttgaggcagatggtcacggcctggtggaggaactcgccgatctgctcaaagtccttctcgacaagacccctggatgtcatcgcaggagtacctgaaaaccagccagaatccgtctgagatacttgcttgtgcaaagaaaggtccagtagtagcacttgtgttcgatataactatcatctatggacagaggctctgtagtgaaacatggagcgaagcaattcgcatcagattaattcatgattttgcagagttgtgttttgtaaccatgaatcaattccatagcaatcagcaagatccggactataagatgttactacattagcatgataatattttctgtgaaggggaatgcactcaccaatgcggacaccgccaggagccaatgcactgctgtcaccaaagacagcattcttgttaagtgtaatgctgcaaaggtcacacatcttctcaaccttgttgcctacatgagtaaaccaacattaggacaagtttaatagcactaattaaaaattaacagcaattatactgaagaatgcaaaaacagtctgcataccagtcaagccaagagggcgaagatcccagagaacaaggtggttctcagttccatcagtcaccattttgtagcccttgctcataagatacttgccaatggcgacagcgttggccttgacctgctttgcgtaggccttgaatccaggtgtcatggtttgctgcagagcaacagcaagggctgcaatctggtggttgtgaggaccaccttgcagtgacgggaacactgcgaagttgatcttgtcctcgtagtcatagacagcaccctcaggctggcccttcttgggaggcttagggcccttcctgtagaagatcatgccagctcttggtcctcggagggacttgtgcgtggtggtggtaaccacatcacagtactcaaaaggatttgcagcttcctaaataaatgaaacaagcatattttagagactataggactaaaattaacattaatacatcatcatacagttcagacatgccagacaccaaagaaaaacaacctgaatgaacagtatatcttatgattttgccctttatatcccagcatcggtgcacgtaataagaaattgaggaatatgtcaaacatgtattcttatggctaacaggaatatccactcagataattctttagagatctgttaccactcagcaaaaaagctattgtttcataacaatgtttataaatatataagatgaagcaaaacacaacttgtcacaaatgaatatattgtgccctataacacccaaaacaaacaaattagatgggcgagcgcaaaatagcaaattgattgaagacaactaggattccattgtgtatccactatcagagtgctcggcaagttgcatgaccgaacacaggaaaacaaatcctctaccacagactaccagatctatcatatttaaagaattgcactaaagcacactgaaagactcaaattttgtatcgaattgctaataaacaaaacaagctagaagacaaagagacatacatccttccaagatttgcctattccaaacaaccccaacacccctcacccaatttaggtccttatagatatatgtgtataaagctaaagttaccacatagtttaatcacatacaaccaccaaacccaactaacccagtccttccatccgaaaatagggcaaagatatgtccagattcatagtattagaatgtttctcggccgatactagattgctatatttcgggaccaaggtgtagatccaatcaaccaaaccccccagatcgggcatccaattcactctaaaacccaactcgggattactcaccatccagatccccaaatccaacctttacagcagacagcaacgaagcaaatgccggcggacagaattttaccccatttcatttttcatttctgaaatgcaacaactaatcgagacgagttgggggtgggaggattggactggataggatttttatacctgcgcggcgacgaggccgctgatgtgcgccatgtcgcagaggagcagcgccccgaccttgtcggcgacggccctgagcttggcgtagtcccagtccctcgggtacgcgctgccgccgcagatgatgagcttggggcggaagtcgagcgccttctcctccagcttctcgtagtcgatgtaccccgtggcggcgctcaccttgtaggggaggctctcgaagtagatcgacgtcgcggagatcttcttcccgcccgcggtgtagtagccatgggtgaggtggccaccgagagggaggtcgagccccatgatgcggtc

SEQ ID NO: 5460 - DNA, 3502 bp, Oryza sativa
tggatcaatttttttgtaattttcttttttatttatttttaatcaaatctttctaccagcgggggcctcccgtgttgtgctcctttcaaaaaaaaaacagagattgtttcagcaattgagcatatacaagcaaaaatacctagtactacctctgtcccaactagctacacacggatacagatggatcaacaattttaagatatggaagtacaaatatgatagcccaatagagacaaccgtgtagatacattatctttcaagataacgaagcaagggggtagagtctcgtggtactagctatcggtctcaatgtttcgaagattgtttaaggcagatgtgcattctttaaattttttttataaaaataatatgtgacaggtttataatgagcgatatataccatcaataattatgtatatcatggtgttctaagattatatactttttcatagagaataaaaaaaagtatgaataactaacttaacgtgtgtagatgtgtaaaactagactaaagccagccatgccaatgctactatacattagttgttttttttaacctatggacagtcagccatcgaggtaggcacgagcatgagccacagtgtcacgagccatggagaggtaataggtgtgagagtatatatcaagggtagagctaaagtgtaattattaacgggtctaatgacccagtgaacttctataaactttatggtaaatcatttagtcacggttaagaaaacaagattgactctatggtacaacgtatacaacacaagtgaccctggtgattttttccccaagatccaactttggttggtatggtgtacaaatattaaggtgcatgggagcggcaacggataaggtagatctagaagatgacgaactcacgcatacttgttggcggtaccctttattgatatccggccttcaacaaattcaatatctacatcacatctagaccacattatggtttaccctcaccttcaccccctgtgttttgtcgtaccatgcaagctcatatttagatgtgctagattgtatgctatgttactttgaaactcacgattataaaaatagaggtatacgtatgggaaaagagcaatgcactagaatttagcacacatgaatttgaaagatggatcatagaaaagtgaactggaacattagtggattatatacagatgtgagagataaagacagaagatgcatattggacttctcaaaggaaaaataaaataaggtttgagctcacatgtaaatttcctttggaattgagatataggattgtaatccaaaagaatttttcaaactacagcaggggatccagaaaattcacaaggacgaatcctcctttgatatattcctatagactcatttgttgatcctcagtgagctttgagcaatggtctcaacgtgaatatatagaagtaccagtgtaccactaaaaatgctgcattcagttcacctaaaaaaaaagctgcattcagtgtgtgctatgtgtgctagcggctgctctgagctgcataccaatttcatggaacattttgaaatggtaacgactcacaaaagtcctctctttatatatttaacccctaaatcattttagctcgatgattagacaaaagcttggaggttcaattagtggcctccttgttctgcctttttcctttcctatctatattaagagactttgttaatgaccccttctctaatcaaaattagcggactgtttccagcttaaactacaaaaaaatgtggacttcttttaacacctaacagaagcacttggtatatatctttctcccttgtgatggttgttgaggttggtgagcgaaaaggacccttcataattggcacggtaagtagagcctgtagaggttgttcgtgtggtcaccgtgtcatgctaccaagatcattggatccaagttgcttcttagtttttgttgatatcaatattagtctctgtccgtgaagacatatccatgcaaggaactgatttgtgtgacatgtaaaaaactaatttcgaatcctaatacaagataagcccccgagctgcataagggagagttcgcagacgaagaaaatgaagacccaattctgtttgctaaaaccctaaacctaatcgtccgatcgacttgaaccgagaagaggtttgtgtagctatctcatgcctggtgaagactcgaaggctatcgacatcaagctaaaagcagacaattagatcttgatagggccggtgtcctatttcccttatgacacaaccaaaagaaaaactataagagaaataagaagaaagaagagaggaagaaccgcaaatagaatatatcaaacagacggcgaagacgtgtcctaggagttgattatttgaagattatgcacgaagcttatattttttctttctgttctatgccgctaaaaagaaagataatacctatatgctaatgagtttgtttctccatcctcaccaagataataagtggcaaatagcaatctggtagcccctaatgaattagtgtaggtagcaaattgcagattgcatatgctatgatagatttaattttatggcaataatacataccaaaccattatccgccacccaaaacgaatctaaccccggtcaaggtttacaaaatgacatatatattatcaagataaaagaacacatgacattatgttttttctatcatgcataaggaaacctatatatctaaggctccattcggtagtacaggttcccaactcctcctcctcgttttccacgcgcacgcttttcaaactactaaacggtgctttttttgcaaaaagtttctatacgaaagtcgcttaaaaaaatcatattaatctattttaaaaaaaataaactaaaatttaattagtcacgtactaaaacgctgcttcgttttgtgtgccggggagtgagccctcactcccaaacagagcctaagtatagttaatgctaattctctctcctctcatgaagccacatcgcatcaattgctttaagcctttggagattcatcaagggtgtaaattgcatctcttcatatcacctcaattgtgtttaaccttttgacgatttatcaagggtataaattacatctattcccccaaaaggcacaccatacaacccaatcatttataaactatagataattaataaaggtacaaaaatatatataaacacataaaaaaaatcgtatagtaggtaagaaaaaaaatagaactcatatatattattatcacacaattctcccttagcaacacgcggggtacccatcttgtattatttaagcgcagtaagtcaatagcggttgtaacagtagttgctaagtgctgtagcttccactaagtttgaatacactatttttgttcccctactgctaaccttggtcaacaggtcctaaaatggttattaatcagcttaggttgagtttttatcagcatgacttcctcgtttatcacgagcatgttcttaactgttaaacggggatcctctagagtc

SEQ ID NO: 5461 - DNA, 1425 bp, Oryza sativa
tactctgagtttcaattagctttataaactttttcaaaaaaaaactttttatatgaaatttattttttaaatttgtaatagataatattcaatcaatcatatgctaatagttttcttattttacgtgtcattaaaaagctcaaacgttgagcctattcgaataaggttgcattctgacacttggtttttgaaagtcgaaatggggtgattagtgtcaatgtttgatgtcgcgattccagtatttgcatagtatggggatcattggtaccaggatatatgcgagattgtagtaaaagagacggggacgaggaattttatacaggttcggacccctgaattgtcaggtaatagccctaaatcctgttggccgaagccggtattgatcttattcaccataatcacacctgtacaatatttggggtagcctatctaactgttgtcgatatggcggtctgaagctctgactcgtagtcgacaacagggtagtcttcctccttgagttcgtgtccggcgagatcagagacaatgctagatccttacggccggcctctgtaggtattgaatagggtcgatccaggcatatctttgatgtcgatatccggcagctcgtcttggcgtatgttggcttgtattggcttctggctttgtggcgtctatgttgattgtccgtctcccctctcctcctatagggccttgtatttatacccataggtgtccccttgtccaagtagaactagggaaaccaatatggatacaatccgagtagtccttgtcgttttcatgtagaactctattcatccttccttatgcggaactcctcctatatccgaaggttgtatccgtataagacatggtatgtggtgggtcctgctgagatttagtcaactactattaggtatgtggtatccataaccctgacaattagtgtgattaattcggtattaactaacataaactttaaggtggtagcactgtggcagggagcaggagctagagccaaagaggaaacctctatgccatgagttaggacatctacaccttcccaccaccgtctcgccctcctgcccacggccatcttcatcatcgcaggctcatctgtgcgcttagatctgactcgactgcttgacctcaacgggcagccacatccaatgcctcccttcatgcggacaagtgggcgagatcgacctcgacagggctcgccgggtgccactgccacaaccccttcccgcagagctcgaactcaatggggtggtgccagcatgtgcgtggtactcaagctcgagcaaggcgtgttccaaatctgctaccgcctaggcttcggtggaatggtggatgcggtagctcaaggttgagttcgatggggctcactgaccaccgttgtcatgttccctccatcacgccacactggagccaggagtcaccatc

SEQ ID NO: 5462 - DNA, 7000 bp, Oryza sativa
atgtggtgtataggcaagggtggttgtcatcctgctaccctcattgcactatagtccatccatgctgctgcctattgctgccaccatcgctcagcggctagtattagcagtcatcgagctcaacatcctcgtcactatggagaatagggggggagggctagctagccaggggaggaaagggtgaagagggaggggagagagaaaagaggaagagaacggatgacatgtgggccctatgctgggactaacatgtgggctccacatattttttattttttattgaaatcgataatgcatgtgggtcccatttattttatttttacttttttgttgattgtgacttcacataagtgccacgttagccgttacataggataaatactgtgtcaacgtgccacatcatcgaaaacgaccgttaatactgccgagggagttattttgcacatgttttaatagttggaggagtagttgtgtggtttggagatatagggataagattcgagctatagttgagggagtcaagttggctatagttgagggagtcaagttggactttttcctatctctggtatagttcaacttccccctgaaatgaaggctcaaattagagctgaaagccacattctttgctggcctatgggccgcactctcagcactcgtggatcttagcccatcatacccttggagatgcacttaaaaatccacgggaatttattattggaaatcatctccaaccaagaaaggtagtgtgaagaccatatgcaagtttcagtttggcaaaaaaatgacagcgaagtgttggaatatccgggcacctttcactgtcccaactcggtaggcgtactgcatattcctgtggttggtgaagaacagatccaaggcagcgtatatatataaaaatttcttcacaaaaagaaaagattcagtgatctgactgaaccaaccaaccaaatgagagagacatgctttgccagtagaaaggaaaagaggagaaaaactgagccgtcagagcagaatccaccaaccccccatggtgtgcatgcctgaactaatggcgacttaatttggtggtagctcagctagctgcaaccaggttgactgatctgcagatcttgccaaccaatactatacttgatggcaactaatttctactaattagtaaagtgagagtgagtgagttagtgagaggagcaaggaaagatggacgatggatggcaagggaaaatggaagaatatatataatatcattgccgacgacatgctttctacgcgtgatctcatcgatcgatcggtcggtcagtcggtgggccgagcaaaatgatcgagttgatgtgtgcctgcctgcctccgcctccatgtggtcggtggttaatttgggatcagaaatgctatggtgtaaattaaatactccctccgtttcgttttatttgacaccgttaactttttagcacatgttttaccgttcgtcttattcaaaaacttttgtgaaatatgtaaaattatatgtatgcataaaagtatatttaacaatgaatcaaatgttaggaaaagaattaataattatttgaaatttttaataagacgagcagtcaaacatgtactaaaaagttaacggtatcaaataaaacgaaacgaagggagtatgtctatatttccatctcatcgaatcgatcaggttacattccattgacttgaatgaagtttgcttttctacccgattgaacagcaatttgataggtgctggccgttcctgacgttttggagcctggactgtattgatacacacatgagttcactttccattgctactataaccaattcttcacttactgattagcatattcttcatgtaggtttcgggctctatctcttttgattttgtgtgcaagagtgctttagagatcggcaagatttatttccaacaaactaggtttcacgcgttaatgactcacaaacaaagagaacaacgaaactctacctaatttaaatgttatatgaaattataacaagctgtctattcaaatgatttgatcgtattacaaataaacatcggctttcttatctccaattttcctctaagtcaatttgattatcaatcattacccgtatttgacactggcacactgccaacagctatctatctataatgtactctttccatcctaatattctaggattttagctgaatgagatatctgttctctagatttatattattagaatatggcattgttcttttgtccaataaaagttggattaaattttggatactcgtggcacgtttttcaaactgctaaacactacgtttcgtgcgaaaactttctatatgaaagttgttctaaaatattatattaatctattttttaaatctggaataattaaaactcaattaatcacacgttattacaacctcgttttgcgtgaaacactttgggtgtgtttgaggagaaggggattgaggagattgggaagatacgcaaaacgaggtgagccattagctcatgattaattaagtattaactattttaaatttcaaaaatggattaatatgatttttaaagcaactttcctatagaaattttttataaaaaatacaccgtttagtagtttaaaaagcgtgcgcgtggaaaacgagactcaatcccccctatctccccagaactaacagagccttaatcttcattagacattcaaacaccacctatatatctcattcaaacataatctcttctgttttgataggcccgcttttaggccaataacttggcctagcccaagcccaccagacccaagcctaggtctaggcttcctagctacaaaccatcttatcattagtaaaaccttctacctccgtccaaaatataaaatataagaagttttaaagttgaacacggttaataaaaaaaatagatataatcaaatggtgaaaagttgttattggttaagaagtaaatttatgtgagaaaaaagtaaatagtggagagttgcgattggttagaaagagaatgttaccgaagaagttatattttaggatggatgaagaattaattattctaccttttcatcccaaactaaattcctatacttaattagctcttgctagtccagagcaaaacgatttatcctcctgacaaagtgtagctaaaacaaaaatgcccatgtttggcacgccctaatcaacgagttaacatgtgatagtgctagtgctagcttagcctttaaaagatgatgggggccccactctcactgtcccagttgaatcggtaggtgtacactctcgtgtggttggtgaagaaatatgctttgtatctttgcgaggccaaacaatatatctgcatttttaatgtgagaccaaattaagtggactagcctctattttttttcttaagattataatttagaagtggacaagtaccggggagtttggctgcatgcaccaaccatgaaccgacggcgacgttgcccccacgactccataaaaagagaaagggaaagatgggcagccaccggcgggtgggcgcttctccaccaccaaccccacaaattatcgtggaaattatccgtgaaatcggactcaatggcttaagaaaaaaaattatgacggacgatgagcctggtgtacgtgtggtgtggatcgtgtgatcctacgtgcgccgtcggcgtcaatcaatggcggctaggctccgtcccataaaaaaacaatctaatacggtatgtgacaaatcttagtactgattagaagatttatggtattaaaatgtgttgcatcttttattggatttgtttttttatgggatggagagaatagttgagcagccttatatatacgtgccgtgcaatatttgttttctgtcaaaaacaaacttgtgcaatgtttcatatagacataagatacgggataaagtagagaagatattactatctttgtcctaaaatattataatctagaatgaaatttgattcatcctagggttttgttttaggagcttaagattctgagaaacaactggttagaagctaattggtgagaatttggagaagctgagtttagcttctgacttctaactaattttctaagattttacaactgcagcttcataggaattgtatgaaaatctatattgtttgaaggagtttctagcagctaaagattctagaaaaaactgtagttatcagaaactcccctaagcaaatcctataatggacataaatgacaatgtttatgtaccatacacatctccatgtttttttacggatcttagttgacatggcgacagctgcgtcgattcccgtaaacttatttagtcaaaacattccattaagatcttaatcccggagtaagtgctaagcaaggctatgcttgtttggtctttacacacttcaaagaaagatgttctctctttcttaattcctttgctcctactgccactaccttttactacgataccattcgcacctcaacaattttgcacatagtttaagtttatcgataactaataaaccatgtgagctgatcaaataagcaagatcatcatgacggtatcttcgatgaagtagtgtataaataataattgaaccccccaagtatgtagtgctatactccctctgtactcataaagtaagtcgtttaggacagcgacacggtctccaaaacacaactttaacttattgtaagctataattcagtacgtgctccattattatgtggtttaattagtgttttggtttagtggtaggtgtttgatttggcaacgatgcgttaacacgagttacatgcagctgattaatgattaattgttgtttggggtgcagtggtcgtatgtcactttctggacattgagttttttctacaggcttggtgtaggaaaagaacaattaattaataatactagtggaaacagctcggagaaatctgctgccattgcacctaaactgcaagtggaactttggtgtggtgacactgaatttcgtgcggtttggtcactgtcaccaaaagtttggtattcatgcttggactcctggttggcataaaggtctgtcttggacaaaaatatagttcagacacctcttgtttccttgaaaataccccctccttccctaaatgattaacaccgttgacttttttaaacatgtttgaccgtttgtcttattcaaaaacttctgtgaaatatgtaaaactatatatatacataaaagtatatttaacaatgaatcaaataatagaaaaagaattaataattacttaaattttttgaataagacgaatggtcaaacatgtttaaaaaagtcaacggtgtcaaatatttagggatggagggagtagtataacaacacttgtcccaaaatgtttatcagtattatactccctccatattcgtaaagtaagtcgttttggacagggacacagtctccaaaacacaattttgacttcttatttctataaaaaatatctatttaaaaatgatatatgtatacttttatgaaagtatttttgaagacaaatctattcatataatttttacattttcaaactcaacaacttaagagttatttatgatttatattttcaaggttagacttaacattgacctaaatgactttcgtcaatgactttctttacgagtacagagggagtatttcattttgataccctcaacaaatggttcgctttttctttaatggaattacaattgaattcacataaccttcacataccaagcacataaacataaaaacatgcagtaatgcacaactacgccaactgaccaacagccaccagagcatgtaatcgcaaaatctagcttcttgtcaaaaatggcttgggtaccatgtcttttcttggttttttttttaaacaccgtctttgtacacatataaagatagaagatgattggtgagctcacaaaatagcatgttgtcttttccccgacacatttgggtgcttaggaaatgaaaacataccggctacatattataactataataattaagtgctataacatttacaggagagtggctggtcttataagtatgatattatgcgagactatgtgccaagtagactaaagctacaatcaacgacgacatcccttcttaatacacaataggatgaatataatggtgaaaaaactactacaataaatactacattactcgcacacaactaggttctcgagattgctctcctctctggattgatgtgttcgtttggccattcctaacccaagacactaaatataatttccaaaaacttcacatcaccaagaaactagtactaagacacaacttttccaatgcaaacatcattattctatacttaaatttaatgctacttatttcacatgatgtcttggatgttgtgtagaaattctctttcctcatttattcatttgctatatcattttttattctagatggcaatttatttaatactatggataccatcttagtcattgggttgggaatggcctaagatcactcaccatgtcattaagcaagctctctagggctccgcgtcccctgtctcagcaaatttcactaaatttaaaagacttttttgagtaaaattcaactcaaacatatctgagtggcaagtgcgtgggtccgccatgatctacaccaacaagctccccggtttggatcgtgtgtgcatgacggtgcagccgccgacgcggcgcgccgacgcgatctgaaacccatccccctctctctctctctgtgtgtccgaaggagatatttttcgcatcgaatggagcagcgacaagtcatgtgaaacagtgactgtccaaaccagcacgcgtggattcttcagatctcgatgtcctcctcctcagatgggccatgatgggccggcccccgcaaccaacggcccggatcacctcttccccccacccccatcacaaaaccccaaacccatcaccaacttcccaatcttacccaccccaccaatccccaccagatccaacggcccagatctcccccttacccagatccaacgcct

SEQ ID NO: 5463 - DNA, 2704 bp, Oryza sativa
  unsure (1)..(2704): unsure at all n locations
ccctcgaggagtactggtggtgcaccgagcgctgcctcgactggggcgtcggcggcggccccgacctcatcgtcgacgacggcggcgacgccacgctgctcatccacgagggcgtcaaggccgaggaggagttcgagaagtcaggcaaggtccccgacccggagtccaccgacaacgccgagttcaagatcgtgctcaccatcatccgcgacggcctcaagtccgaccccagcaagtaccgcaagatgaaggagaggctcgtcggagtctccgaggagaccaccaccggtgtcaagaggctctaccagatgcaggagaccggcgccctcctcttccccgccatcaacgtcaacgactccgtcaccaagagcaaggtgaagcatcccctccctccctttctaatcccattatatttcagatctgaagctgtttgcgttagcctagcctgctgcttgtactgttcttaccttagtactacttgattttgccgttattatggatttgattatgctactactgtggatctggatctggtttatctgcttcggttgattcagtagatctggtgggctattacgcataaaaaaagtttatgctataggagtggtggttaggtggattatacatgtgtctttaacattttagattcctgatgtttgtggcatgttgaatatggatctgtcatctagatctccttttgtgacacaaactaaaaagacagggttaaaaaggtttagttgattttacctaagcaacactaacaattgggggaaatttgcacctgatgtagtgcgcgaattttgcttttcgtgatcgtttggttgcttgatttagacgggatgcttgtagttcctttatttagtgtctcctgtgttataggagtaggagcgtcgaatttaagtcttaggttactgcggttggatctaaatcttggtctaattgttgcgtagctgtcaaagatgtctagttttgttgttagcttgcatgttttgcggatctgatgacagaatatggaataaaatattggtaccaaactgcttgccatttgttttattttactcgttattgtgcacttgtgtagcttgattgtttaatggcattttactggactccttagtacacccttcatctgtagtgaaatattactgaatgctgggaattacaatctgttatattttgcaatgattttatcatttttgcttgagatatattaactctgtgtttcttctgaacagtttgacaacctgtatggttgccgccactctctccctgatggtctcatgagggctaccgatgttatgatcgctggcaaggttgccgtggtctgcggttatggtgatgttggcaagggctgtgctgctgctctcaagcaggctggtgcccgtgtcattgttactgagattgaccccatctgtgccctccaggcccttatggagggtctccaggtcctcaccttggaggatgttgtctcggaggctgacatctttgtgaccaccactggcaacaaggacatcataatggttgaccacatgaggaagatgaagaacaatgccatcgtttgcaacattggtcactttgacaatgagattgacatgctcggccttgagacctaccctggtgtcaagcgcatcaccatcaagcctcagaccgaccgctgggtcttccctgagaccaacactggcatcattgtccttgctgagggtcgtctcatgaaccttgggtgcgctactggccaccccagttttgtcatgtcctgctcattcactaaccaggtaaaatatgatgaccagtatctattgtctcactaaacatgctgagtatagctgtaagttacatgattgaatcaattctgtgcttgttgcaggtcattgctcagcttgagctgtggaaggagaagagcactggcaagtacgagaagaaggtgtacgttcttcccaagcacctcgacgagaaggtggccgccctccacttgggcaagcttggtgccaggctgaccaagctctccaagtcgcaggctgactacatcagcgttccagttgagggtccctacaagcccgcgcactaccggtactaggctgcccagcacgactagcggctgtggcatgagaagtgtcaacttgaagttcgccatgacgactctggagtatcctgctttgttttcatcatcttatatgccgtcacttaggaggatttgttgtggggtttatggtttgagactggtgaaggggaggaatgggaagccgtttgcttttgcccagaaataatggcgtaattgggtggagttggggaggtgtgctttggcagatacagttttgtcttgttgactctacttatctgatatcatttgcaagcgttttgataaaaatcatgcgtcatttatgaataatattcttgcctttaaagatagttttgctcgttgtgctggattgtatgcctgtttcgttggtttgttatgtgttgctagtctcatttgctcgtggtagagctggtgcttcacttcccattgggagtgtgttttgcatttgcttagtgtgctattatttggtactagtacattaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5464 - DNA, 1034 bp, Oryza sativa
ttgatttgaattcggttagaattcaaataaaaatccaaataaattcaaatgaaagtcgaatgcgaaagtcgattattcgcgaactaaggcaaacccaatttcgagttttaatatcctaaactattttgcgggtataaatattttgttgtcctaagtttttaatttaatctacccgagcattatatccatataataggttagaaatttctatcgcgagctaaatgtcggacgaaatcctagaaatattatacgatttaatttagtctatgactaaatgattaaatataacacatggctaaaatccctagtaattaaatccgaatttctaccgtgaattgattacttatagggattacccaaaaataatctataataatctataagaattcatctatttgtttagttattaattacatctaaattactaccgcgaattgatttcttatagaaattacaaagaataattaaattttgcaattctaggaccatgattattctatacttaaattctaattattttaaattttctaaactattatcccccctaattttcttcctaatttttctatttatttttcctttttctctttctccctttttttttcttttctcttcttttctttttctttcttttctctctctgctctccctctcggctctcttttcctctctctctctttctctctctcggctctcttttcctctctctctcggctctcttttctctccctctctttctcggctctatcctacccgagcggcggcggtggacgcaaggggaaaggagggcggctcaccggcggcggcagcggcgacgacggcggtggcgacggtggcgcacggcggcacagaagcggcgacacggtggcacaggaacggcacggcagcgcgggaacggcggcgcggcggcacgagagcgacggcgcggcggcacgggaacggcggctcggcggcacgggagcggcggcgcagtggagaggggagaggggaggaagggtgagatgggatgggggagaatggagaggggggggtat

SEQ ID NO: 5465 - DNA, 730 bp, Oryza sativa
  unsure (1)..(730): unsure at all n locations
nnnnnnnnnnnnnnnnnnnnnnnnnnnnnnnnnnnnnnnnnnnnnnnnnnnnnnntttcgcttgtacattgaggagagcacttgcttcacaagtccaaggttgttgtcctgaaaaagaaaaaaaaaacagaggaaaggaaggaggtggttcaaataaatctacaaatgggtttgccatgcataactgtcaacaaaataatgcgtagcacgtcaagtaaatagcaacttaagtacagttcctgattaggaaatagatatagtaaggagggcagctcaagcaactgacaaaggaaatactcaccgattgaaacttctcagcattcagctggatatactcctctaattcagagtagttacctttgctgtagcatgttgacaggtcaacataaacctgaaataaaagaacagcgcacagcactaatgacttcagaagcaacctaaaaagggtgtatgcagttaaacactaaaaaggatgaacttgcatcaagagcaaaatttagcctttatatctagggtggcataaacggtaacgtagaacataaaaatgtgagcattgcctctagtgagtaaaacaaatgtacttgattccgagaacaaactatgcagcaaacaaaaaaaagatgttaagcatttgaccatgccaaaaatgaataaaaaccactaaatcaaaaaccaaacgatgagacaaagcatggggcatggctaacacttatagcattacattaaacag

SEQ ID NO: 5466 - DNA, 359 bp, Oryza sativa
aagatcgtggcgcggtcatcgccggcgccgtcggggagcggcagggtgcctaacatctcgctcaagagcctggccaaaaagggcatgtctgtgtcgtcgtcgtcggcgctgacggcgcccgaggcggcggctgcaatgcggggcgcgttcttatcggcgctggcgtagacggacacggcgctcgcggcgcagcagatcacggacgtcgccgcggcggcggcgggtgccgacgacaaccgcgggctggcgttgctgctaccgatcgcgccggccatcgcgtgggtgctctacaacatcctccagccggcgctgaaacaactgaaccgcatgcggtcggagcaggtgctcgtcgccgggct

SEQ ID NO: 5467 - DNA, 850 bp, Oryza sativa
attcttgaacaccctacacacactcagaactgcccatacaaaatacaaatcgaagaaaaaaaaaggtggaatgtttagtccacgaataatgttctagtactagtaacgaataatcgatgcatgacagaattagatagattcgatttgatcattgaacagcacgcacacttatcaggcgccaagcgtatctgctccgccgagcaggagacgaggaaatcggccgtggtgaccaggaagtccccgccgccctgcgccctcaggttggaagccgaagacgcgaacgcctccctgcatcacggacgaaacaaccccccgcaaggtgggggaaaagtagattagcgcgacggattggattcggcgagcatacgggattagggttttcgcggacggcggcatcaaggggacgggactcacaggaggtagaggaagccgagggagtgggcgctcgggtggagctgggcgaggaaggggaggagggcggcggagtgggcgcgcaggggctcgccgtcggcctgccggagaaggttgtggaggtgggccagctcctccccgctcccggagaggccctggatgtgcgccaccagcgtctccaccgtctccatcgccgccgccgtcaccgccgccgccgccgccgggaagtgtgggggttttgcttgccgttcgcgtcgccgcggttggggtttggttttcttgtgctgcggcttcctcttcgcgtcgacctgtttggttggatgcggagagattttgatggcgagatcgatttaattgtgcggggatctggaccgtccgtttgagtgggggggtgtaatctgtgccgtttgtagcagattcagatgtgatctgacaaaat

SEQ ID NO: 5468 - DNA, 713 bp, Oryza sativa
attttttgggctaatttgtcggaacaatttactggtgattacgtacgacagatcgctcttgaacaaacccttgctatctaaaccaaaccatgcagtggcctcggcttcccagccgcttcgcgacggcgatcgccgccggtctgcgccgcccttcgccgctccccctcgcgagaacgccatgccgcgcgccgccggcctcgccgtcgccgtcaccgtcgactgtattccgccgccatctcttctggcccagtcgtgcggccatggcgccgccaccgccgccgcctaccctcgcgttcgcggcgagcgagggcgcctcctcccgaagcaggggcccactgatctctctctactactgctcggcgccgccgccgccgtcgttgcggcggccacaccgcgcaccgcgcacgcggcgtccgggggcgtcatgggcggccgcgacacctccccatccccctcctcctactcgtcgtcatcgtcgtcgtcgtcgtcgtcatctccgtcggtgagacactaccactactacccgccatcaccgacgaggtcatcatcgccgccgactccggcggcccataccaccagctgccctatatgtccgtacgtgctgttggccgccgccgtcggtatcactatcatctttctctgcaccttggccagcaaccagaagactaccgtcgtcaagctccaggtgagtttatcgaccatacaaaaatacc

SEQ ID NO: 5469 - DNA, 679 bp, Oryza sativa
  unsure (1)..(679): unsure at all n locations
nnnnnnnnnnnnnnnnnnnnnnnnnnnnnnnnnnnnnnnnnnnnnnnnnnnnnnnnnnnnaacacaaatttccaaagcgagatagacgatgattccaaaagagaaaaggtagaggagatcccgaagattgtttcctctcaattgatttcaccggaaacggaaaggatcggccgaatttggaaggagacggcggcggcttgcgctagggtttcgggcggcggcggccggaggtagactacgacctgacaagcgggcctcacctgtcagcgagcgagggcgcgcgcgcggctgcggcggactgggccgacttgggccggggagagagaaagagggttttgggccgactttcggcccaaagccaaaagagacttttaaaaacatttttctatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttatatatttacgatttttagggtgagacatctcctcaacggggattaggaaaccggcaagtttccgaacctttgtgaaaa

SEQ ID NO: 5470 - DNA, 568 bp, Oryza sativa
ccaaagtttcccctttccactactaagttttttttctcattctttggtccataaccttccaatctttgttactcaacttcctaaaatgccttttaatcccccaagatttttaaaaaaaaaaaaccccccagcttacaccgaaaaatactagaatatcgatcataaccctcatttgcctggccaaaaccaaataactccaattttatgaaagttaattttcaagccagataaattttcaaaccccaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattggtgataaaggatccccttgtctaagacctttatgtgtttgaaagttgtcaccaatttgatccttagctttaataccagcatgtcccccttggataaaagaggatatccactcacaccatttgggagagaaaccc

SEQ ID NO: 5471 - DNA, 433 bp, Oryza sativa
  unsure (1)..(433): unsure at all n locations
nnnnnnnnnnnnnnnnnnnnnnnnnnnnnnnnnnnnnnnnttaataaattgaatattgataaactctcatagaggaaagcaccctaagaaaaactccaaaaacttgagcttggcaacttgggcgaagctcaaggtatggtggagcgtgcacatatcgtcgtgcagttgcaaaccattcccagcctcttcaggtcgggcggccgaaccacgggctccttcacgaccaacttattgacgacggcgatgtcgcaccggatcgcgaacccgtcattcttgaggtaccacgacttctccagcttcttcctaacgacgaacctgtcgaacccctccgtgaccccggagtagaataccctcgtgaacctcttctcgtgcggctcgcccaacggcagcgtcagcccgtagtggtgttgagggaccaagctaaaccggacct

SEQ ID NO: 5472 - DNA, 11079 bp, Oryza sativa
attggacgtttgttaatgatattttttggattttctcttgttgtttttatcacaggtcgaaatctataagcgatatatctcatattgatttattttaatttttttaaaaaaataatgactatttaagtgatatgaactagtgtctctttatggatggaaacatttttccctgcgtgatacaccagttctacgctcagtgctactaggaggctagcagccacttgctgctgctagagcccaaagaacagtactgtcagttcagatcagttgcaacttgcaaggtctccatcttagtggagtactttagttattcgatcctataaaggtactccctccgtaccctaatataagaggtttttgtgattttacttgcacttgcactttaactattcatcttattttaaaaaattagaattattatttattttatttgtgacttactttattatccaaaatattttaaacgcaattttttgttttttatatttgcataaattttttgaataagatgagtggtccaagtaaaatatcaaaatcgattatattaggggacggaggaagtaattacaaagtctaaaggaatgaaatctccagctagataataaaaaaagtgtgttcttttgttttaagcaggtttggtctgaggtgacaaagactgtctgttagaagtttgcaatgcccatacttttacaaaccccttcatgattagcgattttaatccacaagtctgaataaattccagcatgtctgatgtagctcatagaagcatttcagcttgtcttaatttttttctgtcctcatttttttaatcaaatgactatttcattgtacagtcgtaaagccatttcaaccacagtaatctgctggtaatttttttaatgtcatataaatttcataggtagtgatattactgctgatttcccaccattcaactttcttaaattaatgcctaatatatcatgattatttttgctggcattggtctctttaagcatgtgggatgtatatttgtgggtgtgagtgtggtgagcgtgcgtgtgtcttatcaataatgtaattttaaatttttttatataaactattttataattttttaagtaaatttcatgaaacctcacatgttatgatttaagttgcacaaaatcacaacggctctggtacatggcatataaccatagatattacggtcataagatttcaccaataaaaatagttaacttacctacaatatttaaatgatggattaaaagaattcatatatttcggaacttgtatgcatgtatggtagatcaaagaaaatttagttaatggtgtatataaaactaaatgtcatagtaccagcattacgtgcaagtgtgcaacatgccaaaactccaatagttttatgcaaattggatcataacatcgtggttacgtgaaatttactactatctctgtcttaaaatataacaacttaatactcggatgttatatatcttagcaatgtaaatcttgacatgagacatatatccataataagtagcagtacatattgtgggatagggcgagtagtttttttaaaaaaaaaaacgaaacggtttaaaaactaatccatagttagcaagtggttaagtgagcaaccgtttccatcaaagacggggcaaaagtgagcggggaagacgacacctccgcagctcggcgcacaaagcctgcaggaaacccatcacctgtaaccaatccttccatcttctctgccttctccttcgcttcaccacctcgccaaaaccgccttcccttcccttctcttcccttccaacctctcgttgcggtttgcgctagaaaaaaaagagaggagagatttcaagaaaccgtgggggagaaagaagcaggcaagaagtagcagcagcagcgagtgaggctaatctggtcagtttcagaacagattctttgttgggtctctatccattgcaagaacaggttttgttttttcttttccctttttttgggatcagagtctctccatttctgatgctgctgctgctgctgatgatgatgatgatgcaaggcttgtggcaacttgtttggtgaaagaacaacgagagggatactgggatagggatcaaaggcaaaggtttttgtttttaccccgtggtaattgttcgttcggtttgtgatgggatagttgctgggactgtgaatcattttgccccttcttatcatacagacaggcgcgtgatttgaccagcttgtcgtctctgctctgcctctatccatccatccattcatacatccaaccttgggggttcttgattctttttctcatttcttggggaggcttaattgttgctatcgccctccgcttcaggtgtccatttgaattattcgtcgtttctttcgtatttaattgccatttgctgatttgcctctttatttcggtgggttttatggtaataaaggtgtggttcctttatcatcaaatttgaggtgttctgggttttctttggttcttttttggagcactggatttgtgtgctcttgtaaatcaaatagagtttgtggtttggttcgtattttacacaatcgagttgtgtttttattttagtttgtatcgaaatatttgcatacttgtttctagttccttcaggcttcagttctcttcattattataaaaaaaaatttggtcctttcgtccataatttttttcacaattccatttttgaatgtatgagcttgaattatgtgacttttcagtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgtaagtgacttcctcacctcaatcagtatttgctctgtgtaatgttcagttactctactcatgtggtttatatggaggatatatttgtcagtaaatggtgaaatctaaaccaagatacctattataaaaaatattctaacgcaagatacagcatctttaatttctcttatgtctctgcagcttcgtataattagtggaattttggagaagaaagtgactatatatgttgatgactgattaatcttaatgtcatggttttgatttatgcaggcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaaggtagttttctcaaacaatgtggttctattccctatttactgcaaatctgtaatcactgctcgcctgctcggcgcagttagttttactgttccagcaaatctgacgagcaaaatcaaattatcagtgttatttatgcattggtctgatgatatttatacttttcagggtttcagtgttaatcatcaaaaccagccttcagtgacggataatcaccaggagctcagtcttcagcctatctcaactgcatccaatgatttcacttcaccaactattgttaaacctaagacatctgattccatgttagacaatgatgatcacccttcccctgcgaatgatcaagaagagaatgcttcacacaaaaatgaagagtattcttcagacctgatcattacccctgctgaggatggatataactggaggaaatatggacagatgcgagttagaacagtgagcatcccagaagctactacggatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaaggttggctagccttagtcactaatcactcaatgaaccaatcttcactttgagtagctgattgttttccttcaattttattcatttcagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggtcaattctaatgccatttttctcttttggaacaaattctttgcagttcctctaatccttcactacaaaagtaaatgtttagcttcacaatatgacactgtcatcgaaggaacatttctctgtccatatgtgtgcatccatagttggtacaaagaccggaaattactcgcattatctaaaaaactccattttgtatttgcaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggcaattgtaggtagtagaggttctagaaaagataaatggctttggctgagttctaaataacttcctcctttttcattagcatgtttactggattgctaaactatatattttctgtaaaaaagattatatagtatttttaaaatttataatacatactttaattatgcgctaatgatcccccttgttttccaaggcgtctacagctacagccgaactcagcctcagccttaataagatcagaacttctgcgttgacatcttaggctgactggttttacaatcaacaaattcaatcttgaattctgggagcaaaaaactgcagcaaaaaaaaaggtattttataactttacaggagtaactggtccgcagatttgcattatccagtaattgacgtgcagcagaagatcggacagaaacaataaacagtcaccatttgcaatgcttttttgcgggacagaccaaagtgtacccagtatactgtcatgtcagaacttcgaaacagtcaacgctaacaaaagcgaatcacaccatcaccgcttatatattttctctgcacaaaaatgtgcatatgtggcaactccaagaaactttacatttgacgaggatattttttgagtgaggaggttttaagttaaccctaatcatgttgaaatgtcactttataaatttggtatttctcttcactaaaacgtacaaccaaaacttcagcacttctttttgctcagtggccattaacagctgactgctggaaattctctctttgataaatggctttccaccgctcaagctcttccctgcgaaataatataaacaccagaagttagaaatgggaggagaaattgacccctttctttgggaggagggccagttgcagacaattgcttatactgttgtacaatatcaggttctctaatgcactgttatatagtcgactgcgttagtgctatattatcttatgatgtatgatacaaaagataattgccaatcttgtaggatacaattgtttagctgattattgtgtttctaatgaagcaattaatatatgatcacttatacaaggctactttgtttaagtaattatttttgtagaccactgtctacacctgaacagaatgtacagatgggacaagtgcactgacattgagtatgggagccaaaggagacaaaaaagatcaattaatctgcttgggcatgtttttagattgtttagatctgggaaatatgtgcatagatacagatcattgtttatgtctaagctctactgaaattagctagtcccgatcacttatttgagtttgaccttaaggaacttgatcccaacacagttattaaagaaatcattaagtatcggaaagaacaaaagttgtgtatatatagtccacatagtataatgtataaggtaagtgttgtgtaccgaggtggtaaattcaagtgccattgggcagaaggggccaattgagttatatagtctccccaaggcgattagctgttccaattattggttcacatccaaaaagaagcagccactgcaattcaataaattaaagaaacatatcaagaaggattacgttaagctcccccctatttcatcataatgaagaaggccaaggaccttacgtcttccatcattcctgcggcctagccctcttgtttttaccgactgagaacgtttgctttagatcacctatgtcatctgtcacagtgaagcttccattacgcacgtggctcaggtatcctgatatcttgtgaatatgcagggatcagcctatgtccatcgttatcattcgcgcggtgcgtagctgaacctctcttagtgaggcatgatgaaacaagagaagaatttgcctgaaacaattaaagcatgtaagtatgtgcatcgctaatttccgatattactataagggcgtgtttggataggggtgttcaaatttaaatactttggttataagtttaactgcacgtctgcatcctataaaattccagatccaaagcatcccttaaaacggcaattgctaaattaaattataggctttaaaggtgtgagattttgcatacatccaaagtagatgaatttgccccattccgtggagtatcttcacttaattcagattcaaatcctttacggcgaatgtcaccaatcgtaacaattccttcaagaaaatcttcactgtctactacaagaacacaattttgctgcttatcatgcataagccttgttgcctccttgatagtcactgtaggtgtaaccttaataaattgctttgacattgcttgtgatacctggaacactcgttgttagaaagctgaatgaccacaaaaatatatcaaatttactaaggatgaacttgacaaaataataaagagaatgtagaaaagaggcatggaacctttaaatcatcaagaagcatatcctcattgttaataccatagcggtagggatcatcgtctagaattgcaagttcaacgtcatctctgtctggtcgtctccggtctgtctcattcctatctgtaggaggtaatagtgaagaataaccatgccgaggagatgtagcctcaaacgcctctttgttgccagacattacaacagatggcacccatattgctaaaccaacagctccctgtaaattaaaaataagggtgagcttatgtcacaaggagtgtgcaaactttcatgcttagaagcaaaatagcaaatatatgggatgagacatcaccatcagaggcagtaaaattctgtaatcttttgttagttcgaatagtagtagtactgaagtcaatggaactgagcagactgatgctagtgtggcagccattcccacctgaattaagcagacagtcagtatacttcgtttctatcaaactttaggctaccttcctagctcaaaaaaggaaacttactagtgcataagcttgagggtgtgcaacagcagtgttacccgggatggcagagtttattagttctgctgctgagcctccaaatacagcaccaacagcagcaccaatcatcaagcttggagcataaaggccaccaacaagaccagaacccttgcagagtgcagttgctacaacttttgcagcagccaactgagctaagagccagattccaggggctgaggcactttttccagtatgtaaaatttcatcaacattggtgaagccccagtacagtattccagggtaccttagagctattaaacctgctccaagaccccctaacgcagggcatactacagcagggaggctgaatttcttccttatcaagtcaaaagtctttgtgaaccaaaccaccaactgtctgaatgccacactcactaccccacaaagcatgcctaggataaggtagagtggtaactctgcagaatataacattagtgatttagttggttgcatatttaccagttagacatatcaacatgaaaacagtaatagatacacagttcggcgttcacgtcacagatataccagaacttcaaactattcaattgtgaatggcaagaaaacaagatcggaacaataagaagctgctaaaactaacgtgttgatggtaagggaaccaaccacaaaacttcaaaaccatgagcatatacaagtgtataaatgcgtgatgcatatataaaatagattataaaggcaggatatcacgagtcctctgctatagtagtaagaacaaaaaaaaatctactcaagttcaatacctaactaagcaaaatccaccttcagtaataccaggtttgatcagaataagataaaataccagcagcagattttagttcatacgtcgggacaataaaagctgccttctcccctagcaaaacattggacacagttgatgatataactgatgccaatataatcatagcagtggtaaatggcggtgaattctctgctcgaagtggcctcagtactgtttcaatagcaaaaaaacatccagcaaccgcagcattaaaacctaaagacaaagcaacacaagtgtcaggagagaataaagaaaaaagcattggcctgaagatactggatgttaaagagatgaaattgcaaagatacgtggtacaacaaagatctatagtattgtatttgtagttccagttgcttgcagaattagtttatcttccttttcttgttaacttgtactaacatcttataatgctaaaaggcagtgggaaacgattccaatctgttgcaattcccagatgaatgtaaaaaaatcaaacagatgatgattatttaaaattacctgaagcaatcccagcagctgatccggcagcaacaagagcaattctccgttccctattgttctccatcatttcagcacatccatatgcacaagatttaccaatatcaacgcttggcccttctggccccaatgaacatcccgtccctagagtaattgcagcttgtattgctttgattgtaggaaaaatcgcagccatgaaatcaacaccttccctttgagatgataatgattgttttatctgctcaaatatctccagtaatccgtgcatcataccaacaacaactccaccagtcactggaattaacaatatcctatgccatgtatcagcaagtctctggaggcgaagccaagcagctccctctgtgggtgtgcctgcccatgcccattcatgtatgatatgcacctgaaaagaatagttagccactattgaaccagcagattggtatatgagaaaagtacaaacaggaaacttttggtttagaaatgatcatctaaacttgattggatagctcccgcttaacagatctaagttatttcaaggaaagagccttttctagtaactttaagaaatgggggttcgattaattgcagttcagtcaaagtaaaataggcacatactgtattaacccggtaggacttttctgagtttctatctgatcaattcagatctatgaagtattcagagaacacaaacaatgcaccaaaattgccagcaagtagacataatctagtaaacctcagcagattataataccacgcaagattcgttttcacctaaacccatgccataagaggaagactttaactagcaaagacctcatgtttgtatcaactatccccgtggcatcaaatttcacatgaagaaaatacattatcatctccacgaaacaccctaaacggcaggataaagtaaatgtacagtccatattctcacacgagaaaatggacatttagccacgttcaaaacatggcttcgctagaatgccatcccgaaaacgcgtttcgctaaaatgccaatatgaaacgcgtgctcactgccactttgccattttagcccttttgtgcattttcgaaatcatttttgctcctccaccgggcgatgagacaaaattgcccttcatgtcctgcgtcgccgctgttgaggaagaggagctcgtactcgctggccaatcttcatgtccaccacaagcagctcaccgtcttcctccca

SEQ ID NO: 5473 - DNA, 4118 bp, Oryza sativa
  unsure (1)..(4118): unsure at all n locations
cccccgcgaggtcttcttgacgacctatcctccgcctccgccggctccttgttggggctgtcatgcggcggcggtcactggcatccgccggtggttccatcactacgtgcacccgcacacccaaatgccctcggcggcagtggcggtgggctcatccagcggcgttgacggccatcccgccctcgtcgacggcggctaccgaaggggaaggatggtggatggaagggcattttcatctcattacccactgaagaagcgaaaatgatttcgaaaatacacaaaagggccaaaatggcaaagtggcggtgagcacacgctctatattggtattttagcgaaacacgttttcaagattgcattctagcgaaaccctgttttgaacgtggctaaatgtccattttctcattctcacacaaatcagacaagaaattcctccaaaacaaagtgtacctacatattgaagggtgctatatacagcattgcgtttattcattgcaacctaaactgtccagtagaaatcccctgctcatatatcccatcccaagcaatcaccttaaagatatagatctcgcaagaataccagacttttcctagtctaaggtaattaacgttttttttttcccgcaactttccccacgcagatctctcacttaccccgcggttgaacgcagcgacgcagatgccggtggcgaggccgaggaggcagccgacgagcagcagcgcccactcgggcggcgcgccgtccccgagctcgtcgctgtcctcggacccgggctccccgccgccgccgcccctgggggacgccgccgcgccctccgctgcgtggcggtggtgccgcccccggctggacagccggcggtccaggctccgcagcagctcgcgcacgcggctcctcctcggcgtcgacggcgagtccgggtccgccgacgacggcagcgcccccgcccccgaccgcagcggctccaggtcgctcgcctgcgccatcatgccccgccgcgtgcgagcgagggggatctagaaccgaggcgatcgcatcggagtaggggaaggggaggatctcgcggcggatctcgccggtggcctcgatctcgtcggcggttgggggtggcgatggcgagaggtgaggtaggagaaggggaaggcacgttcgcgcgtggcggtttttgcagattagccctcgagagagtttgtagttgcaattggtgggtgggaggtttggttgggccgggttgcacttgggcctagtggacacctgccaggtccattcactatggttggcttaggttggcataaaaccacttgaacatgttctttttttttcaaaccattaatcacttgaagtttgatattcacctcacaagctattttgtcgcaaatacccactaccctacttagttttttttttcaaaactcaccctagtatgcacatgcttaaatccaatcaacatttcgtaaattgtgagttatcaatgtggtcgctaccaaattaaatacttctacaagtatagtctcgatgtatttttggagattccacgagtagaattgccaatgaaaatttaaatgtcgcactgagtttctctatataaaaagaaaatcaatgaaacatgaaaagtaagtctaatacaagtacttggataagatgactaaggtagtttagcctatgggtggctctacattagtgaaaataagatgaggttaagcatgtgccaatggggtggtctttgcaataaaactaaataggggtgggcatttgcaacaaacttacctatgtggtggaatgtaaaacttcagacaacttatgggtgttttttttatggctttggaaattggattgcagagggaaaatatcgatattgtgcttggattagcttcctataaaatttttttaaatgaaatttagtttttacgaataattttgtgcttgtttacttaccttcttagcaatcatgaaaataaacctatgcactaaagtggcgaagaaatcataaaatcgaatttcaaattttaaatcaacgatggtatttgtttcctgtgtcatgacgaaacagtttggatgttttgcaatattttctgttttacctgtcccacattattgcttggagtatttgcttagcacgtcataatttcagtggagaatccacataaacattggtggtcattgttgcgataaaaaggcgtaatatttcactatttcagcatgtcgtcctgtcactattcactagacgcattaagctagaaaggagctttttttttctttctgtggttgcaaaccaagcgtgaagcaaaaactgaagtattttgaccaagaaaaagatgtttcactgctttcagtgatcagtcaaagcattgctttcccaggaaaaaggatgaattgttcggtgaaatgtcactgaaaaagatccctggggtgctcatcagacgttaccatttttcctgacaatcttgcctcaaaagatgaatcaggaagcaaggttgttcatttgatgtaattgtagccatacatacaaggaaaatctactcaaacatggaatttatggacttatatttcaggcccagattagaccatgaatgcaggattatgtacatatctttcatccaacagatgagattagtcttcactcacctggacaggttactggacactgttctatgctgaatcttgaaagcttgaaaatattagtatatactgctgcatcaagcgtatgactgataataagtatactcatatggagaatcctgacaaacaaaaaacatttaccaatcatgcagattagattagtcaataggtgcaggttctcagaaagcatgaacagcttgagaacatcttctgcttatcagctagagacaatgcttcgtctaaatgaactgattcagtgaacattcttcaccaaagttactatcttgatgaaataaagccatttccctttctgaaagttgaatccagaaaactcaacagtaaagagattaaaagttttatgaaatagtaactgaactgtactgtacatagcgactcaagttacattcatatggcaccgtgaagcttttggctatcatatgaccatcactaacaaaacttgttggcgtcacagattcagaaatgccgagacatgaaaacttctgatcaccctctataagacagtaacaaaggaatacacatcagtacattgcagcaactcacaagggtttcagatatgatctcaaatcttactcctgtatctgaccagctttgccaatgtctcttgagcagccagtgtatgggcatgaccatggccaagcataacagtccggatgctaatgcaagtcctgcacaattcttcgccggtgtcaaacagcccacctcggagcaacagcttcgccctcgtctcgagcagtgtcgctttgagcagcgtcacttcctgccagacaaactcatcgacacggtgattcggttgcagcttcttcctccagcaaagcgacccacggttcaggtcctggatccgcgatgcgtaagacttctccacctcctcaaggacattggtgcacaccttgagcagttctaaagccgagccgcaccgtgagaatgtcatgaaggagtcaattgccaagggaagtgccgtcttccttatgaaatgcaccatgtcgactgccttgagctgaacagaaggtggttcagacttgaaaccaaacacaaggaatgcactagcccataagtggtccgagtacactgaggggttaccagccctcattacgccgttcactgctgcagttgttggtgccaaacctcccctaatcttgccaaagagctgtgttattgggtggaactggatccagcagccaggatgacgagttgcctttcttgccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5474 - DNA, 994 bp, Oryza sativa
aacagctcatcagtagaaatcccctctggagtagacttcgaattagggaacacaaccaccggtatcccattacccctcgcatgctccgctcctccacaacctacaagccacaccaaagagaaatagatgaattcataaatgaggttgcaattctttcccaagtgaaccacagaaatgtggtaaaactcctcggatgttgccttgagacagaagttccattgttagtttatgagttcatttcaaatgtaaccctttaacatcatctccatattgaaggcacggtgtcatcatcattaccttgggatgatcgattaaggatagcttttgaagttgttagagctctttcatatctacattcagctgcatcaatgccaatatttcacagagatattaaatattcgaatatacttcttgatgacagcctaacagcaaaggtatctgactttgtagcttcaaggtatatctcgataaatgaaatgggaataactactgccgttcaaggaacaattagctacttggatctcatgtactattatactggatgacttacgagtaagagtgatgtttttagctttggtgttcttcttatggagttacttactcggaagaaaccaattggtggtacatttgataatggcgatggtcttgtttcacatttcgtctcacttgtctcaaaaggtaacctttatgacataatagattctcaagttagggaagaggaagatggagaagtccaggaagtagcaacactagccgcaacatgtactaaatttaaaggagaagagcggcctacgatgagggaagtagagatggtactcgaaaacatagtttcaaagaaaggcccctccaataaagagaatattcgatcaagtagcagatgcgatgaaaatcaaatttcagctctttacatgtcaattgaaggagttaccaatgatatacaaaacaattacagaaagtagcacggaagaggaaatactattgtcgtcaaggtttt

SEQ ID NO: 5475 - DNA, 2438 bp, Oryza sativa
atattaagcatgctcatgttgattacattcaccactatcactggatcaaatcccattgtaaatatcatgtttattatcttgttattttggattaaaatatgccgaattatgaccaaatttccaacaatccaaaaacctgataggtcattttcagtagttggctttgctgcaacactgaaaccacatgcttttgatggttctaattataagagatggaaagcacgtgcactactatggttgacagcgatgcaatgcttctatgtttcacggggcaaacgaagtgaaccgcctctctctcctgaggaggaggctaagttcgaggcttcggattgcctgttccgtggagcattgatcagtgtactcgctgacaatatagtggacgtgtacattcacatgcctttagggaaggacatgtgggatgcacttgaggccaagttcagagtttccgacgccggcagcgagctgtatgtcatggagcagttctatgactacaagatggtcgatgaccgttctgtagtggaacaggctcatgagattcagatgctggcaaaggaacttgagaacaacaactgtgagttgccggacaagtttgtggcgggtggcattattgccaaattgccaccttcttggtcggactttactatttctctaaaacacaagaggcaagagtttaatgttactgatctcattggctctttgggtgttgaggagaaggcgagagcaaaggacaactggggcaaaaatatcgagggaaattctagcgccaatttggtgcaaaagaagaaccctcacgcatcccacaacaacaacaacaagaaagtctagcctgatgtcaaaccaaaggctacaaccaattttaagaagaaagacaagggaaagggcaagggcgactgctttgtgtgcgataagcctgggcattgggcgaagaattgtcctgatcgcaaggacaagaagtctgccaacatggttattagcgagggcggaggaacatcggggtacggtaattttttacctacagttctctctgtttttcattcacctgattggtgggttgatactggtgctaatattcatgtgtgtgctgatatttccctgttttcttcttatcaggtcgggagaggttcctccttgttgatgggaaacgagtcgcttgcggctgttcatggtgttggtacggtcgatctgaagtttacttcgggaaagactgtgcagctgaagaatgtgcagcatgtcccttcaataaagaagaatctagttagcggctctctactatgtagagatggttttagacttgtgtttgaatccaataaatgtgtcgtatctaaatatggaacttttattggaaaaggttatgacagcgaaggtctgttccgtttttctttggatgacatgtgtaataataataataataataataataataataataataataataataataatgttgtgaaccatattagcgagaatgatgagtccaatgtgtggcattcgcgactttgtcatgtgaatttcagttgtatgacgcgcttggctaacatgagtttaattccaaaattcactttggtcaaaggttccaagtgccatacttgtgttcaatcgaaacaacctcgcaagcctcacaaggcatctgaggcgagaaatttggcaccactagaactagttcattccgatctgtgcgaaatgaacggcgtgttgactaaagggggaaagaaatatttcatgacactgatagatgattgcactagatattgctatgtgtacctattgaaaacaaaggatgaggcattgcattactttaagatctataaagctgaggtagaaaaccaacttgaaaggaaaatcaaacggttgaggtctgataggggtagagagtatttttccaatgagtttacgtccttttgcgaagagtttggaattattcatgagagaacgcctccctattcaccccaatcaaaggggtagccgaaaaaaagaaccgcactctaactgagatggtgaatgccatgttagacactgcgggactttccaaggaatggtggggtgaggcaatttttactgcttgtcatgtcctaaataaaattccagtgaagcataaggaagtaacactattcaaagaatgggaaaggaagaaattaaatctctcatacctacgcacatggggctgcttggccaaggtaaatgtacctatagccaaaaagcgtaaaattggaccaaagaccgtagactgtgtgttccttggttatgctatccacagtatgggctataggttcttaatagtaaactctggagtacccgacatgcgtgttggtacaattactgagtccagagatgccacatttttttagaatgaatttcccatgaaaaatacacctagcacatctagtcaagaacctgttttaccccatgagcaccttgcaccgataaaacacaatgat

SEQ ID NO: 5476 - DNA, 6735 bp, Oryza sativa
  unsure (1)..(6735): unsure at all n locations
aggatttttttcgacacctactcaccagttgcccgcttgaccacgattcgagtactacttgctctagcagtctctcatggtcttctcgtccatcagatggatgttaagacagctttcctaaacaaagagctagaagaggagatctacatggatcaaccagacggatatgtactagaaggtcaggagggaatggtgtgtaaactgttgaaatccttatatggccttaagcaagcacctaagcaatggcatgagaagtttgacacaacacttacatctgctggctttgttgtgaacgaagctgacaaatgtgtgtactatcgctatggtgggggagatggagtgatcttgtgtttatatgtcgatgacattgatttttggaaccagcctcaatgtgattgaggaggttaaggactttttgtccaaaagctttgaaataaaggatttggaagtggctgatgttattcttaaccattaagctaaccnnnnnngaggagatgagggtgggattacactcgtgcaatctcactatgtggacaaggttttgagtcgctttggttatagtgactgcaagccagctccaactccttatgactccaatgtgctattaaggaaaaatggaagaatagcaagggatcaattgagatactcccaaatcattggttcattgatgtacttggctagtgcaacgaggcctgacatctcatttgctgtgagcaagctgagccggtttgtttcaaatccgggagatgatcattgtcaagctctggaaagggtcatgcgctatctaaagggtacaataagctatggaattcactatactggttacccaaaaatattggaagggtatagtgactcaaactggatatctgatgctgatgagataaaggccacaagtggatatgtgttcacacttggaggtggcgctgtttcctggaagtcttgcaagcagaccatcttaacgaggtcaacaatggaagcagaactgacagcactagatactgccacagtaaaggccgagtggcttcgtgaactcctaatggatttgccggtggttgaaaaaccagtgccagctatactaatgaactgtgataatcaaacagtgattattaaggtgaacagttcgaaggacaacatgaagtcatctaggcatgtaaagagaagactgaaatctgtcagaaagcagaaaaactccggagtgatagcactggactatgtccagacagctaaaaatctggcagatcagtttaccaaggggctaccacgtaatgtgatagacagtgcatcgagggaaatgggcttgagacccacttagagttgcacaatagtggaaacctgtccattgtgatcggagatcccgtgaatttggatggcgaaataaactattgtgtaaccgagagaagagacccttaaatgggctcattttcatgatgtacttctcttctattctgtatggaagcatggctttatgcctcaatgtgttccgagtggctttcattaagcatagatgttgacctgcagaacatcttagaaggaacacacctatatgagttcgactgctagtcacagtctatgagatttggatgatctctagatactcatgaaaggcctggagtatgacttataagctccaacccgagggaatactaacggttgcctagtatcagttatggaattgagtgaaacctaactgcacaagactgacaattcaaggcatagtccattgttcagttgtggtcaggtgtagctccttttctaggtgaaagttcaacttaacagtcttcaccgaaacactggtatataaaagctgctatggaatagagagcattctcatgagccttgaaatttggtggggattgttagatttaattgggtaattgatccatttaaatcaattaaatcaaataaattccaaggctcattatgctagtaattcatgtgtattcattcttttatgggatatcaatgggatgaagagttttgagaattaatccatttgattagggaattgataacttatatcaattagtcctaattgatggatggttgatggttgtgtagtggaggatggttcatggctagttgatgataattagttgctctattcctcttcctattccattggtaacttacatcaattactcctaattgattattggttgatggttgtgtagtggaggatggttcatggctagttgatgacaattagttgctctattcctcttcctattccattggtaacttacatcaattactcctaattgattattggttgatggttgtgtagtggaggatgattcatggctagttgatgacaattagttgctctattcctcttcctattccatgactcttacttttcatcttccattcctcttataaaatgagaatggatttgatctcccgcgagaacagtgagacacactttcatccattttccaacgctgttgctgctacggtaatcccatcccgacgagtgtgtgcacacgctttgggagagtaggcctccgaaaccacgcgctgctgcgacgtttgcacggacgggcgggcgatcaggtttttggggagtgcaaggcgcgactactcactgttcgtcaacatctacttcacattcaccaatatgtcgaacactggagacaacggcaacactggatacaaggagaaggaggctcccgtcaataccaacggaggcaatactgcctcaaactccagcggaggaccattcttggggtataacattcttacaatatttcaattagaagttttactgttaatgttcatcccaatgtcaacattatgttattatgtgattgttgatgcttattctacattaagcatgctcatgttgattacattcaccactatcactggatcaaatcccattgtaaatatcatatttattatcttgttattttgaattaaaatatgtcgaattatgaccaaatttccaacagctcgcccatcaggcccggcctgcttcccatccgaaagaaggcagccagcctagtggtagggccatccaaaaaccctacctttcgaacccacccgttcattatatttaaggatgttgttgcccttgaagccggtatcacacatgaaatgtgcctggcaacatcagccggattcacagctcgtccaagatctcttcgattacaatgcctccgaccggccgttcgtcacgcgcaccatttttccatggcaataccccaattaagcgacctctatcggggtcttgttgacgccatcaaagatcctagcgtcgtcaacacacaagcaattctttggaatccttttggtatagcagcgcgtgtctgacccggttgatttcagtactctctttttgtaaaagaaaagttgatataaacatatatagaaaatgaaggcgatgattaagctttgaaaccctgaaatgaaaacgtatagagtttgcttgccttgattcatttgatcatttcttcaagggaaaagagacatttgcgcctttgtttcctcgtaccgctactgtaagtctctacacgctgttgactagagagtacgtacgtatcttcatgttgccattgatgggcgcagagaggctttgttactgccaatttgtttggttcttgtacggccaattaatgttgtttcaagccagcttacgaagccatatatactggcatactgctgttgtacatgtgggaaatttcacatggactaatttctcaccataggggctgtttagttccccaaacttttcccaaaaacattacatcgaatctttggacacatgtatagagcattaaatatagataaaaagaaaaactaattggacagtttgcatataaatcgcgagacggatcttttgagcctaattaattcatgattagccataagtactgctacagtaacccacatatgctaattactgtttaattaggcttaaaagattcatctcgcggtttctaggcaagttatgaaattagttttttcattcgtgtccaaaaatcccttccgacatccgaacaaacgtccgatgtaacacctaaaaatttttatttcatcaactaaacaggcccatatagagtttcaccaactaaacaggaccatacagagggaattaaaggagacgacatgacccactcgctgaaaagcaaaagcagcaagctgcatgccgagacactgcgtgatacacgatgcatacgcacccaagtataattaacaaatttatatttcctttatatcatcattatactatatattatctgagacctccgtgtagaatggaacgtatatatgattgtcattgactgacgacacaatccattcatcttactacatactagtagttaatttcgttagttaggcacggccgcacgatagggactacttcagtcgtctagagtacatctgtatatatagttagttacaccggagattaattacaaaccagagattaattacaaaccagcaaatccatatcaggatcagcattgatagaacgttcgatacataatctgttgcgataaaacatactccctccgtttcaaaatatttgacaccgttgactttttaacacatgtttaaccgttcgtcttattaaaaaaaacttgtgagatacgtaaaactatatatgtacatgaaactatatttaacaatgaatcaaatgatattaaaagaataaataattacttaaattttttgaataagacgaatggtcaaacgcgtactaaaaagtcaacggtgtcaaccattttaaaatggagggagtatatacagagatggtcagggtggtagtgggcagcaggagagtgcatgttcagttgctgattctgcagctgctggccgcgatggtggctgcggcggaagaacccgcggtgccaaccgcgaagaaaatcaagagctgcaccaccagctgcggtaacatcagcatcgagtacccgttcggggtggagcccggctgctaccacacagtcggcttcaacctcacctgcgaccactcataccacccgcccaggctgttcctcggtgatggcacggtgcaggtgctcgacatctccatccccaatggaaccgtgcgcatcaacagcggccgaatcaatctggagtacgatggccgtggaagcgcaaacgggacatggggcggtggcctcccagatggcgggccgttcttcctgtcggagtcggggagtagcctagtgttgatgggccacgatagccaggtcgacgtctgggggctgggaggggacaacccgatcgcctcctgcagtgtcatctgcccaaggatcccatcagcaattttcgggataagtgcgtgctcgggcatttgttgttgtcaaacaaacatcattttaggctactcatcctatctcatccagattcacggtgatgcaaactttttaaatatctacatggtggaccagggattcaactataccaatttcattaattccaatgtcgatctcattatttttgattccgacagagatccgcaagcgctcccagccttgctggaatgggtaatcagtaattcgacaagttattgtcctagaaattcatctgcccccgagtgtcgcagtgcccatagctcttgccaagacactgatgcttgggcaaacaacgggtatcggtgcaagtactcttatggttatcaaggcaatccatacatcattgatggatgcaaaggtatacgttatgaacacgggtccttaaactttgcattcacatggatcattgtttatataaagaatcatattaaaaatcatgtgcaatcaaccatcaaatgattttatttttcatatatactcttacacaaatgaactataagatttataattaccaacgtacaaaagaaattcctaatagtgaccgatgatgctagaagtggccccatatatgtggatattgtccctttttgaaaagggtagatttgtgcatttccttatatgttttcttccaagtatggttttgtggtcgttttgcaaagataactttagttctaatcacaattaattttccaacctagacttttccttcttcattatctaaaacgatcagacttttccctctcctgaccaatacaattttgcatatctagacatcgatgagtgtcattctcccgatatatatccatgttttggcgattgcactaacacgcaaggaggatataactgtcggtgccgagatggcttaaagggcaacgctactcaaccaaacggatgcgaaggtatgtagataaatacgagtgtttcaacataacgacatatgtataacaaaacaagttacttccttagattgatacataattgagtacaataattggtaacccccatatattcgcacaagcaatttacattacatacttttgcaccattttttagttaaaagttatataaatttgttttaagcactcaagaacaaaaacaatttaatttattaatagtctaaaaaactgaaattaatagcttcaaaattttatatataatccacactaccagagaaacgcacaactagctaatatatctcttgatttctcaacattgttttagatctcctttctaggtgtgtactttcagtaagttgtattgtttatgtagacattgatgagtgtgcagaccggcgcattcatgctatggaatctgcataaatacgcatgggtcatttcattgtcgatgtcaaaatggatatggggatccctttaaaaaggggggatgcatcacatccaacaattctttgacaggtgacaattcactaaagagcata

SEQ ID NO: 5477 - DNA, 1660 bp, Oryza sativa
tggggcccttattcatcatcttcatgtcgatggtccaatctcactgtcatgggatgatcgattaaggatttcacttgaggttgctagagctttgtcctatctacactcagcttcttcaatgccaatttatcatagagatattaagtcctccaatatacttcttgatgatagttttaacggcgaagggtatcagattttggggcttcaaagtacaccccgatagatcgatctgaaataactacaactgttcaaggaacaattggctacttagatcccatgtactattatattggtcgactaactgacaagagcgatgtttttagttttggagttcttcttgtggagttgcttactcgaaagaaacctgttgttgacacgttcgatggtgatggccttgtttcacattttattttgctgctctcagaaggaaaccttattaacataatagatcctcaagtcaaggaggaggaagatggagaagtccatgaagtagctgcactgtgtactaaattgaaaggaggagaacggccttcaatgagagaagtagagatggcactggaaaacatattatcaaaaaagggccccttccataagggaaatagggaatcaagtagacccagtaaaaatcaaatttcagcactatacatgtcaattgaaggagttgccacagaagcaagtagtcaatccatggaagaggaaatgctatcgtttcctcgataattatgatctagcagtctagcgttagctaggacactagcaagcttgccaaggacccaataatttatgtatggacgtatattgctaatgttctgtgctaagtaattcctaagatattttgctttgagacaataatgcataataaaattgcaagtcataactcaagtacttgcaatccggtttgggttgattgagtttgctttacataagcgactagttagcttcttcctgtttcattatctaatgagtgtgattgatttactcaatcatggtgttgagggatattaggaactgcagctgagcatcacagtgtcgctgttctactgcaataatgaaactgcattgttctctctagtcatggacctcatggttgcgtatattcacgcatggtgactctaaaatatagtcgtcttaagtcgggaactctaaaaatgtaggtttccacaaccgcaatctgcatatatatgaaagaaacgcagcttgacggtatattaaccacctgcccatcttcctcagaacatagagcaaattgagaggggagatcaacacaagaaacaaccttaattgcttcaagaatcatctaacccaaactcaatacaaaaatgtagtacctaaaaacaaaatggaggaagagttggcaggaacctttctgtcggagagggttctctaaaaatggctgtcatttgcaccatccccttcttctatccctctcgcatactgaaattagcaagagaagctttataacctcatataaaacttcagttgggttaaatattaacaccttttaaccaaacaaggatggaacatatgggaagcatggtaatcagattacacattgaaaacctgtgtgatctgaccagtttttactccctctttgatcgacttgacttcagccgattacaacaattccaagactaaagggtacaatggaccccctcccccc

SEQ ID NO: 5478 - DNA, 21062 bp, Oryza sativa
  unsure (1)..(21062): unsure at all n locations
cttgaggtaggactatgagttaagtgtactcgtcagggtttgtatgacttctaataagtggaacaccatcttctctccacacaattcggtcatcacatagggcagcaactgcctcaacataaacctgatgttcctgaaaaataaggttaataaatgagcaaaagaacgtgtatcatcaatttcagttgcagctaagtgaatatgtcatagccatgtatcatcaaagaaatcttagcggagcataagatatgttacctcatgaaggactcttgcagccaattgctctggagtatcattggctagcacaggtacaaccctttgggctagagtccttcctgtgtcatagtgctcatccacaaagtgcacagttggacccgaatacctgtgtatagttgacacttaacagttagagtacaaacaaagatcattctccaattaagttaataatcaagatttaattttcttctacaatgtgaggtatcagctcaaattgattgccaagatattgctttccatggaaatagcattgagtagatatgcaaactgcacagcagttgcttgtgatgggtgatagagagattgtgaagtacctggcccctgatgcgatgactgctttatgcaccttcaaaccataataacctttgcctccaaatgctgggagtagtgaagggtgaatattcaaaatggattttggatattcctgaactagctcaacaggtataagtttcaggtaaccagcaagtagaatgaagtctaccctgagttccctgtttcacataagaaattaaggatagattgagaatcttgagacctattgcaagtgaccaaaacaaatatccgcagtaggcaagccagtcttgtagaagaggatataagtgaagtgggaactacaaacaccgtaaaacatgcagtggctattcgtgaaaaaatcaacagtggtacattacagtatatcagctaggcaataacaaaatggaagctaatctgactgactgtgtgggcacactgtacaactgatgaagaacacactccaacaggttccggactaaacgtcaacccagagcataaaactgatatcaaagttcatctggcaaaacaaggtagtggcacacattcaataagtaaacactaaaatcatttaaatagttaccaattcatcttcgtttaaaatcatttaaacgctactcgcacacataagacagataaatggattagaaaacttttatcagcacacagcaatgtatcatgtatgcattttgcaaacaagactaaaggcaagtgtgaaaaatctcatatcgaccatttttttctacaaatccacttatctaaaacctaacagatgaactactaaagctagaacatcgaatgtcaaagcctgaaggtgagatcaaagcaaccaacccaacctcagagcattcaacaactcatcaatagaaaccccctctggagcagacttcgacttcgggaacacaaccaccggtatcccattacccctcgcatgctccgctcctccacagcctgcaagccacatcaaaaatccccaataaatcccaacaattccacccacatcgccacccaaagagctcaaggaagcaaagcatcgtcgtcatcgtcacctggtttatcggtaaccaacgcaaccacatcaccattcacctccccacccagagcggcgtcgtggatcgcccggaagttggatcccccaccggaaacgaacaccgcgagcctccttctctccaccccgacgcccccaacctcacgccccttcgccaccacccccaccgccaccgccgcgtaggctcgagcatccggatggggcgaccgctcgcagcggacagcgcgaggtcgcggctgggagacgaagcccacccgagcacttcgccgctcgtgctgctgcttaggcatcggattgggcgagcagcgcaggccggagccggtggaagcgacggccgcctccatcgcgagattcccccgcgcctcgcctacgcagtttgtcctgcgtaacccgatgaaccctagcgccgccgatggccgccggcgacgatcggaagggagagagtgtgtgttactgccgctacgcgtcgaaagcgagcggccgatgggatattgcgatgggacgcatgtgggccttctgctgttgttagacaccaagcccaccgaatttacagcccggaatttgttgggatcgaggttggaaaggcccaatacagaacaaaaagggcaaagatttaagatttgattttttaaaaaaaaatcagttcccaaacattagacctttggtgattaaatttggttttatatacttcagttccaaaattaacatctttgtgatgataatggaatacaccgtctagtcgagactttattagtggatacggttggctggcatttgtgagcatctggaatcaatttctatcagagtccacacaaaagggaagatgtgtccattttgccaggtaatttatctatagtttgtatatttgatgagaaatcatgaagtgtgttgacagacagtatagaccattttggtgtttccatatacaaacaatcatcgtgtaggaagaccatactacatcatttgcctaagagcagcatatgagcatccccacaacagtaatgaaaatgatttacaggtatacagaagcaataggagattgcttggtgaaacaattcaggccatggaaacttcaagagaggcctttgcaagccacagcaagccaggatcgttccttttcaataccaagtaagtctctgcacgaccaatctcatccgagacgacatcctcacagaaaccaatcagttcaaggacctccattgcagctgttttcagggaggcgaaaaaaatgaggaagttagttacagttgatttttgaagacctgaagaaaaaaaaagaggggagtctataaagcaaatagatacctttgtagttcgccacactcctttggaactgtggattggactgcatatttgaaaaatgaggattagtaagtaagaatttttttagtggaccaattgaacctaataaaagagcataagaacagccaagcataccttacgcagtctcctgtacttgatatcatgtgggtgctctatcacattcttgatgatcttaaagagtgtttgaagagcagaagttgcctctgtaggtgttgcttgtgagcgaagcatttcaatggccttctgaaggcgtgcacagagggctgccactggttcttcgatcctctggagctcactgatgtttgaattagcagcatgatcatcaggatcaggctcagattttgacattgtcgagtttctgctctgttcagtctccacttccatcttgtttacacattcttctacaacagcttcgcatgtagtttcatcagacctgtcagttcccagcttcttattcagaatagcatttgaggaatcatcaggatcaggttcagaattctgaactgcgaagttacttcccaattcagtctctacttccatcttgtttacaggttcgggaataaatttgctagtaccattatcgtcaggatcaggttctccattctgcttcccatcaatcgtcaactcctggctaagaatatcaacatttgaggaatcatcagggtcaggttctaggcaaccagcagtgctttgctggtgaatatcatcagggtcaggctctgagtgactgatggtatcttgttctgtaaatgatctagaaactgaggaccaagatgccccagtccctacatccacgttcatgtcatcattatcatctgggtctggctccaccttagtgttgtcctgagaaaaatcttgaccaacatcatctggatcaggctcaaattttgtgttaggcacaagaatttcatttccaggtatagtaacgctgtctttagaactctctaaatccgctgatgcattcaaaaaacgcttataagcagcagacccagacaacacacgagcacttgccagtgaactggatcctcctccaagtttgtggccaacaacaacactgtctggctccagaacaaattcgtcttcataggaatcgaagattttgcgaccactcagcacatgacctcttgacttggtccagtccaaggaagctgcttcatcattcaactgaaattgacattgtattaaagaacagattaactcaaaaacataaagagacagtagccaatcatgaaaggattgtctaggaaaaaaaatcacctgcttattaagagcaaaaaaatttgcatcatgctcggagtgcaccatgtgtgcctgaaatcaccaagtgcaagtttaatatacaataggcatgattacagaggacaaacggaagatctgcataagaaatctccatttcatgaaagcagaaaaccaaggaggcatacaagttcatggagtagagttctcttgatactttcatatttcctaaatcctttcaagtcatcagttcgtaggcgaagggatatttcctctcccatgttctgtattaacaatgaggaagacatgatgatataacctcagaaattgttgtgtgacaagtatccatatgtgcagtagtaaaaagcttatacagttatactaaccttattgaagcctagaatgcattttggactgacgcctacataccctactggtgccatttcagtcatgattcccactcgccatctatgctgaaaaggccaacaggataactgtaaaataacgaatgtacacaaacataaaaaacagaaacaccacttgaaaatattgctaccttgttcatgatcgcaattatgcctgggtcacatgctagcatgtgcattcttttcagagcttctgaaggtgggggattcaactggcatcaaacaaaaggcacgtaagcaaaactcgatagttcaagatgttgtgattggcctatttgttatcatacaaatcaggtatatctgtttttctactagcatgcatgtattttttttacgaaagaatgaggtatatatgaaaataatgtctagtgttcaaatctaatgtactatatataatctatagcaagttacaggaatcatatactgatttcattacaattgtcatagtgaacccattcatttcatacatatactgatttcattataattattatagtgaagtcatgtcatgaaatgagaaggtgttaactatgataaataaaatgagcacaccacattgtttaacgttgtcttttcacaaagttttggacagaaaccagtgcaaactgcacaatggtccaattccttcaaactatttaatccacaatttatagtgtgcatactgttcaaatggaacacttcgtgcgctgcttgcatcctaattcaagcaggaaattgcaagagttcagacttcagaggaaaatgtgcgcgctaaggtttatgataatccgtgaggagacaaatgatatgtggagtatggaaggggcggattgacatgcctacatgaactgtttcttatagatttcagaaagcacgtagggagtagaggctaactaacctcaatcccaggtaagtgaagtgtccgaaaatcacagaagatgtattggccctgtggaagtttgagtggaacttggggcctgcctgatgttcgttgcctcagccgttgttcttcctcctcaaatccaattatccgtagatctgttcttttgccattgtccgatacttcctcgatttcatcattaaaaacacccatcattctaataggcttcccctgtagcaaacaatgattgaatataaattattccattctccattataatatccataacgtagcaacatattgctgagcaagtacaactcttgtgcatcttacatcactaatagcagcttctttcaatgtcaaaactgaatgagggtcggaaaacggtgtgatcagcttggagcctttgtttgtagactgcggaacaataagcttcaatgtctctgggttaacactagtcaaatcctgcaaaagttgcccgaattccttcaccgtacagctcgggtctgcatcgacatcgagctgtctgcctctccaagtgaccgaaatccgagctattctcttctcttccatcttattcctgataagaaaaaaaaacacgttatgccatcaaactaatttcatagtatgatgatgttataacagaagatcatagtggcacctaccaagaagttatcaacaagacagggaagaaaaaaaattactaccctatcttgctatatcaatatgaaagtataaggccactgcatctaatgagcagggggcggctaaaccctcaattttattttgggacacaagttgctactccagtagtactacaccacgcgccaaaaaaaaatccagaataaaactggatgcctaatatgagtcaaatatgaatcaatcagagccccgtatggctcancccaaccggaggggatgggaatacctttcgattcgattcccaaccgagattggggcaggtggaattgaaggaggtcagcggcgtcgcaccactcgcccccctccctcaaaaaaatccttctcgtcggccgccgctccgcgatcacaccggtcgcaccgcagatcgggaggcagagaagcgcacggcgatggcggctgcgcactcgcgcacgcgcggcggtggaggaggaaggaagacgagcgaggcggctgcgccccactcgaggggagaggggaggagggattttttttttttttttttggcggaggcaagcgaatgttccagaaggcggcagcggccgtacggcactcggagggaagggacgacgattctatgcacggaggaaggtttataaacgccgtccgtctcctggtgattgcgtaatagctgacggctggacgttttagacttgggaaatatagctgacgccgtccatcttacccttcttttaccgcaatttgttttctctaataaattctaatactacgatgagtcgatgataagggtgcccatcggcatatctgcaaagaaaaagtcatttgtgaataaaacttttatatgcgtgtttttaacgaattaaaagtaaatgctaaaaataaactttgataaaaaaaaactttaaaatcaatttcaaatttaaaattgaaaatttaaattttgactaataagtactccctccatctcataatataagggattttgagtttttgctttcaatgtttaaccactcgttttattaaaaaaatttaaaattattatttattttatttgtgacttactttattatctacagtactttaagcataactttttgttttttatatttgtaaaataaatttaaataagacgaatggtcaagcattgtaagtaaaaactcaaaatatataagcttaaaatgaagccgcacatttggtttctgtgtagtattccaaaagtttcatatgtgtacagcatctttgctcatatactagtatttgatggttgagagtgttattgtttcttttattggataatgcagcctagttgtggcctacgaatataaatatatgatttgatgttcagtgttaaatttatcgcatgaaaaattacctttgtagcaaaatgtcacatatgctcaccaaataacgatttccacaattgtaggttgtgactgctgtgattattaacttgcaataccaggtgaattttgatggagtaatatgggtaacatatactcccttcgtcctataatataagagattttaagtttttgcttacactgtttgaccactcgtcttattcaaaaaatttgtgcaaatataaaaaatgaaaagttgcgcttaaagtactttggataataaagtaagtcaaaaaaaataaataataattccaaatttttttaaataagacgagtggtcaaacagtgcaagtaaaaactcaaaatcttatattatgggacggagggagtagtatagaacagcatagcgaggaaggcacttctactgcaaacagattcaagttgaaactgggagacatccagagaagatatattattaccgaggactttaatttgtaccccaagtatcatctttgttctggatatgtttagttgataccctcaaaattttggacaccaaacggtcctatccacatcattaaaccatacttaattccatgctttgtaatcccttgttttcttgattaatcttgcagcactccctccttcaccacacattggacagaaactaccatttttcacatcccaaagtggtgacactgatgatcatcaggattctagtaagtttgggctgactgaatctgaatgcaaagcacatgaaggaccaaacaaatctaacgacttgcgagacttgcagagccatggactggagagatgaagtgaccagcttcatttcgaaggaattacacaccacagttcccatattactaggtcaacgcccgagctgaccgatgacactaacaaagtacaacagaaaatttcaccattttactccctccattttagaataaggccctgtttaaatcctacacaaaaattttacaccatatcacatcaaacatttgaacacctacataaagtattaaacatagtcttagaaaaataactaattgcatagattgtaactaatttacgagacgaatcttttaagcctaattgctccattatttgataatgtggtgctacagtaaacatttgttaatgacatattaattatgcttaataaattcatctcgtggtttgctaacggattctgtaattagttttttattagtgtccaaataccacatgcgacaccctatataacatccgatatgacacgctaaagttttacacctctggatctaaacaccctcataaattaaccttttcacacgaatctacacatgctatgtttaattttatgtataaaaattagcttattttagaacaggcagagtatgtgctgtatatacctcatagatccatgtgtacatgataggcgtatatacttccattttgttgtacgaagttcctctcggaagtcggaacaagcttgacatcttgtgccctcttttctggcccttcagcctatggtccccgggattgattccgtcgccttgccaattgccaagcagtgaagcaaagcacaattccttgcccctttttttgtttccttttgcgtttgtgcaattctgcaagtccatacattgaaatataagtttttgttcatgaatttgaattgatatattaccacgtctgcattctgatctcgtttggttgtctgtgtccccgtgtgttgcaattggctaaattattttgttgatatgccaaaacatgtcctaccaaaatacttttagtagttgaatagtgcacatgtggttttggtttgcaaccaaatcattggcattgccaatttccaatttgatagtttctagattgtactaaatgtttggttccaaattagttttgctgaccaacgaacctaggccgtgttctttgcaatactattccaacttcaataactcatttgtcacacgcacatttctcaaactatcaaacgtaatttgtttctatgaagttttataaaaatattgttttaaaaatcatattaatatgtatatatatatatatatataagttttttaattaatacttaattaatcatatcaataaattattttattttacatattaccaaaaaaggcttccaaccttaaccaaataacataaccctaaagataaagaccacaagtcttcattcgcttccagaaccttcttgcatctaatctgcgatgtgcagttgaaccttccaaaattcatcctgtaattaagttgaaccttcttgcatctaatttgcgattttttctattttgcaaagatgctattcgaatgacagttttagtgatatttttgtaatttttcagtggcagttttacaataacgatttaaagcagtggtaaatttataattgccccttacaagaattatagtattcactattcccatacagtactagaccatagagatgatggttttcttaatttaaaccgactccaagcctctccactcctccagaaccttccaaaatataaaaaccataaccaaccgactgacatgtgggcccgacgactcgtcaagtcgtccatctcccaactcccccgctggttcgagcccctggtagaacgttcgagaacccccatctcccccttatatatcgcccccttcttccccatctttctccaatcgaatcgcacacgccacgcgagctccctctcctaaagccctaaccctagcctccaagtcgtcgtcctccggaagcttccggcctccgccgccgccgcagcgccatggcctcggagacggagacgttcgccttccaggcggagatcaaccagctgctgtcgctcatcatcaacacgttctactccaacaaggagatcttcctccgcgagctcatctccaactcctccgatgtaagtgccctcggtttactggttcagatctgcacgcgcgcgcgttagaagggcttttttttggtccgattggtagatcggtttgttcacccaatctggttcgagctgactcgtgtgtgttgttatgtgtgtgggtgtgtgagggagtttgcactgcagcactggttactggttactgagacatcatcccaacataaatctgcgatgtggtgtttcactccccattttttaagattatgtttcgattccgacgttaattacgtttctcagtgtatcaatctgtggatcatgctcgcagtacttaattttgttagtgtaataatctgtggatcatgcggtccttaattttgttaagagtcctgaattttgctgctgattagaatgttataaacataactgcaggcataggcagcattatctgtcgttgttctgctaattaatctcgtagcattatttacgattgctctgataaagtcgcatctgaaaagtctcacatgctttgagtgttgatgtttaaatgttgtaaaacatatcccctataaacatagagggttgttattttgctagttatcatttatttgtcatttattttgctagttatgtcacattctaaattgataggagggtttgaccatatataagacaaaaacacccgactagtgctttattttgctgattcattgttaaaattgcctctatgaaacaaaaacacccaaccagtgctttactttgctgattcattgttaaaattgaccctatggaacaaaaacacccaaccagtgctttactctgctgattcattgttaaaattgcccctatgaactgaggattggtctggttctctatcctgccaaaaatgtggtaaatcctgaaatctttggagttgctaaatttgggcagggtagagatgtcccatttggtgtcaagattgagctgtgagaatagatggggatagctgaacttttggtgtggaaacattattaaattattgtcggatagtgaattggaattgctagctgctttcatacaaaaccggccacttatcttatgcttttgtgttctgcaggcgttggacaagatcaggttcgagagcttgacggacaagagcaagctggatgctcagccagagctgttcatccatattgttcctgacaaggcctccaacacactgtcgatcattgacagtggtattggtatgaccaagtcagatcttgtgaacaacctgggtaccattgccaggtcagggactaaggagtttatggaggcactggctgctggtgctgatgtgtccatgattggtcagttcggtgttggattctactctgcctaccttgttgccgagagagtagttgtgaccaccaagcacaacgatgacgagcagtatgtgtgggagtctcaggctggtgggtccttcactgtcacacgtgacacatctggggagcagcttgggaggggtactaagatcaccctctacctcaaggatgatcaggtactaacagaatttcattgaattcttgttcaatttgtgctgcttgtattgctgaatgcccttatagttcatgaatgtggcttgctattgataaatgcatcaactagtaattctgtcctcgtaggattattacgaatattgttggtacttgattttatagccacttttagaaagaacatgttgatgtgcctcaagttttcaccataggcatgcttgagccaggtgcttaatcggtctgtttaagacataaaaaatgtctctatgtaggggcatttggtgaattgattgaacagaatgaacatatttcacacactgttgacattgtgataatctagatagatgccttaacatttcgaactcctgctgtgaaaattatgttagtatgtttctgccttggatgttatgagtaatcatgttacacatgtacttaggatctataagcttattgttgagctcataaactgattgtgtatgcattttttttctttgggtctggttttgtgtcagtttgattgcgtgtggttgtctaatacttcctccgtttcacaatgtaagtcattctagcatttcccatattcatagtgatattaatgagtttagacatatctctctatctagattcattaacattaatatgaatataggaaatgttaaaatgacttacattgtgaaacggagggagtactatgaattaattagtaacaagtattactgttctactgttgtgaatttttagaatcacctgaactcctaagttgaactgtgaaatgtgctataaggtgtcctggctctaatgtgttcatttgttattgacaacttgctcatgcttcctgcagttggaataccttgaagagcgccgcctcaaggacctgatcaagaagcactctgagtttatcagctaccctatctctctatggactgagaagaccactgagaaggaaatttctgatgatgaagatgaggaagagaagaaggatgctgaggagggcaaggttgaggatgttgatgaagagaaggaagaaaaggagaagaaaaagaagaagatcaaggaggtttctcatgagtggtccctggtcaacaaacagaagcctatctggatgaggaagcctgaggagatcactaaggaggagtatgctgctttctacaagtccctgacaaacgactgggaggagcatcttgctgtcaagcacttctctgtggagggtcagctggaattcaaagctgttctctttgttcccaagagggcaccattcgacctctttgatacgaggaagaagctcaacaacatcaagctctacgtccgccgagtcttcatcatggacaactgtgaggagctgatccctgagtggctgagctttgtcaagggcattgttgactccgaggatcttcccctcaacatctcccgtgagatgctgcagcagaacaagattctcaaggtcatcaggaagaaccttgtcaagaagtgcgttgagctcttcttcgagattgctgagaacaaggaagactacaacaagttctatgaagccttctccaagaacctcaagctcggtatccacgaggactccaccaacagaaacaagattgccgagctcctgaggtaccactccaccaagagcggcgatgagctgaccagcctcaaggattacgtgacgaggatgaaggaaggccagaacgacatatactacatcaccggcgagagcaagaaggccgtggagaactcccccttcttggagaagctgaagaagaagggttacgaggtcctctacatggttgatgccatcgacgagtatgctgttggccagctcaaggagtttgagggcaagaagctcgtctctgccaccaaggagggactcaagcttgatgagagcgaggacgagaagaagcggaaggaggagctcaaggagaaattcgagggtctctgcaaggtcatcaaggaggtgctcggagacaaggtcgagaaggtggtggtctcggaccgtgtggtggactccccgtgctgcctcgtcaccggcgagtatggctggacggccaacatggagaggatcatgaaggcccaggcgctgagggactcgagcatggccgggtacatgtcgagcaagaagacgatggagatcaacccggagaacgccatcatggaggagctccgcaagcgcgccgacgccgacaagaacgacaagtccgtcaaggacctcgtcttgctcctcttcgagacggccctcctcacctccggcttcagcctcgacgaccccaacaccttcggcagcaggatccaccgcatgctcaagctcggcctgagcatcgacgaggacgagacggcggaggccgacaccgacatgccgccgctcgaggacgacgccggcgagagcaagatggaggaggtcgactaagcgggtttccttttttttcccctcgtcaaatccttcgcagcgaaagtacaccatggagcattggagctagcttatctgttttaccttttgaacatcgcgttgttgggtcggttcggtttattttgtgcgatttgctttacctttacctagcctgcaatgcatggggctagattgtgctatgggttctcgaactgcgtacgttaattatattgctaaatatgagtattatattagtgtcctcatgagttgtctattttttcctctgcaagttagatgtatcaattaattttgcgaatattcttctgcctcaattccaccttcgagcaccagctttgcaatttacagttacagaaacatatgattgcgtagtgtgaatgggagatcttgtcacgctgatcaaattgatcaacagcaacgggaggagttccttgcagcgaatgcccttggcaatttatactgtgctttgttggtggtttgctcgctctggtgtttgttggcgattgcccgttggcgtccaatccttgcagctgatttctttggtatccttggagcacctgatgaaaatttcttcagctcacgataacaattaaatatatctgttttctgttagcaataacaatcaactttttcttcagagcaaacaatcgactgtttcttcagagcagctcactccggattacctgacaaaaacacaattaggactagtaggtacctgacaaaaaccaaaaaacaacataacactcggtcctcgttcatattcacatcagctaaattttatacttcctcttcatcatattataaatcacatagtagaaaaaacatagtagcatctataacacaaaataaacatatcattacaattattcaatgttagatttaatgaaactatttttccataaaattggttaaatttaaaaagcttgactagaaaaaaaatcaaaacaaattacaatatgaaacagagagtaacaaacactgctaacagacgagtctcgaagaccatgaagtgggattatgtctacgcttatgcacgtatagcatattgtcattggatcttctataagggtcaaggaaacacgaccgctgaaaaaattctgatgatttaaataagttttgcctatgttttgatgctcaaggaaattgatggtcaaggaaacaagaccaactgaataaattctgatgaattttaagttttggcctgtaaagacagatgctgtgacataatccatctttggcgttatggcaatttcaatcagctctgaagcataacgagcatagtattttgctatctggggcttatgagttgtgatgttctaaccacatttccgataacttgtaagcattaagcaatatacccaccagtgccaccacttccattgctcaaaagcgtaaagtcaatatcaggcttctgcaagaatcttaaacctatcgtgtccatttcctgatgccagacctctgcacaacttgcctcgcctccagaacatcgaaccatttaccagcagcagcataaatgtcagaaatcaaaacatggcagccagactgctgggcgttgagattgaggctatggatctcactctgaactctttcagccacatcaaatctcttgtgcattcgacaggcacccagtagagcgccgaaaaccatgacatcgggtgccatcggcatgctccggatcaactcctctgcctcttcaagaagccctgctcggcctaacatgtcaaccatgcaaccatagtgcttcacctccggctgcactccgcaggtagacgccatgctctggaagcaccgtcgaccttcatccaccagcccaccgtgggaacaagctgtgagcacaccgacaaacgttatgtcgttcggcttttcacccgttctcttcatctgttcgaatgcgtctacggaatcccgagcattgccgttcattgccaacctggtgatgagcgcgttccaggccgagacgttctttcggtccagggagttgaaaattttgacagcaatgtcagttctcccgcacttggcatacatgtcaataagagcagcaccaagattgtactcgttgttgagcaccattttgtgcttgtcgatgaaggcatggacccatcttccttcttccagtgctgttaaatttgcgcatgctgaaagcacactcaccatggtcacctcattcggctgtacattgctctcagtctgcattgcgcgaaacagctcaagggtatcctgatagcgtccagcctgagcataccctgaaatcatgcatgtccaggaaaccacatccttctctggcatgacatcgaacaactccctcgcgccatccatgtcgctgttcactgaataaccccggagcattgcattccatgacaccagattcctgactggcatctcatcgaacatcttcctcgctaacggcagcagcccgtggcgcgcgaatcctgtcaccatggagttccatgtcacgacattcctcccaatagctggcatccgatcgaacatctcccttgccacatccagctccccggccgcggcatagccccccaccatggtgctccaggacaccccattcctccgtggcatttcgtcgaacaccctcttggcactctccatctccccgcacttcacgtagccaccgatcaccgtgttccacgacaccacgtccgcgaccccggcgcacgacccgaacacctcccgcatcgacgccgcgtcccggagcgcgccgtacatcgcgaggagcgcgttgacgacgaagacatccgccaagaacccgcgccggacggcctgcgcgtgcacctgcgcgcccgtgcgcgggaaggccgggagcttacccgccgaaccgaggaggggcggcaaggtgaacctgtcagggacgagcccgcaccggaggagggaggagaaggcggcgaaggagaggcgcggggacgcggaggaggcggaggcgcggatgaggatgttgtggaggaaggtggcggaggaggaggggaagagcgggaaatggacggcgcacagggcggcggcgaggtgggggtgggaagggaggagcgggacgatgcggcggaggtgggcggggctccggcggaggtcgccggagacgacgaggcggccgaggaggagcgggaggaggtgaggcggcggcgccatttttatcttctttttttttttctcgccgcgtggaggggagaaggctttatttgaatatttgaaagcttgtgattaacgtgagccgttggatgcgcatcggatggctgagatcagataaagctggagaaaaagaaacatttatcactagctactggtttttctatactactgtatgagtggaaaattgtacacattttatgtgcagaactttcattagtacagagttaggcttatcctaagtcaaacctatttaaatttgatcatgtttatatgaaaatatggtaacatctacaatatcaaattagtttcattaaatcatcaatatatatatatatatatatatatatatatatatatatatatatatatatatatatatatataaatttgatcatgtttatatgaaaatatggtaacatctacaatatcaaattagtttcattaaatcatcattatatatatatatatatagtaaatttgtttggtgctccatggtgcccgggcaccattgttgaaattgagtatatacctaattcaaatgggtatatatatagggtttttttaaatgatgctatatttttctataaacatgatcaatcttgaaaatatttgacttggtacaaagctaaaatggctttttagtatgatgaaacggaggaagtacattgcaagtcaacagcactattttaaaagaaaaacattaacacaatgtatatatctaagtaaactgcggctcatctggaagacgaggtattcagggagggatgtgcatgatagaaagcagagaatctgaatgctttgcactagagattcatgtcattttgtctactatcaaatttaacaatgaatgcactccacctgacttcgaaccagaacccaaaacaaaagagaacattttatttactatgttagctagatgttcataagccatgctccaatttctatgttcagctatccttgttctcagctgccaatcttcaaagcttgattgcctttgatttttacatttgccacgctagccagtgcgctcagaggctctgaatccaccatagttgatttcttgacaggatcaacaaggtcaagcctcttctgcagcttcctccttttgtatgtgaaagggtacctatgaccttcttcaacttctgtaactgactggctggcaggagtcttcagcttcaatccttctgggtaacgcattgtttcagactgctccaataggtgtttgtaagggccagcggtgtctgtaccaagggtcaacacctcagaaatactttcagcagttttcagaccatgcgtcatgtatccatttgtttgatgacaatcagtattccttgtaaatggatcaggagaactttcaggaattacggcattttgttgaccaaagttcttcaaaaggttcttctcgtggggtgcttcattgcaatattccggactatgtttggttgttgactgatggaaggaattcggcattcgagaatagtaaccccttttaagctcctctggaaccataatttgcactccaaacggactttcaactgagtgagggtaagtatcaagtgtgccttctctttggtagggacgcacatgtagatttctcaaagtactcttgcttgtgtttatgtggtagtaataagctgaattcatcgcaaaaccatgaacatccagtgcagaagcgcaaggtaagctggagacctgtattcccagttggtctgctagcatcggttctggtgtacgatgaattccttcattgtgatcaatgagggaagcacaatcggtctttattttcagcacacctttgggcaatctaatacatgtagtaagctcaccaggaacatgaaagacaggactcttcaatgagctcatttccattgatttgtctctgtagactattcccttgcgcttggctgaacaatgagtggttactgtcccatccatacgtttggttcgcttcaaaggtggaagggttgcatctttaacctcattggcaattgatagacttctattgaaaggagaaccgcttatgtcaacacctgtgaggggatcttcatgtcttctgtcattccaactgttaaccttaccctgaagaccagtactcgccccacatcgtcctcctaccttgtccatggatgcaaacttgaaaatcatgccatcatgatgggacttcagaaaatgataatatcttcgtctttcaaagatcatcagtaattctctagcctgggaaacttctggagaataaaacccaccattcaatctgtggaagaagctcttcactggactcccaaagaacaggtcactgccactaaacagctccttcattgttacaaagaaatcatgttggtccatgtctgggagataggctgctagacggaatctatcatcttctgttagacataagttccatgtctccaaagaaagaatatcattcaattcaggcaaatcataaagcccataagggacactacagatctgatctccagactttgcaagctcacaattgacctcttcatgttcatagtcatcggattcatgaataggaaatctctgaagcagcattttctcctcttgtgtaatgtcctcgtctccacagctgtaagcccgctcttctgtaggcgcacaacttgctaccttcacaatgcccattgatcgaaggaagaggtgcaatgctccgatcggtatcagagataatcatagagacgaaagtcaacagtgtgtccagcacaataccatactatccgacggaagatccctgtgaagaaaaaggaaaagaaaaacaaggaatatcagcatcacaattcatctataattcaatttgaagaccatatttcatgacctcatgcaccaagtaggctggaaggaaatacattgcagagccaagcctaaataattcctggaaatagaatgctatactggcctttatttgtttaaaacattgggtgtcatctcaatttccatttagcagcacagagatatactggttgttggtaagcactagtatgttacaacttataactgggagggcagcattgtctagtccagtaaccaaactgattacacataaatcagaaatgcttccgcttgcgaatagcaccaccatatagacatcatgtctgacagtctgagacaagctaaaaatgctaggcattctcaaagcaagggtttttcaacagtaaaacacaccgcaaatttatcaacaaattctcacgatcacggatcaccacaaaaactcgcccatttcttacccaggagcggctactccgcgagaatcacacacctattcgccccaatttcacgccaaaccaaacccccaaaacaaaaacaaaaaaactcaaaatccccatacaaaccacaccaccccaccgaatcggggggcatcgcgattcaccgaaagtcagcgccgccgctccacgcgccggagccaagcacgaggtaaaccacgggtaccaccaccaccaacatacatgtaccccaaccaatccgcaacccctcggggctgaccccaaccctagtacccagtacccacccaaccaccgatcgatccgtcgatcgaatcgtcccacggcgcggaattcggtaaggcaacagaggaaggaaaggggatcactcaccggctgcggcggcggcggcggatcggcggcgaggagagggaggaggaggggaaaggcgaggaggaatttgtcccgggggggagggggggggggggggaac

SEQ ID NO: 5479 - DNA, 3817 bp, Oryza sativa
gggggggaacacgcaccgacgcgtgcgtgcgtggtggctactgctactgtggcgccgcgctgtttgcttggcagtggcagtggcagtggcagcgagaggggtgtgcttgcttccattttggcagcgactgcgagtgcgagaggtcttcccttgcttgccatctccagcagcggagaacacgcgggcgacacgacctgaaaaaaaaaaaagcgcctcttttgtttcagtcctctcctcaccatctcttttttttttttgctcagtgctctcacaagtcaaagttacggcctcagtcctctcctcaccatctctctctctctctctctctttttttgctcagtgctctcacaagtcaaggttacggccgcttttttttttctagctagttgtgggcagttctcaggactgttaaatttctttttggcccgtggatcccgtgctaagatttgtgctgagatattttgctattggatctaaaccattttttcacaaactagtggcactagccagtttcaccattgcatgtttatggtagatttatttaagtttttaggaaaaaagggttcttacccagtttacccaaaaaactgtccaaaaattgattaaaccaatgactttcggtcaacgccaagctaaaataattgatctgttttcacaaaccgttcgccggcgatttcataaaaaaacgagcggttttcgcaaaaaaacaattgatatctgtgagccctggcccggtcaatgatagttctttttttttacctcataatattcgttttgaaaaatacgatggcctatattaaatctaggactttggctcagatagatgggttccaccataaagaaacaaatcggtcgaactttaaattttgagagtttgaactagtggtaccaatatagttagcacatgattacaaactttgcatgtaaaattcggttttaccatgtgcagctgtggcgtgaaactcatttttgtaagaaatgcatatctttgtttctcttggccattccacgtgatcccatgtgttttcgattgtttttctacatcaagggtaacctttgttcagtaacatgtaatatattggatcttggagagcaaaatcaatttactctaagagctaattgaagcaatccaagataacttcgtagcaaatcaaagttatttaagaaagaagtggagacaattttatagcaaatagaagttatttcaagagcaaatcttagaactgattgttatttctcgatgaaaaactaaacatggaaagatatatgcactagtaattcaaataagagcatgtacattaaccgacagtagtacaatcacctctcctttagtgataagttagagaacggagattaagaaaataagtagaaatgattagtcactagttatacacgtgctcaatagaaaaaagaatgcaaggtaacaatgcagctaacaggtatgctttaaagatagttgcttactcttctcaaggccgtacatccatatgtataaagcgtaaatctaaaagacgtgaatattagagaaggacctaatatcaaataattagaaggggtgaggcttcgaacctaggttgtctagttcatcaccttgtggagctagccggaagaccctggacgtttttcgtgtaaagcgtaaatctgttcaaggtcttcaaaatttagggctcccaaatctataagtactagtactaattagttatccaatctaataaacactattgcaagtatgaaaaagcccaacaagctattctagcatccatgataaagtccaaacaacaagctaaattctctcattacctcgtttgatcaaaccaacatgcaccgcacactgcacttactcgccttcttggctcctctgattcccatcaccactacaaatttaccccttttttcaaacaattaacgctacataaggctaggcaatgggcacgaacagacgtcacaaatgaacatgctcccaaccgccgccacacttgctggtttttgtttggggcatttgcaaatttgccactggttttttcaattttgcaaggatgccactcgaatggcagttccagtggcattttttcaattatctagtgacagttttgcaataacgattcaaaacagtggtaaatttgcaattgcccctttttgtttctgacttctatgtgcctacgactatatgccgccagccatgacagtgtgcaccgtgcatgattatgactacccgccatcggccaccatggctttcaaattttaggacccaatatgtatattcgcaccgggggcctctgatttctagttatggccctgactcttctattgaccttgccctgacccaattcttcattgttggagagtggttttacatacttgcctttctatcctattaatgaccacatgtgtttccctattcactcatttatctcgcttcttttgttgcttgtccagctctcaaggcatgatcaatgccacacagttgccaagtcagttggagacaccttttttagcatggtgcttgacattggcataggcctttaggagactagcaagagaatggtggtggatagcaaatggtgcaaatgcatattgggcatcgattgggttggataaaaaggtaaaagcaaacattatcgcaaggtggttctttactaaaattccactataaaattagccaccattagaccaggattcacatgatttagatagtcaaatatgcaagaaagcattatatatgtactgagctgaatgcctgaatgggctaatgcccaatggttagtagatacgaaagtcacatattgatattgatttgatacgaaacctacttttacactaatgttatgattttactaaagcttgctaatactgacacaaaatagtgggaaaaaatatgttttaaataccataccaacgtctaaattaaattgattgggcctttttataaccagagagagtttcactttatttccacaagttgttatttggctgatatctaaacattgaaatttaaaactgtataaacaaccgaacactccaagattgagctgcaaagtgcaaacatcggtacacatataggattgagaagccgagctaatgcggaagtagctatgccttgagaagtagggagttcagccaaatggctatgcaaatatgtagtgggctgaatgggctagcgtgcatgactggtttgtagttggttgcaatcatggagaatgaatgggatcgttgcctcccaaaaaaaacgttttaaaaaaacttcggagtattattttttaaaatatttacatttgatgcacaaaggtcatacatattgatttgcctccaaaccaagctcaattcaaaacaaatattgagctgactattactaaagattattattttagttatgaagataaattaaatattttggtaaataaacaataattaatttaaatacaagtggtctaaataatataacagaagactttttttttattttttcccaaaacatggagcaaataatccgttttagcaatctactcgataatttgtattttggttgaaacttaatagtaatgcggtgtgatatggatcagtgacgaaaacatcttcgcaacattaaaagggcacaatttttttgtgaccagagagatcagtatcctttatttcgacatgttattctttgaaacagtttgaagcttgtggttgagacagtgaaaattcagagccgtataataaacggccaaacactccatgattgagctgtaaacgtctctgaacctgaacatatacaaacacatctgatcagtaaagcaaattaaatctggtttgctgctcaaggctctgctcgatg

SEQ ID NO: 5480 - DNA, 4483 bp, Oryza sativa
aattttatatatgttcttagcgaattcaaaacgtaaaaacagtcatgtttattagtgattacaaaataatttataagtaagacttttatttatcccattttagcggcttactgtaggaaaaaagaatgtagttattgtaggaataaagaactatgatgagaaaataataaaattaactctaaaattaagttttgaaatttaagttttggttgcggttgataagctgaagatgaaatgacggaggtgtgaagtctccgttttcactgcaattctggctttgaaatgcagcaatatgtggtcatgactcatgataagcttgttcttggctggatcctcaagtgtccacatcttctctattgtgcagggaacagggaagtagccaaggttgggtggttgatctgtgcctgatttaagtaaagtacgcatgtgctgaatctctgggattaggagaagagtttcaggatggacaaaaaattcagattcagaagataaaagaaaccgtcattaagtagttggattaattactcagtacagtatttaataaccgaccggttacagacggcaagcaccagaaccctgaacacaagggaagaaaagctgcaaaactgtataccccaggcagcaatgacctgccatggatgcaaccatgcaatgctgatgatatatatgccattactgctcaaggtgtggtgagcctaattgttaggccatctgcatgatggatgataatgggtatatggcaatatattctgagggcattatgaataagttgaatgttacaaagttgaaaaggtgtactaaaaagtactccctccatctattttgatagtcatattttcaaatttgaaaaatttatttttgataggcatatttcaattcacacatttaatgcatgactatctattcttccacatatggttggctacatgagtattgagaaatataaatattaatgaatcgtttgtttacgagaaatgactagtagcatgtttaaatagatgataaatagaattatttatccttagtctgtgtgtcaagataaaatatgactattaaaagtagatggagaaagtattatataacaaaaagatgatgaaaaaaatgtttatcgaaaaatcgtaccatttaagagctcgggaaacgtgcacgggataattcataatccatcggccataccgaacttgctcttaattgtacccccaataccatcaatccctgattgtaggggaccctcctgaacagattttaatttggccaacattcatgtgcaaagatgagatggggaagaggccggtgagaaatggacgccggcaaggacaatctgggacagcattgcatccaatccattcatctacctcaccatgattatgctccttggagatcatgttcttgcctccagcatacatagctccgctctttctttctttctttttttttctcttttattttcatgcaacttggctgccacatgtgtgtggccaccaatgtctcatctactaactcaggtagatctgcagggagagagagagagacatggaaagttccatgctggaaaccttgtcataagtccgcacactgtacaacagtggtcacaaaatatggtttgtttggaacgcaggaatttcatggtaattttacagaggtatatgtatttttataagtttaacctgaaattaccgttgttccaatttccaaatggcaccgaaaatgtttgatggagataattgagtgtaactttgtgaattgggtctcaactagaagctaggatggtccaagtccaattacttgaaatgtctccatagaaactgtgatttttttcatgtgaactgtgaagctttgcgggatcagaaaaatgtttattaaggatgagaggatcttcttggccaacaagatttcaactttgttgttactatcgtcgttactgtcatgtaacgtactaatactttgagtggtttagtcaactcaaatcaccaccacttggtctaagtttgacagtctcaagtctgaaaggttgtatgaccgtgggacgtgcccacagattcatcactggcttttctgactaaaatagcacagtttttccttttcaaaaaaaagcacagttaactattgactgggtttcagttccaaacttccgggacccaattaattaattggatccttaaaggtaagaaggaaggaaggaaaaaaccaaggagaattaaggaaattccagatggacacatatgactgttgctatcaatagaagtgtagccatcttgtcatcattattgtccatgtaatcaagattagacgacagtagggtggtgtttatcagcttaattaatccttaagaggagcagtgtgagtaatcttgtctgtacctgagctaatgaggacaaagagcagcatataagttaaatcaccttttgacaaaaaggctatgccagaggaggacattgtatatgtataatgggaaaaaaaattcacaatccagaatccaagaaaagatataccaaaaggtctctcccttgctgaaagaagtttgaaaagtggatgaagactgaagggatgatagttctagtggttgttcaatataaaacttgaaatttttgtttttagaaaaatgaaacttggtcaatatagagaaataatttcttgatgacacttcaatttttttttacaaaaatgaccccaaactgtgctggatatacaccgttgctccgtatccagtaaagggacttcagcctaccaaaaaaaaaacatatatattcatgtggcctgttgggttagtattgtcaaccggatctgattaactaaacaatatttattccagttttaagattctttggcacttgcagatacaaaagagagacaattttgtactgttgtaccacatgcatcttgtgccctcatctcactctttgttcatgctctgtcaatataggtatttagagccatagtgcctctcaattcaactttataaattaaagcacaaaacaactaattagaaacaaaaaatgctactcatttatccaaatcccttagaatatggaaatatatgactcttggattaatcatcatttatctcattccgttgttaaaaccaaatcacataatcttttttagaaaatactggtggtagctgtgaatctgccaccccaccgcccacctactcctaatcccattgtattatttacaaattaatccttaaaattcttaatataaaagacaatcaaattcaaaatgaatgaatagctgcatacaaaatcatatgtattatttatttatttattttacacggtattataatactttttattcattaattataaagctcagtagtacatagaagaatatacactcttattttttttaaccttgagtaatttcccctatcataggattccattatccaaaagaagaaacaccatgatagcaatcagttagactaacaccccaaccaaaccccactttggcactttataaaatactaaaacaaatactttttttcttcattttcaaccccaaatctccaagttaacaagaccatacaaatcatatgatactccactcaacaagtgagaagagacctcaaggagtagtaggagtagcctacaagtctacaagacgaggaaacatcaaaaaacacatcaaaaaccctatacaatccgcacttttgcgaagcggttgcccaactctgtgctccgccgtgttgccgccgccgccatgggctcctgcctctcctccgacctgcctccccgcgccggcgccggcgcgggagcgtcacccgggtggccgcagcggtggcggaggaggaggcagcggggggtggagcggggcggggctgtttccggcggcggcggcggcgtcttctccatcggcgtcggcggcaagaagctgcaccacggcggcggaggaggaggggagatgacggaggaggagctcgcgaaggtcgaggggagggtgtgcgtcaacggcgcgagcgcggcggcgtgcctgcacacgcagcaggggcggaagggcaccaaccaggacgccatggtcgtgtgggaggtgagccaggcagccatggtggatggcttctgagtcctcctgatcattggtactagtagcgttttccttcgcgtgttggttctgaaaatctcgcccgcctttttcctcgccgtgttgctcggttcagaacttggtgcttgcgtttactcgatctttccgaagtcttctttgaactttttttttcttcacggtattggctttggatcaatagcggatttgaattcggagtgtgtgtatattcgattcacagggaggagcgttttagtggagtgcttgattcgaaatgtgggatttgactttataacagaataagcaaaacctcttctatttttctagtttgttcttcgaaacagttcgagcatttcttgatttggtctcactgggagcgtcttcttgctttgttggatgacttaattcgaaatgggaaggattcagctttagattgttttga

SEQ ID NO: 5481 - DNA, 4150 bp, Oryza sativa
cacacaattggtggagtttacctaaagggagtggtgaagtacaatcatggataattttcacttttgttttggacctacaactaggcagctagctaaacttatctagctacataggaatatcttgtgagcttgttttaggaagtcaaacaagtaaaagcagccactttatgatatgcatggtgatcatgctcttcagaggacagtaaagagaatttatgcctaaagattctcagtataatgctattgattgctaatattcaacgaaaataggtaagtacttctttattggagtgaggaggtacttccttgacaaatagtttccatctgttggaattgagtttttattttcttccttttggcttgggatttatattttttatattttttcttgctatgcctcgacttctgttttgaaatgtgagttataacagaaatcatatttctagtcaactttcaacatgaatatgaaatacccttatagggactgttcgatgtcttgctaatagaacctcttagcataggagtatcctcatttactaagggtcagttgcaacaattgctaatcgcatggaacaatgccttgtgagggttccatcatgggtgattggatgctaatttgataccttttccttgcctagttgctgactttatccatctcatttgtgctatttgaggtctgattatctgattctatcctatgtgcatttctcacattgttcacccaactacctgtgtctaccgttctttgtgtagggaatactccattgtgaaaatatgagcatactgaatagaatcccacaaatacagtttgttagaacccatctatacccttcagtttattttcctgaaaagtaatgtgcattgtcgatttgcttttaaacaaattaattatagacattaccagcttatcacatcactggtactaggagcgcaaacaattatctgacctagcccttccattcttgcagaactttaatacaagtgatagtgtcttctgtggtgtgtttgatggtcatggtccatatggtcattttgttgccaagaaggtcagagattctcttcctgtcaaaatacgcacactatggaaaaccagtgccaacgaggacactagttcccaccaaaatggaagcatttctggaagtgttaattcagaagagtcacctgttgttgatgatgaatggggtgaatatgctgatgacagcgagaagcttcctgagatgtttcttccacttaagcagtcttattttaaggctttcaaattgatggacaaggaactcaaaatgcaccctacagttgattgcttttgcagtggatcaacagcagtcacgttagtaaaacaggtgagggatgcttctaaacttgttctagtattcgtagataactgaccagcatttggaacaaaaaaaatagtggtagatattgaaatcaaaatgacagaagaactggacatggcttattttccagggattggatcttgtggttgggaaccttggggactcgagagcaataatggggacacgagatgctgccaataatctaactgctgtacaactcacagttgatttgaagcctaaccttccaagtatgttcatttctcacttatcatttcagtgggtacccttgtgttttcaaaactgaactttctctttaactgcgcatttaggattttcttcttttcctcctagatatggcttcagtcaaacttattaacgcactaagtatagttacttgtctggattggtcactctttttggttaatcgctaatcttcatatttcttatttaggggaagctgcgaggatccagcagtgtaggggaagagtttttgctcttcaggatgaaccagaagttgccagagtatggttgccaaataatgactctcctggattggcaatggcaagagcttttggagacttctgccttaaagattatggtttaatatctgttccacagatatcctatcgtcgtcttactgaaaaggatgagttcataatactggccactgatggggtatttttcttatcatcttattactttcttactactacttaatatggtgttgaaagttactaattccttttgtgaatagaaatgcatcatgttctccaatccctacttaatccatggggattggggaatagtttgatttaacatacaaagatgttacagccttcactccttcagctgcttcaacttgtaatattggtaaactcaatgcatgtaggtttgggacgtcctctcaaacaaggaggctgttgacatagtagccgcagctccatctcgtgcaacggctgccagggctcttgtcgactgtgctgtcagatcatggagattgaagttcccaacatccaagagcgatgactgcgctgttgtgtgcctattcttagaccatgcaaagtcacctgacttgattcaagagaacgagagcgaggaagaaactacagaggatgttgcaatcccagacaccgttgctaaggttgaccaagacattgcacaaggagatgcacatatctccagtgaagagcaaatcaccgagccagcattgcagcactcctacacattaagggatgttgatgagattgtaccggtagaggagcctccagtctcaaaggaacctgaaagatgtggatctgcccgcagccttgctgattgtatatccacaaacgaggaggaggaatggtcagcactcgaaggtgtgacgcgggtcaattccctcttgaaccttcccagaatactttcaggcgagaagagatcaaccagctggaggaagcggcgatgaacgattcccccgcttaagtcaggctgagagcgcatttcagtcgaaaccggcaatttcagccaggagtgtgcaaatctcttcggtccctgggattttattagagccgatttttaggtttcttcacccagattgtttcataccctgtacactccagatcgatctgttcttccttttgttctcttgtcaggaggtgtttcatgcttgggcttctttacttgtttttttgtgtataagaaagtttttgttctgtgagaagccttctgtaaaatcatgtaatacctcctcccttctcctctcttggtggatggatgttcagttcacctgctgtttctatgctggaacaagaactcaattctatatgtattagctcatgaattttcagctgcaagtataaaagcttcctaattttgcaccttgtctgccaacttggttgatcatccttacaaccgaacaccttttcttcagaatctttgtagatggccaagatgtcaaataatcgaagcccaatttaagaagtgttaaattatcaaatctctctcttttgaatcacccttgaattatgcttctgtcaaactatgtaaatttcatatcagttcttctattcaaaccgtctttatgtcttctcatcatcctttcgattgttaattgcaatcggatgtattgtaaaccttgtagctggttacctattatctctatctctactattataaaaattgaagatatttttgctaaaattttagtgcgtcgtctgtgtttgagtcgttttttaagttcatggatcatattttgtatggaatcggacacagacattttgttaaaacggacaagggctttttaaaactgtgagactctaccaacgatggaaaccatgcaaggcaccggtgtgaaacccaatcgtaatcaaactcatggatggacatagcatccacatcagtgatcgatttagaacaagtgaagttcgtaatagtgattataaggatattaaaataaaaatcaatgtaaaactgagcacatggttaactaaaatttgcaatctctatttctatctttatcttctttactattataaaaataaattgaaaatgttttcatcgatactacgtcgtccgtattttgagtcggtttttaagtttatttttttaaatacataaagagtcgtataagaaatcattttaatatgctaacttgatatgtgagtcggactcctaattgcttgagaattcttgccacgttataagaaagtaagatacatgatatggccatcatcccaataaggatttcaaattaaatatcaatactatcaaaataaaaaaacacatactttttagacaaaacaatctaacaataatacgattaaaataacctttcaccc

SEQ ID NO: 5482 - DNA, 3020 bp, Oryza sativa
agcgcagggtggggggggggggggagttcaggagaaatcggtgttggcggtggccggatcggtgggcttttgggcggcgttctagggtttcgtagttgtagccttctaggccgcttatgttttgttttgggacgcaggtatccgcggttttagttagattctgctaattggttgaggtaatttggtgtaagattactgcttgcgatgagagtttcatgaagctttagctaggagttagtgtttggatctgttcgtccaactattttggaatttttctgtgcctgattggtggggagataataatgtgcatggtgttattttttttctgcaggaggcaagagagattggacttcctctacgagtcagggttggctgttggcaaggggagctccgagggattccaagcgctgcaaccatctgccccagcagctgctgccgccgcctcttcttctgcccaagcgagtgccggctcttccaaggtatcgcgaccgtttcttctcggccatgtgattgtacttatgttagtttgcagttctaaaatattttttttggttgtgcatctaattccactgatattatcaaagaaattcgtatagtaggaagatacttggttgatgtgacagggcaaaggtttttcttagtaggaagatacttggttgattcttagtaggatgcgatgcttggttgattcttagtaggatgcgatgctcaaatgtttagctgattgttacaattcttccattatagcaaatgggctgaggttgctagattatgtgctgctgttgtaaacttgtaatatgatttctcatctttgaacttgcagaaaaacgataaaatatttgccttcttacttgtatgcaaaagcaaagtgcctcctactgtctagttgtggatcattgaataagttggaaactgttgtttgtggtatggatataagaagttaattaatctttccttgcttccatggcattttacatttttatgttgtcttttgaattgttttgtgttttagacttttagtcaagggagtataaaagtgtaaaatatcagttatttcatgcgcactatatcacccattggttgtaataaaatatctattcatcactagctattagaagataattgcttattttcttttgtttggaataatttcaggcagctgctccaggtgcattatttgaggataagccccaatctgcaaatgatgcatggagaaaactccacactgatcctcttctactaataaggcagcgggagcaggatgccattgcaagaataaaaaataatccaatcaagatggctgagataaagaaatcagtaagctatatccttcttttgatatggaattataccttctgagcatcttaactactgtcaaactcttgtaatgtcaaacatattggaaggtttataatcaatcttcccctgaacatattccctgacataacttcgtcttgtgtaggtggaagctgagaaaaagcaaaaggaagaaaagaaagagaagagaaagcacaagaagcgccatcatcacaaatcaaagagtaagaggcatcactcaagtgagaactcagattcagaggaaagtgatggcagggatgagagaagaaagagtgttcaggcctcagagcataagagagaagagaaaaggtcaagacatgataagaaggatcacggacaagattcagaagacgatgaacgaaggaaaagacggcatgcaacgtcagaagatgatgagccaaggaagtcacagaaggagaagaaaggacagagggaagattcagaagatgacaagccaaagaagtcaaggaaagaccgcagaagacatgattcagaagatgaagaaccaaggagaaaacaccagaggtcagaagatgatgaaccaaaaagaagacaatctgaggtttccggagatgatgaaccaaggagaagaaggcaggagatgccaaagcatgacgaatattcacgacggggtcgttcggatgctgatgataggagagggagacactatactccgtcagatgataggagagggagacactatactccgtcagaccacaacagtgcttatccaaagcacgacagttcagattcaaggcataggcgaccggaatatggacgcggcaattccacttctgaactaggttcagaaggccaacgaaggcaggaaagccagcagggcaggaacggccctacattcaaccgtcgacggggtgtccagcacatgtcagaggaagaaagggaagctcgacttcgtcaaatgcaggctgacgcagaggtccacgaagaacaaagatggagcaggctcaagaaagctgcagacgacgatgccaaggaggcggcatctgtgaacgcaaaccaattcagagggaagaacttcttggaagaagaaaagaagagcatatttggaaccgagaagggcggaagcgccacgatcgaagagagcatccggcgccgtgcgtattattcgcagcgtaatgcccatgagagcaatgcattcaggcggtgaaatccctgaagcagagcagcagctcaggcggcctgacctcgttgatgtcagtgttctgcatttgctttagcttcttttgcctttctggtgtattgttccttgtttagtatggaagaatttttgaatgttgtacaacgcattgtccagatgttttgaatccatatgttttagtaacaatttttgccaaaatgaaaatcctacatgtgtattatagagggtttgctaacacaaaggtatgatttataagggctttgtacgctacttgggcctatttattaggggtaggactaggcctgtgggctgtttagctaactaatgggccggacttgctgtgccttcttgtcagccccacttcctcctccgccttttcttcttctagtcattgtaccgtgcctttgtcactaggtccggagacatcagatccatatgtcagtgacaaaagcactgatccagcggctgtgggagattgggagggccagcggtgtggctataggggggggggggggggggaaaa

SEQ ID NO: 5483 - DNA, 4630 bp, Oryza sativa
aagatggggatgtatatcacgcggcgatcgccgagttcgtggcagcggtggcgctgctgtttctgtaggagacggtggccacggtgatcggatcgggcacaagagccaggacgctagcatcgatggcgaggaatgcgacggcatcagcctcctcgcgtcgcctgggccttcacctcggtagcatcatccgagaccaccacccgacatcagcagcaacactcgcttcactccctgcgtctccagccgcatccgcatgatattgtaaccgaaacaagagagtatctccttttttccaataagagttagataaatattaagatttatgtggtacgcttttcaaattattaaacggtacgtttcgtccgaaaactttttatataaaagttgctctaaaatatcatattaatatattttttaaatttataataattaaaactcaatcaatcatacgttaatatcacctcatttttttaatcttcatcttcatgaaaaaaaaaaacaccacgtaagagaccacacaacaccaccaaccaggccgcctcttcccgcccgggaacggcgccgcggaccgggagacgaggaggggcatcggcggcgtcgccggcccatgcttcgacgtcgtgatggattacgtcgacggacgggccgagccttgcgcgtgtcgtgtgggaggagctggcgcggggaggccgttcccggaggccaagactgatgtggcaactcctcgatggcgatgcacgtggcgggggtcatcatctttgatccggtctgcaacttctatatctacccattaactatttaatgacattgtaatacaacgctgaaattccatcaccgttttcattcccgtaataatccacatcaagaaaaaacaatccgcaatacgtataatttttttttaaaaaaaactgagagtaatacccgcagacatgctgaaacagtgaaacctgctaccactttattttctgtagaaaattacaagaacgtgttgcctccttttgacatattcgttcgatattcttttattctttccctctctgtgtacagaattacatgtgacaactgccttctgctttgcgtttcccacacctacggaagaatgggtgcccatcttgaattttatatacatgtcgcgccttgttaaaatgaacaattcgtatacacgaaccgaaaaccacaacacaacggccactgccattttgcactttcatcattccaaaatgtgcagcccccatttcgctagttctctacttccttgtaccctttatcatgggggcgggcctgaggagcaagtgcaatgcctagaatgtttggactcacaggggaaactctttctgaagaacgtcaaggttgcgtgaatcacatgcagcgatcatgtcagctcgtgaagcgttactggtttttaaaagagaaaaatgttagtcaattaaatcagcgttgaatttaggtagacaaagaaatgatttaacgtgcttggaaagttctagatgtactcaaattggaatatcaactggttgcaatgtttcttgagtacttgcaagttatgagtacttaaaagtgagcgacaattgatgttcttttgaaataaatgtatctctagtatcctccaaggaacttcaaatatctcatagataattaacaagacatacctaagagaaatccgcaagtactgccaggcattgtcagcttttggattcatagcaaccgcccgtacatagtatcgaatagagtcttcatacaatccctgcataacacggaaagctggggtattacatctctgttgccactttgaataaaagatatttgagctaggccgtggcatcattggatatataatatatatttgtactcatcctttattatgctctgtaaatcaacagttaacattaatattaccgaggctttgaatggatggtagtatttaggtggatatccaatgcacaaaaacttgaagatcttttcagaatcgagtggaaaccatgatagccaacatcttattatgaaaagcaaacaagtggaagcatacaagctcactcataaaaatgatggtttgcaagttagttgagtaaatgaataatgctgacagacaatgataaacaacattgagatatggttttgtacttgcatgcaaggaaattgttgaaactgcaattattttgttaaaaatacaattaccgaactaatggtgttatcaagtggtagcatcatgttagagaagaattacctggttggcatagctaatccccatattagcccatgcacgcacataattgggctttaagtccagagcctgaaaccagcagcaattgattatattagttccagatttacataccataaagtgctaggatacttgtattacacaattttctctaaattggagattcatcaacaagttctacacttgcaggactgcagtagaccaagccgtaaaaggatagttgtaccagcaaaataagtgaaggttcctccctaatggtattacaacactaatgctaggtgaagatgtgtctgtactcagcaggattggacaccaaaccaatggtattacaacattaatgctacctaagcaaacagtttgattagaattgattggttttcctgtaatgctagaagtacagggatgcggcacatagcttgaactgaatgcactcttactatgaattatactgaaattgggtacccatagaggaatggacagcccgccagagggtaaaggtcatattttttttccaaataaaaatccaaaaggtccagatacacatcatatatggattattgccagccacgaattatatcctgttagatttgcagttcacacacaagtgaatgcaactgccataaacatcgtccgaaaggaataaccagagcccaatgaaagagtggatgaagtagctattctacacagcatgatcgagacaaagcactgtacttcttcaaccagactagttcccatgagttacaatgggattggaaggaatacagacttttcagttttttctatctggtttttctggtggataatgtaagtggggttttttaaggcagggtgtttcttttttatgtgggatgtacaatggtgggataggaggacggctctgcttttacagtagtagagatatgtaaatacgctatagcacttatagcgaaacattcaccaaagctgaaaaataaaatatcttacaataactaattacctgttgataggccaatattgcatcagcactctggatgctgtttgcttgggtcgcacctagcttattccagagagaatagtcttgtggtttcagctgcagcgctgtcttgaaagcagctatagctttatcatattctcttgataggttgtacaagactcctagaactatatggacatcagcatcctcaggtgacatttgggcagcctcattaaacaatctaataacctgatcagaggtaaactgcttagtgacaaaacgaaatgacttttttagaaatatcagaaaacatatcatacatgacaaacagtatggggtgacaggaaaaaaaaacttgaagaaaaataaaaggaccgcagaccaacagaactctagagcatacatctagaacatctgtgcaggataccatttggaaggtgaagatgccattattatttatttacattatggaacagatgggatgcacttacatcaggaccataaggtgaatcagttggctgtggaggggcgatacccccatatttggggtgattctgaagccacctatgaagatatcttaatgcttctccctgctccaactttgcatcaattatatagaaccctcaaatgtatacaaaaagcatcaaggcatagaacctgttagaactaaattttagaatattaagttaatgctagaaggaaatagacctttgccccctcaaagataaattagctttatctagttgtttaaaacttaaaagcttgtatcaatgaggaaacctcgttacttctaaccataatttatgccgcttcatttctttcaggagcatcttagtagattatgccggacactgaattaccatgcactcaccattcgtgtgactgacaccaagtgcaagaagaacttccaggtttgttggatcagcttcttgtgcacgcatcattgctgcgattgcctgaaagcaaagtaatagcatctccttgtgttaaacataagcatggaactcatagatcataatgccatatcacatggtgcttaaaatttagctaaaaataaaccataatttcatgacagacaatagtatgggttcgtccgttcaaattccatatatatcagtttatgaagttcttgcaagggtatgcaaaaacttgatagagcataattcacgtaatttctattgagatccagcacactgcatgctcctaccgaaaaaagattcataaaaaaaatattctaataaaacatgtgatgaaaacaagtgatgcacacaagcatgcagtgcacctgtgctgaaaaactaataatgaaaagttgaaaataatcagcacatggtaatttacatctacatatatcctcagtgggagagacacaatcacctgttggtcatcatcattttcagcatgtgttactccaagtagtctccaaccttcagcattatcaggatttttcaaaactt

SEQ ID NO: 5484 - DNA, 34725 bp, Oryza sativa
aaacaaactggaagaatttagagttcttccaaaaaagaaacaaaaggtatcatcaggtgcttgagagttgagacaggctgatccaaatgaccctatagcataacaaagttgctagcagtatagccagctgagatgaggttcagaatcaactaaagttggtattaaaccacagatgtgcagaactgcagaatggcacaacatatcaatgtggtgtcctaggacgcattagcaaataatatagcaacaatgcccactacaccatctcatctcagcacgtctagtagagtctcccctttcactcttattttatgctgacagaaatagcattgagaaaaggaaaaaactttgtcaaacagaaacctcttccattgagtgttctatattgagtggtattctacagacctgcatgcacacaagtttttaaactaatgagtcttcacaacctatcggggttaacaaatgacgagttgtttgtaaaaagtaaaatgccagaagcttcctaaagtacactggatgacatagaaaaagttatttcaagtgagatgtgcataaaataagatatcaatggacccaattcattagcaaagtggtatatcaatatattcacactattaaacctgttatgtgcaattccacaatcgtggggcacataaattggttggaattcgtagtaataaaataagtagcgtggaaactctagattatatgtcaatttatggtgatttaggtaacaagatcagtaaacttaatcctaatggattcatatcgatattgagcccaacaagacacatttaggtttatcctagtaaagtttacattggtcaccccaaccaagttgcaactacatacaactgtagataagatcataagcagaaaatatcaaagggaagttatacccttcactgttgaaaataattaggatgagttgttgctcaagcagatttttttctcaccagctaaaatatttaaaatttacccattcaaaatgaaagtatacagacctaatagagttaaataaacaaatcaaatcatcatacatacctgaaattttgggtcattattactagctaatgtctgtgcaagcatacgagattgttccatggctgccaggtttgccatattcattcctcctgtcatggccatctgagattgatgctgcaacaagacaaaaatagataacttaaatcacaaatcctagaaggcttatcacaaaattatatagctttgttttacacccattgtaaatatgctgcacatgctagggaaaggatgatatctaaacatgataacggacatagcttatcacaaaattatataactttgttttacacccattgtaaatataaaataaaattagacaattagttaatatccatgaagttaaccaaatggtacatgtgaaaatatcaaatagcccatgcataaggctctgacctgttcaaactcagaggcccaaccattggaaccatattgctgctcaaaagaatgagcccactcttcagggttattattttgcttgccaaactcagttatccatttgtctgcagcattgtgcattggaccagatctcatggcgctttgggactgattccaatactcctccatctctgggtatggtccgtgcatgggtcctttcattcgataattactgtcgatatcaagtgaatgcagcaatgtgtttacctggtacaggtgagaagtgtcaaattaggtcacagcagagaagataaaaacgaagccactgcaacaatctaatgaaatgaaacacaaatgcaagtgctttagcatattcactgaggtaacaaaaattataagttaacctgtgcttggatatattcttcaggctggtcagccaaaatgtggcgtgccataatgcaactacgatcacgtatacattgcttgtcactttcagacaaaccaagcgctggtactggaacaggttgaaatggcacaccagcttgaccacttgctaggaaagaacgtaggacaccagataagaccctttgtggtggacctgaaccaattttgggagtcagtataatgtgcttcagtatgttatcaagtgatgaatatataaacaacaataaaataaattggaaagaacaaaaactacaaatctaccatccatgactggtggtccaaaggttggccctgtgctgttaaaaatttgctcaaattctttaagctgtgcatctggcacagcaaattctgggagtcctggaggccgaaaagattcaacccaatcatgagaaggacccccacggatgaaatcagcgccctagaggtgttcaattatagttagaaatgctcaaaagggcaccaaaagcagcaaaccgaatgaccattacccgtgcaagtggcagttgatcttgcttgaactcattctctgaaccagggatggtcgataagggagcagctgtccctaattcagatgttgttggaacattaactgcagaccctggaagttcctttattgactgcacaaagaaaagggcacatacaaagttagcttgattattaatgcaatctggatgttaatcaccccaactttctactttattacattagaacagcgtaatcccaaatttccgcttcattgtattatagacccataagcattattgtctggaggatttaacttttaactttttaaggtacaccacttatatttggaacatccatttgcaattatatagtggctagaattgaaaatgacctattactacctaagaggtaaattagtcacctatggttattactaccttggagtaggtaagtttgctcctcaacatacatctaagaaaaggaatcagtatgaaatttcttgtggtgttttaagatgtatttttctgtcgatgatgacaatcttttagttcaaatgaaagaataaaacaaatctgtctttcacactttagcatgaaatctcttgtgatgttttaagatgcatttttctgctaatgatgacaattttttagttcgaatgaaagaataaaacaaatgtatctttcctacttccttggaagttgaattggaatcatccagaaacagtctaatttcttgtgatgttttaaccataaaaagcgttgaaaatattgtacaatattcatggacaatctccattgcatatatttgcaatccggctgataatggaataaatacatatatcagttgtgtctagggtgtcaatgtgtaatgcaaatgttggcttaagggaagtgattaatcacatttagagcgttgcaagtgcatcccttttgttccatgaagggctaactgtttccagttggttagtagtatttatgccaaaattgaccttcagagatgaatggccatgattaccatatggttcttacagctacaggaatcataggtgcaccataaaagagctcttattaagacttgtaaaagaggtaaagataaactaggggttgacgcgggccaaccatgcacaatccttgtcccacactagtttaactaaatggactaagtttcactatttagagacacctcatgatctacttacatggatcatggaaagcactgaattgtaccaacactttaggaacaggcatgtacttttcagctacttcaccagaattgctcaggcaacttcagttccaatctaggccaaaaccccacagaatcataggtaggcgacatgacgaaacacagataaataaactagccaaaaatcagggaaatctatactaccactcgctgtcgtgaattatgataggccatctgtcacccaccaattcacttactgcacaattttatcagatgaagcagcatgatcaccaacctaaacatcacaggatcgaactaagtagtaactaaatacatccagaccaaaccaacagtacacaaacatacatcgaattacttccgttttaacttttaagaccagtcaaacgaaattgcgtcgtttccaccaaacaatcacatcgcggaggagaggaaaggggagcgacctaaacggcgccggaattgatccatccccaaccatcaaccagccacagccaagcctccgaaccgcgagcaaaaggccagtagtagtagagagcaagtgactagggctagggctaagctttacctgcgccttggacgactggccgaagatggcgttggcgaggttcccgaaggggttggacgacgacgccccgtccggcgcgcagttgccctgcccggtgatgaggtgccgcatcgccatctccgccgccgccgccggcgagaggcgttccggtcgaggtcgaggtcgaggagagagagaggagtcgtgcagcgtcgcggtggctttgtgggaggggagtagtagcggtaagcagttggaccccgataagaccaggacacgtgaaagatcgtgctactccatatacgtatggctggtttggttggttgagaataccttttctttttccttcaaataattttaattttaatttaattttatctttgtttgtttttttctcgcggtgaaaacttttgttttttaaatttagtttctatacgatgcgagaagggtggagacaatcgattagttttaaattcgtttcgttaagttccacgaaattgtgaccgaattttctgagagtctcctaccactgaataggagactttgtactgtgtctcacagaaataaattttgtccggttaagttccacgaacttcccgtagaatatcagagattcgatattgggtgatctttttatattgtagattgtaaatttgtcctcatgaattttgacattttgtttattctatttgatcactcatcttattcaaaacatttttacaaatataaaaaacgaaaaaatatgcttaaaatacattgaataataaagtaagtcaaaaataaaataaataaataataataattattttttaaaataagacgaatagttaaatagtaagatatgggtacgaaatttccgagggagtgagcggaatacactgtaccagcacaaggatttcctctaagcccatgggggcccaagtaagcccaattggcccaacacgagacgcatacgtacaactaatccggagaaggatacctaggcacaacccaataccctcccctatctctctcgcctcaccaccagcgtcgtcgtctgcgacgtccgaaccctcgccgtcggcgctaggctcgcgactccgacgatgtcggcgccatccgaccccgccgtggccacccacccgcaggggggggggggggccgccccgcccgcggcggcgtcctccagcagcggcctcaccttcaagctccaccccctcgtcatcgtgaacgtctccgaccaccacacccgcgtgaaggcccaggcggcgtgctccggcgacggggcctcgtctgcggcggcgggggggcagccgccgagggtgttcgggtgcgtgatcggggtgcagcgcgggcggacggtggagatcttcaacagcttcgagctcgtcctcgaccctgtctccgggaccctcgaccgcgccttcctcgagaaaaagcaggagctctgtgagtgaaattccggcgaatcttctgcgctttttgttagggtttcggcgaaatctagtggtacgagggtttgattcgtgattgcggttgtggccgtgcagataagaaggttttccccgacttctatgtgctgggttggtactccactggaagcgatgtgcgggacactgatatgcaaatccacaaggctgtaagttcttgttctgttcttagggcaagctagcagaaagaagtaatctatctggtcagcaagtgcccaacctgtctcattatgacaatgtgcttggttgtttgctctttttacagaaatagaatatgggggcttggtgtaatgttgtttagttggcatggttggcagtgctagcatctaatatctgtggggtttctggttgaattctgaaagggatggtagaagaggacatggttttcctagttttgtggctacaccaaattatattgttatgaacatatactgtttattgttatgttatagcatcatattgggtggtggagcagatggtaggcgcataccgtgctatttatggaccaaagaatgttactatgtattcaaatattcaaattgtgcgatgcaattattctggccatataaattgatgctacaattttctaaaatatctgctgtagtcatgtgtcatgtattccaaaatgttttatgccttctttcattgccaatttgccagcagtagcagatagtagtgcttatgttgacattgcgtacatatattctctatgttgtgtttttactcaagtttctgttagcaaatgaaataggcatgactgttaactcttttataacctcattgcttataaacatatatattcttttgagatctgctctgtacattgtttttgttcctctttgtgttacttacttcttttttttattatccagctgatggacattaacgaaagtcccgtttatcttcttttgaatcctgcaatcaacctctcccagaaggatctccctgtaacaatttatgagagtggtaagtgaatctgacttcagcttgtatcattataaaatatattgcaattgatttcacagtttttatatggtttgggtttttgttttacttttaggtgtacgtcaattatgcatgtacctgagatgtactccaccttttacatattgcccactactcctagaagtcttttttcccccaaatgccaccttttagcatcacgtatatagcatgtgtgaccccttgatttctcagataattgactcaaaccagttcggtgttctttcatggtgctactgttattttattgttccatttctccgtctgtttattattctaatttcctctttaccattttctgttatttctttttttttgacatgattttctgtaatttcaagagttgcatgttatcgatgggagtccgcagctcatctttgtcagagctaattatacaattgaggttagtttttttcttgtgtgtgttgctttttccataaataatttttgttaagacttaacgttagtacgtttgatttaaagactgtagaggcagagaggatatctgttgatcatgttgcccatctcaaaccatctgatggtggctctgcggcgactcaatgtgagggttcttcttatcatcagtttatgtcttacagatattgagttgtactacccaatatattgtttttggaaaaatgatactgacagatatatttgagcagtggctgctcatctgacaggaatacacagtgccatcaagatgctcaatagcagggtccgtgttatccatcaatatcttgtttccatgcagaaaggtattttttgttgctgttgagccctcaaaatatgtctgctattcgatgtgcttgaaatatagttcaaaatatgtttgccacctgttacttcaaataggtatcaactgtaaatccctttaccatcactgcaggtgatatgccactggacaattcgctgcttaggcaagtctcaagcctagtaagaaggctaccagcaatggagtcagaaaaattccaagatgacttcctaatggtctgctaacttgataatattctctttatttttgtttatcaaccgttgtccttcatgcagtgatgatcttctctgaattttcaggaatacaatgacaccctcctcatgacttaccttgctatgttcactaactgttcaaggtatgcccccacttattatgcaaactacaaagccttttgatatgaaagaatgtcacaacatcaacaagataagattaaaaaaatactttatagggaactcaaatcagcttgtgatttgtacacttcaatgtattatcagcaaatttaatagattcactaatgttagtaaatccgtacttgcaaatgaagttatctgccaagagatgaagagaagttgaatcataatggttgtttactcgtttggcattgcacccatgtcagtgtattaatactcttgtaacttgcagcacaatgaatgagctggtcgagaagtttaacgcgacatacgagaggtcgactgccaggagaggaggccgaggtgctttcatgtagattttcccccttctgcatctgcagctggttctctgctgagattttggaaatagttacccatatggccaggaagtttttgcgtataatctgttaggaactatatctggcagccatcaagtttcttccaaactcatgctccctcgttcaggattgacacggcaaacatgttgatattcttgattctgtgcctagatcgttgtttattcctcattcgccaagattgacatgtaaagtttatccccatcacccccatggtagttacactatttgactccctaaatggatatggatgcaggtttcctgagttatgcttgtaaatttctttaggttaactgtatgtatggctgttggtgttcacgcagcttgaggtgatgtgatgcgttatgtatggctgttggtgtcaacgtagctcgagctgatttgatgcgtgattgactgatggtcatggcaaaattaaacgggactgtctatacatcatttaatagaaaacccccataaaaatcttgcaaattgcagaccacccgattactttaagatccgtgcaaagaaacacaaccctaaaaacctcctcatcctcctttctccctataccgtgctgccgctccctagcgtgatccgcgcctttgttgccgccgctcggcctcgctagttggacagaaggcgtcaacggcgccggcgagcaccccccccattcgtccagcctcttccccctcccctccctcctcaagccaccggcggcgagatgcccctgccgccaatgccggccccccgccattgtccatcaccatggcttcggttccggcgcctagacgaccgctcgttccaccacctcccatacccatcccttaagcccggcagccaccctcttcttcgtactcccacccccaccccaccccaccccgggaccttaattagtcggtcctctgctggagtttaggttgtcgctggcgccggagaagaagaggagatcaccggagttggaaaagaaacctagagcacgaatcgcgaagcacatccaatgatacaaaatttgcaagatttgtgtatgcgttttctgtcaacagaagcttaacaattccgtttacggtggcaatgacctttcatgtttcaagctaatgtagatcatgaagctgagcccgaaaaaaattccaagctactagaaaacaaagacgatgaaaaccaataaatttccaataagaattcattactttattacaggacacaagcagccgaccaatcctaagaacagctccttgtttacaatctacaagtgcaaagaaaaccaaccaatcctaagagctgttccttgtttacaatctacaagtgcagagcaaaccaacaaatcctaaagaacagccccttctaacctacaaacgcaagagatgttccacagttatgttacagaacggatgaaggaattacagaatcaaacccgaacgacaatcttcggtttattgccttcgaatgtcaggatggcactgattcctgcagcccatctcgcaggcgttgccacagactgttaatccaggctttcgctccaggagctccgcgacagttggactgcagccacggcgttccaacatgttcttcccaacaccaagccacctcaggcccctaaaaaatggcggctcaaatagtcccaggaaattacgtgacagcctagaacaataggagagatccagcattcttagggaacttttacccaaattgtgacgcatagaacctagagtttcaagagaagaatcattgatgaggaggcagttccggaggcagaggctgctgatctgctcgcagttcttggcaatcaacgtgacagctctgcctgatattctaggtacattcccgatatccagtgagattagagttttgttgatggtgccactcccgcacaacaaagaagctatgccattgttgctgatccttttgcaacctctcaaacataatgaagacattgggcaccgcccattaccgagtgcagataatcctgcatcggtaatgtcagctccagcaagatccaatagtgttagcttcgaaagctgcgaaatagaagccaacccagagtctgcgatgctcctgcaacctgataggtctagaacttccaacttggtgcaggatgagagtgagatggctgtttcactggttaatagactacagcacagcaacctcacttccgtaatctttggagctgcctcatcaagatcaagacatgtcaaatctgacaagtatccagtactgacctcaaatttcttcaggtccttgcaagactgaagaagggctgcatacccagcatccctcactttagaaaacccagcaagtctaatggttttcagttgcttgcatccgtcagcaagcatcattatcccaaagtcagttacccttctgaaggtggacgaacaattctgcttaccacgtgtcagagataaatgtgccaggttgtggcataacccaagtgcttggagcccaacgtttgtcaggtcattgtgcaaatctggttctttcattgggttatcttctaggcacaactcaactaagttatggagactcccagtgatgaacgcaacaagttcatcagttattatgtcaagaactaaagagagtgattctagagtgttgctaatagatgtcttcagacttgtgcttataggaaatagcctctttgcctgccaattcgacacaggctgtagcaatagtaccttgatggtactaggaatgggtaccaatgactcaaaatcaacggagcctggacctagcagaggaaagaacttgagtgaaagattctgcatggagagaaaagaacgtcagattagattatccgaccagattaacttttcaaagagttccatgtcattgttaaaataatatggctaatattatgttatctatactttagtattcacacattctcagcctaaaatattatttacaaaatactatattgctatgaactgaccatatatgtacgcgaagaacagtattggggttcatctgcaacaaagattcctcacctccaggtaaccgcatcctttgacgatgtgtgctatggactttcggcagatcccgaaatgttcatcatcatctgaagctgccatctccagcacaaatgatctggatataaagagaagaattcaacatgcttcaatcgacatcatttgggccaatatacaacctatggaatgtacaaatcaatttcccctaatgtttgtcacacaaaaacaaagtttaaaaatcaatttcccctaatgtttgtcacacaaaaacaaggataaaccgagcagtgtgcacaatatcatgcaacaaattcatcaattcgattcccctgatagaatacaatttcgtgggcaatcgtgcacacagaaacaaagccaacgctgaaggaagaaaccacacctcaaatttttgcatctctcaccaactgccacaaagaggtacgaggagaaggacgagcacttgagcagcgagagctcgcggaggcttcccttcgcgatggcgcccaccgcggagtcatcgaggaggctgcagttgacggcgaggcagcggagcgcgccattgcccgcgagaatcctattcaggatggcattcgtcggcgggaacatctgccaacaccaacaccaagcgcgtttagggggggaaatcgatttggggcgcgggggggaaaggggaagcgagaggagaggatggggggagggattgagagatgagccccctcaccgataggtcgagggaggtgacggcggaaaaggcggcggcggcggcggcgcggagggcgcggcaggacgacgcggccgagcacgcggcctccagctccagcctgacgaccacctccacgaggagcgcctccgggaggctctccaccaggccgcgcgcggcgctgccggaggcctcgccgccgtccccctcgccgtcgccggcgacgacgagccggcgtctcttctccattgctgctccccgtttgcttccgggccaggggagactggagaagcgtatagatgtgaacacgggccccgggatataccaccagacatctggggcccacgagagggttggtgtatgacatgtgggcccgcccaaatgagaacttttcttcttcttcatttgggtcgtttatgacaaacgattttattcacaaattgtcgcatgagttgagttaatcatgtactccataaattgtcgcatgagttgagttaattatctactccatttgtttagaaatatagtagtttgtgtcattcaagttttatttttttaagaataatgctactcgtgcgtgtcaacaaattaaaccatcctcatttggtttctccgtccacatccttatgttaaccaatcataattacctctctttttaatttctttaaattctccaattaaaaaactctagaagcgattatattttatgagagggagtaaatgattcaaaacatgttgagaatatgtatgccatttttttttcttagaaatatacttgagctaaattcttttacaacaattcttagaagataaaatcccatccatagcaaaaaaaaaaaatccctctaatatgacatttgacatttgtttagtctacagatgcatctttgaccatattttaaaataagtttatgatattgagtaaattttgagataaatttacgcataccactttcacgttcttaaactaaatatttaaaaattcatagatattcaaattttaaaaattcatattgtctaaaatatcgtatatttatatcctataagggagtaaatatgaacgttgagtagcattgccaagagtacaacaaaatgtaaatgatccaacattcaacaaaggccaaagttaatacaaggaaaaactggagcactgagctacatttattagtataattaatgaatgtaaacaaagaacaaaagactgaaagttataatgtacatttacttgtgtagtgaaatgaacttgaaaaaggtgtagtcaaatgaacatactagtaatacacaagtatcactgggttaactaatggctatactactagtcaatggtagattcctaggcttggacaaagctttcttcagtcaatgttatttcaatattacgtttttttctctctcgggcatgttcaatctcaggcctcaaaaccaaacaaacaatgtcaggcattcctggttaggaaaaatgcatcgagatttcaggggatcttcaggcaccagtcttcctcaggcaccaaccaaacacacccctggtccatctgaaaatctgagaacaaatttgctttgtagtgattgatccatatgctaggctatgcttgtacatgctacaaaacgttgaggtacaaaatgtttatctgccaccaatccgagaaaaatttacttcccggagattgatctatacgttttttttttcccttcagtgctccaagccaacagaacaaatggaactgtcaacaaaatgcctgcctgtagacaaggggaaatgataagtgattaagtttgtaatcctagagaaaaagttgcaatgctgcacaatgacaatatgagcgatggtgaattgatgattaagaataagcaaagggaaccattgattcaattattcgatttgtccacgaagttctaaaaaataaacaacaaagatatccacgtgaatgagcaatagctggagaagctttccaacattattttgattgataattattcgattgcttggtttgaagaataacagaagagatgggcaatagatgaaaagatgataatatttgccaagacttcagtaactggattactgaatatctcaatttgacctggttatcagtaatacgattctgtcttaccttgtgtcatcaattgattctgagaacaatgctgcttgaataaccacaagtccaaaatttcattccccatagtttccgctgtcctgtattcccaacattatttcctcactgttctcccattcagtcaggcataaaatgagtgccaaccaagtgttaactgcaaacaagagcaccattatgaaagggaccactagtatcgatcacattgaactcaaagaatctgtgaaagggacatagttatcgaaattgccatatctaaccttccagcaaccatgtatctcaaagtttgtttgtagatgatgaatcatttggaatttcgaaaggtacacttggcttatgttttaagatcatttatgttcaaattgtgtaagtcagtacttttatctcaattgaatagcttcaacaattcatttacattacataatccaacttaatacagaactatgtcctgagattactcgtgggaagctttgtaaagcaatcaaaataaaacaaaagcagcagttatagaacttaaaagccatggaaattatcaacaggtgtcaggggcacagaactttcccttaaaaaggcataatctgagttcatacaactaatgtaactcctatcgcttgtcaaaaataactcataggatttcactactccagttttttatgcctactcatcaatatcaaaataatcatcaatctggagtgagaagcacttctacagaaagtaacaactaaagaatatgtttcccgtgaaataaataaagtattatatgaattcttgcctaagcttttttgaagatgaccgtatagcttgaaattctacacatgatatttctttattctagcaatattaatcacaagaatttctagaacttttccgtgttagaaggttttgaagtaaaacaaattctccttaagagcctacctgattcttgattttttttttctattagatattaatgttcttatcttagttagatgaactactgttaaacagctgaacattgctatctaagcattgcaatttggctgcaaaaataaaatgaatgaatgaatgccaacaacagccttacaattacatgtggtggacatacagcaaaaaattccatccagcagtcaaatactcaaattatcttctggtgttcccaagagacaatatgtcctggaaggatttcacttcatcatttgaataggaaggttttcttcctattaccaatttcattatctctcttgcattcctgtcctttgaaattgatatgaggccttttagcagttggttaatagtatcaacacttggaaaccagtttttctccatgctgtctttgcacagcctgaatgccatatcaaactcccttctctcacagaggtaatgcaccattgtctggtaaaccttagcatttggcttgcatcccctcccatgcatcgcaccaaatactgtcttagccatctcatgctcgcccatcatgaagaaacccttaataactagattatacgtgatctcatctggccttaagcctgatgcatacattttcctcaccaaatcattcgcttgccagccccttctcctgttaaccaagaactggattctcacattgtaactggcaagtgttggcatgcaacctctcaacctcatgagattccacagaccatccccgacctcacgctggccacacttatagaatgcatccatgagtgttgtgtatgtgatgacatccggtctcacccccgccttctccatttcctgcataacccgaaatgccgctcgaagttcccccaagtcacacatcattttcaccactgtattgtacgaaatgtcatccaactcaaccccatatgtctctgaactctcgaacaactgaaggacctcatcaaacagccgcgctcgcagtagcaccttcatcgtggcattgagtgacttggccgtgcgcgggcatccatacaatcccatctcgcgaaaagtgctcagcgcgtggtccggcatccttgccttgccgtacagacctatgatcctgaccacgaacccttcccgcctcccctgaggcaacgccttgtgctgctcgagtatctcctccactaggtcattccgtcgagcacctgccaggcgcgccaccgcgtcctcgaacgcgaaccggttctcaatcaagaggcggttgtgcgcgttggccctgaacagctcgtacagccgcaccgggtccctctcgttcttgatcctgaccagaacggggggctcggcaggctcgacgccggcggactccttggtggtggaggggtggcggcgccgccacttggagctggcgacggcggcgcggcaggaggcgatggtggggaagtccggctgggagtagtgcgcgtgcgcggagaacgggtggtgcgaggtccgggagagccccgccgcgatgacggtgagcgcgatggcgtcgaacgcggcgcagagcttgcggatggcgccgagggagagcatctgatccgccccgatcccgaggccgccgcccgcgccggagtggtagcgtcctcggcgtgagctaggtctctcgggggtgggctcagcacggcggcgtggaggcggcggcggcggcggcggccatgggcgcgggatgcgtaggtgaggaggagagggaggagagagttccacggctgcgtgcgtgcgtggaggcgcaacccaccgcgaagtgtcatgaactagcgggccttcttcgtctacggcccatcaaggcccaagttgatcgctgtgcttagttattttgggcgctttgcccaacttgcaatttatgtatcgctggtggtcaaattagttgttagggcatcgatgcaaattggtattttctagcagattgcggttactacactatagccatcatttaagggttttttctatgtaaggcctagatcctaaaaaaattttggccaaaaacgttacattaaatgtttggacacatgtatggggaattaaatgtgggaacaaaacaattacacagtttaaatgtaaattgcgaaacaaatcttttgagcctaattacgtcatgattggacagtgtgatgctacagtaaatatttgttaatgacggattaattaggcttaataaattcgtatcgcagtttacagacggaatctgtaatttgttttgttattagtctacgtttaatacttcaaacgtgtgtccgtatacttttaaaactttacgcccaaagaactaaacacaccctaactcatctctcctgtatttcttgttctttgcacacaatttggcatacagtactatgatagcacctcgattgacatcatgatttgtgaaaaagattgtgatgtattaagtattaaccactcatgtttgttgctgtgaatctcagcatgtgacatcatgacattaatcaaaggcatatgctgagatttgaaaaatgagtaggttgttcttcgctctgcaagtttagtctatatgtttagaagagccattggcattaatcaaaggccagtcaccattattgctttctaggaaaccatcttcgcacctgatcatcgacgccacatccgattatggcaaggaccagatatcctggtccaaagacatgaaaagtaagctcgagaaactggatgagtccagttcacagattgagagcctggttgtctgctgctgaggatggcaaggttgagctcatccctggcctgcaatcttggctttgacagcttcgttatgctgtcgaagctgctgacaagacagcgtgtttgatgagatcgagtaccgatgtaatccctgatgaggtgactaattgagagaaggtttccagtgccatgaggaaagtgttcagtttttttttgggagagtggtgaaagctgatcctgtaatgcagagcctgcaagagcttttttttttgccagtgaaggagttggaggatatcctcaggtggatcctgaaggatgcacttgcacaacatgtattcaataagaaagaactggaagggaagtttcatcaagaattcaagatatggatccatgcctctagtagacttgagacgataagcattgccaaaaaagatggtaaagtcagtgacaggtgtgaattatgacgtcaacacccttgataaagctcacaagagactgatggacattgatgtataaagagatttctgttggtgctggatgatgtttggaatgaagctgatcaggaaagttggagtaaagccattggtccgctaagatgtgcaggccatgggagcaagatgctgataactacccggttgggttcagttgctgatatgattggaaaagttgttgggcagcacataagaatcattttggagggcttataaaaagatgactacttattactattcaaccagcatgcatttgcagatgttacaggcatcgatgagcatggaaggttgctctcaattggtatgaagatatcagagaagcttaatggaataccgcttgccgcgaagacaattggtgcaatgctgaattcttgcttaggtggtaagtattggaccagaatactggaaacaagaactttcgatatagaaaacaacgacgttgacctgattacaaaaggttacagtggcctcatgacaactctgagattgagttacaagcacctacctgaaaacttgcagttttgcggcattttcccattaagttgcagtggcctgaccagacttgaaccaattttttcatgagtgatcacctttcggatcattgaattgtgagaaaggaacacttggtcggcggttcaaaggcggcaaagggtgaatatgagaaccttccggttggaaggcggcaaagtgtaatcacaacaatagcacaagcatacacaagtaagagtatgactctatgatgatgatgagccgttgaggagctgtccaatatcatggattagctgtgccctcaagttgtccacgctgtccatggtaacacctcgggccacaactccaagccaatgcgactctgatcctccagcagcgtggtttcgccaccaaccacagatcacctcagcacatttaatcatgtaaagggcacattcggttccattgttttgcttaggtgtcggagctttagtgcatttcgtctcaggaggtaggtaaggaagcagtgatgccgcaagacggcgtgcagctctcaaattagcatcaccaggactgctgtcatggtgggctaagcatggtctgcctccaaggttgcggtcaaacactaggaggctccagtgtgtaccttcacccaacagatggggatcctgactgttcactggaaaaaaggactagttttcgagaggggagtcctagactctgtagctgggttgacacaacagtagcatctgagtttcctagtagatgtgacattgcaggattcacaagcaacacatcttcgctgtcaattctatctgataacctgttgaaagcatggaccacaactgggtcagtgaaaaactcctgagagcaaagagagcgtaggtcatctatcgtcactcctgccgctgattcactgcttgttgggagagcctggggtgatagattttctgtgttgctgcttatcagagaactgctagcggggagagcctgcagtgtttcatctactgaacagccgccaatctgagaaccaacacttgtgggaagagcttgtggtgcttcattaattgtatcaccgtctatctgagcttgtgctgataaattttggtcaggcagcttaggatgattctccacaagttgattggtacaatcaagatcagtagcatctgaggagtttcctagcagatgtggcattgcaggattcacaagcaagacatattcgctgtcaattctatctgataacctgttcactgggtcagtgataaactcctgagagcaaaaagagtgtagatcatctatcgtcactcctgccgctgattcactgcttgttgggagagcctggagtgatagaccttctgtgttgttgcttatcggagaactgctagtggggagagcctgcggtgcttcatctactgaacagctgacaatctgagaactaatgtttgtgggaagagcttgtggtgattcatttattgtatcactgtctatctgagcttgtgctgataaatttcggtcaggcagcataggatgatgcttcacaagatgattggtacaatcaagatcaaaacgtcttgctttatgcattttcaacccaagctcctcctcgaggtatgaaaccagctcatcatagtatttctcctggtcctgtcatatgtaaatgaaataagttgacagttgaattgataagccaaatactatctgcctaataatatgcaaaggaatcgatacttacatcactcaaactccatcttaagaaaatttctggagcaactggaggacctccaagtttgcctccagatagacccttcttttttgtcaactgttgctgacctctcctgtgcactgcactgcgtggcgtgggctgtggctctcgaggcagtggaatatcctcctccccatcaccgccaagatctacatacaggacaccagctcaggtctcgtggtgggggtggtaatgcagtatgtttgaaaattccctccaaataagcatcgacatgaagataaaatgtgcttttcagaagatcatcaaaagtaagcaattctcttatgccacaatcgtggggattgtatctttgattgctaagagacctcataacctgttggctgattgaactccaattgacgattagcctcttgacccattcaaaaccatcacctaaccgtgaccccgtaccatgctccatggcatggcatatcctttttatgcaccattttgaattttgattccaaaaacattacgaccatcatgcccaatgaaatcttgaacccaattgggactcttctgttgctaggctgataagaggaaagataacgaaaacattttttgaacagttgcagattcagccatgtattttctgtcccatgtggggatatttccttatgatttccattgaacggaagcttatgacattggacgaattcatataactcccaagattatcatcagaccgcatctcataaatgcctctgttgttgaagaacccaacaagccagccagttctagcatcaatcactagtacaacgtattctgcttcatacctaaggacataatagaatgtcccgtggactggtgttgtatatagcatcattcggctatatgttaccctgaaagcagaattccacaggagccagaatctgtagtgcccctggcaatgtatgaagttctcaacaaattcatgttctgttccatcaagatatagagttactgtgttctgccaaaggaggatgaaggtaaaatagaaagatcagttcagttgcattcacaggttgaaaatgggtagatcaattcgttagcagaccgtaaattacaggagatagaaaaaaagtgatcgacgatcataccctcggtgtgagagctggtgttttctttttgcgcctgcccattatcaacactaagatacttcctccaacagcaacaaggtcagcaaattatcctctgcagccacagggaaggcgtagtaaaatcaaaataataattaagaactaaactacatcctaagaatcaaaacaaatcgtgctatggtaagaatcaaaattaactgtgctccctccagccgcagcagaaaccagccccaaacaataaaaagaaattgattttttttacaagaaacaagcccattgtggtgttctctccagccgcagcagattttttttttgttttggaatgcgcaaaagaattaagcatcaatcagccgcagcagcaatgcaccggcagcagcagaacaatttccaggagaccgacaagaaaaactggaaacaaaaccaaataatcgaaacaaaccgagtttcaaaataaaaggaatccccggccattctatgcaggataacatacaagaatggacctcgaacatctgctcctcctcaaacaaggcacaagcaagaagaagtatgggagccctagttacgacttggtgacacatttggctaatgcgaaatgagaaaatttttaaaggccatcccccgaatacccaccaaatcgaccaaacggtagctgccatcctagaggatattaacgatagagagttcacctttaagccgccttaattttcttccctttagctttgttcgccactctgttggtttttttcctagttgtttgtatttgctgctactatcctatgtgatgtaaaactcttctctatccttctaatatagccggcaattctcttgccgtttactgttaaaaaaagaaacaaaccgagttttctgattccagtgattcctcaagatcaccggcagaacaatatctcccgcgacgaggaccatacagaatagaaaggacaatgcagaagagaaaatgctgcagagaggagtccgaccccaacaaaatcaataactgatacaaagaaaaacaaaatcaaaacaagtcctaattttttcatcagaatcagctagttcagagatttcttgagctaacagttggattattctctatcaacaacacgatcttgcgacacaatgtccccaagaacttgcggcacaacgcccccaggcgatccagagcaaaacaagaagaagaaatgggagatcaaccccaagaactatagaactaaaggtgcagaacggcccgaactgatgcagcagaaaggagaagaccaaccccaagaacagagcaaaacatccaagaaacaagaattgtcgatgttctttcgaggctcaccggcggaatagtatcctccagaaactagatggcgggtgcgggcaggataggctgattcttccaaagtactggacaccgtgatcgtcgatgagtcgagctccctcggcttggttccgctgccgcgctgagcgggaacccgaagcttgaagacgattgttttttttttcctttcctttttttttccttgggaaaaatggttgtcttgggattgggcgcatctggtgcccctcttcttgataactgggccgggctaaacgagcatgttgggctcgctcagccgatccacacacccacaccctctctgtcccccaccgcgtcggccgccgccgccgccgccaccaccgccgccgccgtcgccgtcgatgcttgttcatccccaggcgccgccatcttcatcgacaggtggaacatccgccgctctgaccccgaacgatagcagcttgaacttgaagtgatagcggcgcatgccgccgagtggcggctggcgagaggacgcatggtcgagcgcgcccgtggggacgtcgtagccggcggcgaccaccgtgtgctgcctggcgtggagcggccacgaacgcgacgccgccccgtcgatgtaggtgaggtgggtgggggttggggggcaggtcgcgctccgccacccaagcgcgctttggtcgagctcgtcggtggcggcggagatggcgtcggggccatcgccccactccatgttcaccgccgcactatccaatcatccgtgccgcgggagatgatctcccggacgatgtcgcgcgcgtgagccttgccctccgagtccacggcgcggtccagccatgctcgcctcatgctcgatcgggtgcccagccgcttcaaactccgccgacatccctgcacgtcgagccacccccaggcgccgatgttgtccaccgcgctggtcacctcgaacgcctcgtcaagcgagcggccagccaccgccaatccggccatgatgcgcagtgagacgcgagagcggattgggattgggggaagggaggtggagaggctctaaccctcatcgagcgaaggtgcgggtggcggcgtgaaagcggagcgggcgagaccgatcgaggcgaggcaacggttcacgcgcgcggtggccgtgcagagcagcaccggcgcggcggcgcattggccgaggtggcggcggctggtggggaaaattgggatttcgcgtcgtggtcctcaaaattggatttcacccgaatgcaactgtacaggaggattcaataaaatatcactcttaattaaaggctaccttacataaaagttacgggccagtttaaattgctaccctaccaaaatttgctctggtagaatagcaaactaaacacctctattaaaacactacctatgctataaatttagctttgcccatgaacttgtctcttatggacatattttggcttcaatccaaataaacattttcaactttaccctaccaaaattttagtagtaccaaaacttgctcaaaatttggcactaccaaaaatctggtaaggcatgaatcctaacatgccctgcatctattacttttaccatcaatatcaaagagaatttaatttatcttgtgtgtaacaaatatcaaagagtatatacactcatggaaccaatgagtatccttctttcattcatcactcaacggtccagattgtctcggtgaaatctcaacgattgagatcgctcccacctcccacctccctcgattgcgcgctcctcttcgccccctctctatcgctctcacgcgccgccgcccctccccaaccccgactcacgcggcgccaccgccctcgactgtcgctgctccgccgtcttcgcatccgtcgtcaccgccaccgatccccgcgccaccgctgtagccgccgccctcgactgccgccgctccgccgtcatcgcatccgtcgtcccaccgccaccgattcacgtcgccgccgacgccttcctcgcctggtcgctgccgagaccttcctcacccccgcgattcccaaccctaaccgccgtcactgccaccgctagcccccgtcgaccgtcgcaccgtgccgcgccgcaccgtctcgcccttccaccaagcccccggactccaacgtcgccgctccacgccgccactccagccccgatccacgccgccgcagccgcatcaccgtttgtttccgccatgggggcgtgattccgcgcgacggctggaggaggcgaggtcgggcctgccctccatcgatggcggactccgcgtgacggctggaggaggcgaggtcgggcctgccctccatcgacgctccacgccgccgcagcccgcagccccgtcggcgccgttgctgcgtcgcttcatcgccgtcccgacctcgaaggagaaccggcttcgagtccctcgcgccgccactgatccagggctcctcaaccctgcaagccgtcgatcccgcctgtgaacaaggtaagagtgcttctcgatcccgttcctgtacatgaggaggcgacgcacagcgcgtgggagggcaggcggaggcgaggagaggcatggctgccgtctgccgggctcccgggcgcagcctcacagagctgcggcatccacgccggacggcgccgcggcgtggcggggcgcagccgcgcaggcgtgcagcacaggcgccaagcagggcaggggcagggcggatggcgcagcagcaccaagcagcaagcaaggcaagcagaagcagtagcagccatcaggccatcacgcccaatctcccatcagcagaaaatggacagaaagagaaaagggaaggcactggcatcacaaagaggttgtactttttttttatttgacaatttcagaacattgcaatttcaaagtgtacaaatttattactgaaattgcaattaaatattttatttttaggatgcttgtacattttgtttcactcattgctttttatcttatcaaactaatcaatctttgctatttgtttttcagattctacatatgtatctatcctcattagttcatatatgtgatgtacggctgaaagcttgaatcagtgaatcttgaggtatttttgagtacctacttttatatttacacttatttgcaaatggatgatgaattgtgaacttgtgattaagtgcttgtactatgacttgctgatataatgttacattgtacaatattgtgcattgaattttttttcttaattcttgttctgtgttaactctcgcgtgtggtagtttattggccacacctaaattttttttctgtcctccgccactgttcatagagatgcataatggctttaggaatcccctttgttgactaaatccccattgttcattattaaacattgttcactgtgcatggatatctgtgatgcaaaactctaatccaaagcctattttgcatttcaactaaatttcacgtgttaatctcattcgtgtggtaggatttttttttggggtttcattgttgtcattggatgagatacttcacatcttgttaacatttatcgtcaatctttcattgtaaaattgtggggaagaaatggcctatctcagataattctattgtgtcaatttttctatgtgattgcttatatctagcaaactgacttaacctttcatttcaaatgatttaatctataggacgaaaattcagattgccgaagaaaaattcaggctgacaggacaccatgtcaactgctattgtttgctgcacaatcaacgaaatttttggctgattctactaaatttctgtttggtataggtaatttcttccataatgattaccccttacaaatagtgcaaatgtatacttcgtgggtcaatcttcgcactgttgtagaatctgatgtttaaaattgcctgcatccggtttacaaatcaagaaaaaaaattgccctgattactgtgccaaccatattttctttgagggattgaccaatctttttcttggaaaagcttaaccctgttccaaacgtaatactgcaaaattttgctcaatttcacatgcacaccacagtgtagacatgcattaatgattttgatttcacggtgtgacatgcacatcacattgtggacaagtacattgacagaccagcattttgatttcccatatattcttccctgttaaagcccggtcatcctaatcgatctgggatctaagaattagatggtatatgcagtacctttagtttttcttgcaatagactctaaattcttatgacgttcagttcatataaataactatatcctacagaatagatgaacctatttttctttctctagggcaaataactgaagagtgttggtatttgagttaaccactttttacgaacctaacctgctgcagttccacaaccatggatttaaataattgttcatgtagttcctattttttcttgtatcctacgttcacagatcatttattaaattttccttgtatcctacgtttacagtgttgcatgaatcaggaaaaatctgattgaaggatctaatatttgaggactcctgctctgctgttgactacttcactccagttattcaaggtatcaaagttactctaaaacagtattaaacattatgttttgcattgttgaaaataaacaaatgttcactgtgcattattaaaaagtatgttttgcattgtgtctttgctttaatttgaataaagaaatgttcaccatgtaccgagctggactgaaattacttgaatggatcatcaccacccttgtctgaagtaaacagtacctacaacagataatgctaattgcgaatcattcttggcaattgactgcatttgtaattgattgttaattaattttaggcgcactatactgcaaatcatgtcagctttcctgagcatttgtaatgatcaatgattaaaacaaattattattattatttatcttcgtagcagcaagcttgagatattattggcaaatcatatccaaatctctgtcaattacgctttcatgcagcagatcagagtaaaggttagcaaatcatatccaaatctctgtcagatgctattttggcaatatttccatgtattacatgcccatacatgtcaactcacaagacatacaaggcaatattgttatgtctttccatagatatcatgatagcaacaatggtaacattatcctccttagcctatatatatgtgggtgaaggagtgtgatccaaaaaaaaattactgatcctccttagccggctgcatacgactgctcaacttcaactcatcatcttggtatcgttctccaagctatctcttatgtgttggaaattattatatactttagtttgcacctattgatctcctatttcttatgtattgtaataaggcatggcatccatggatgatgtggatttttcaccacatcaagccacacctaaggagtcaatgaactccaaggatgatgcgaaggtgcagccttcgtcagggcaaacaccaaacaaggggaattattacatggggcacgcgaatgccatcatgatgatgtttcaatacatacgtgatggttgccggcgtgttgagagttccatggaagactagaagtgcaagaaggtagaaaaaggacacggtgagaaaaggaaggtgggagaagggtatgatcctcgctggtcttctcccatcgagataacaatgaagatctgcaatgacgacgtctccgatgaagcaaccgagaaggaaacatgatttagtattgtcactactgtgttttggctttagaataaaataacatttcttgtgaattacacaagaaaattcagtaaacaatgtcgttcaggcctattcagtactgcttgtgaaatgcacaaccaaattcgatgaaactttgttgttatgatgcctattcagtattgcttgtgattgagttgatttctgggacctatacaaatgtgctctacctcctgttgaactactatgtatttgtttggcacggttggatgcatagcaatgttcctttatatttgttttccatgtctttttatataaggagacatcacacaccaattgtggtttagatctcacataaataaattaggtcggccaattttctgacgttgtgtagcactattgatttctgtaactcttttgctttagatcaaacacatgtaattcttttgctttagatcgaacacattttatttgcttcagggctccattaatttaaagagctgaccaatcacatgaatattgattaatgaacatgaaagcgtataaaaaaaaagcaaatataattaacataagaaaccagtatcgctaatttgctattatgttgcctattcagtcatgataaaggagtaaaggactgctagatgtcaaacttatgtgtatggtccaatcctgtaatggcccattaacaactaaaatacccattataaatacttatatgccatactcaacctaagtgcctttgatctgtcacgttaatcatatatcttagggcacagatatatgcattatcatatatctttaatatcatattattatgcgttatgacatggggcacaaatatattggtatatccaattcaaatatttcactgcgcaaaatatttgaggtataatataaattgaattaaagttcaaaggcacagttaatataataatatttttggctaaacatgaaaattttaaaaattattaagagacaaatagagttgcaccgtaggttctagcacgggtatattactagttaaaataactcatcgagttatgatcaagcatttaatttacctcttcatttaaatcttaaattcataaagactacaaataaaaataacttatttgaaaaaactcaaatatgaaataaatctaactcttgtggatggagggaatatttagaataaaattgccgctgactctccttttcaagcttatgtcctaactccggcttgctcattggcgatgagctgaagatgggctcgagtgtgggaaggtagcaaccttcacctcctttgtagcctcggatatgacgctctggcgcaacccccatggccgatgtctacctagcaccatgggcgatgcacaccgcatagaaaagtcacatcatctttatctttttgtcctgacaacttgaccagtccatggccgatggcaagcccaatgactatacataacggccgctgcatccagaagctcatttgggtccccctcccacctccaccataaaagttttggacgccacgcggtagctcatccatacctagggcatgggggatgcttatgttcgagtgtcccgaggagtgcgtggaagctgctgggatggtgggtgccatcgtgcagctcacgaaggcactgaggtcgttatcaccattgctattggctacctcattgccaccgagaggagaagggggcaccaaagagtggtgtgtagctcacgtgacgcggctagagaggagctccgccacctcatggttgtggtgcagcttgatgtgagcgggctcttcagctcggcgccatggcatttagtggtagttgataagggcatccatcaccggagcgagaaagaagagatggcctatagagaacccatgttgttgaaagtgttattttatcgaatcctttttgcacagtggtatttaggcgaaacctatttttgagggtggcataatcccaaatttctcatgcataggggaacagaagtttgcctatgagaatattgactactgtgatgtccctccattgtgatatcttaaaattacttgtaattttatattgtttggcatgatattcagcttaaaatcacttgagacttctttggttccataaaaatattgaatgggatttagtatgaaactaatctcctcaattctctccgacctgtctcctgtaatgaacattgtttatgcttttttagtaaaaaggctggcgcagagcctttgatttataaaattctctccaatctctccctaagcctattggcccataaggatattgaaagggacttgatgtggatttaatccccccacaatcctctccggtcctttttcttgggaattgaaaatatttttgacgagtatttattaaactggtgatccttgtataaatattactgattgaaccagcaaccgtagttttattttaaattgttgatttaattcgtgtgccatgtccattttccagatatggtgagttaaagattttcctttttaagtatatagtgatttagtggcatggaatggggattggggaagaaaatgtctttgctcagaaaggtccgcacttccacaagattaactccttcatgctagcatgatatgttttatgctagcatgatgtgttgatgtttttttggttagcatgatgttattgaacaaaactgtatgagttcattaacttctcatgcctctttctagcttgtagacattgacgattaatgagaaacgtccaggggtcttccggctagctccataaggtggtgggctagatgatctgggttcgaagcctcacctcttctaattatttgatattaggttcttccctaatattcgcgtttttgacattggcgattaatttgcaacgttgaaaagcatgagtgaacgcgtgctacttatctctgatgtggcgtactttaaaagagacagcgttggagctagggaagaagcggagggggagatgccggggatggaagaggagtatggcggaggaggaaggagtggaagatgcagatattttcaacaactgactaccaactaattgtttcctactatcttaagcttcctaaatgggtctcaataacatatgtttcttttaccaaattgattaacaaagtaaaggggaaaaaacaccaataggctactgtgacatcaaatctgaccaaacaacatgcacatctatattggcgaaataatgttggatccgttgaatagaacctgcatgagtggtagccttgaaggcacaatagcgatggatttgattggatccattttcgccggcggccgctaccacaggcgtaatcttgaaatcaagaatcaacacagtgcgcagctgcacagcaaccacgaagtttctgagttttgatggattaacaatggtgccatcgaaaagcttgatttcctcagggtatttgactgacaaagcaagagatggataagtgtatgccgccatgaattagcttcggaatcttaatttgtatggtgctttccttcccattgcgaagaagggctaagctgatatccacggcgccatggatgccatggatccgccgactatacaccccatgaaatggtgtaaggtcgctgaaggcggccaccccgtcgatgagctgcaagtcgtccttttcgtcctctcctttcttgatcttgaggtcgtactcgatcacagcaggattttccagcgagatgcctcgcttaggacctgacaatcttataagcgagttgggatcagagtagtggccaggcaagacgaaaggatcatcccggccgcggttgaagatgtagttgcgcagggggtcaaagagatcccgggcagccatgaagccatagatctggaccggggcgtcggcggcggcgttggacagagctgctatcttgatggagaagatttgcatcatgcggcagccatggtggacgatgcaagccgtccagcatggctggcaatggtcggtccgagccgacagcctcatcggcagcaggctagtctcgcgggtgtcgtcgaggcagtagaggctgtggaacgggtgggagtcggggtcgtagatggatccgtcgctgtgcttgacgccgatgagctcggaggcttccatcatgtcgtcgtcttcgtcgatgtcgtacaagaattcctcctcttcctcatcatactcccaattgttctcctcctcctcctgctgctggtcatacttcttccccgttttgattggagcgagggaacaaggaataaccaacgcgttcttctcttcgttctcatgtgatgacgactccggcggctggcaatcgccggcgccgcctcccttgtccatggatcgatcgatcgatcgactgaatcaccctccggctgggacgctgggtgcgtggtttgtttgggggtcatgggattagcttgttgctgccttttatctgatctgatgggaaacaaaccgtgtccgattccgaccggtgaaccgtctccgagtctagcgactccgtcgtccctttcccggttttaccgtcgtcacgtcctgtgccctggtgtttggagtggcggctgcgtcacggatcatccgactggtaaaaaaagaggaaagtcagggctgccttaatccgcaaagctgccgagggaccgacccgtggaatttgctatatatttgtcgcgtgattttttttctacgtattttgtcgttttttcgaccgtatgatctgcgccgcgatttgtgctgatttcaaaggttgctaaatgcaactgggccaccatttccttccggcccaattatccttcctccctcctggcccgacatttcctcctctttctttcctcaccccagcccagcccatctctacaagccgcctccatccttccccttagcaaggccggcccatcctcccatcctctctccggccagccaaagcaccaccaccttccttttttctccccggaataagtccactttcgatcacccacgcgagtttgaatcacgtcctttgaaccgtaataatagaaatcataaccacatctttcataactaagaaaaaaaatctttcataactaggttaaataaggtcctgagacagtacaagtgattgttttgattgatgtggcatcctagtcgacaaatagaaaatcaaaaaaaaatgtgaagcccatatgtaaagtggactccacctctccctacttatcccctctcttccccaacaactcgtcggcgacgagaggagaggcgaccagcgagcccgtttgcgtgaggtggcagttgcggttagaggttggcgatgccactggtgtgtagctcaagctcgccgtccacgggaaggtggcggtggtggtgggcaaccggagaggatggggccgcagctgtttgcaagtgaccaagtcatcgttccgcccatttcaacactactgtcaaatttaaagttagcatatctctggactatagaatagagtaaacacaaattttgtttctggtcctgctgattcaacaatatcattccatatttccatttaaactttgcagccaaaataaaacctcaactactactatttaccctctcaacctccacactaaagttgttctaccagcagcgcgcacactttattctctcctctttatgtcagcattgacgaagcactgtctgtcatagtggcatatcttaagctgtggtacttgctatctttcttccctgatgtttgttcagttgagcagcatgtgcatgcttcacttcagcatcagtttgacatctctgaaaaggcctcacacctgccggattcctatgacaaaaaaaaaaaaaaggatcaacaatggctgaaggataatctgctccaggcttcatctttcacgcaaaaaataactatttttcaatcaagtttttatttttttaaaaaaatgttttcccattcatcaacatcagttcgtttcattgccgtttattaacttcagtgctggagtgattttatagtctttaagggtaccatatttccaccgtacatttgatatctcacggtactaagagatatatatatcatatttgcactaaatgttttggtatctcttggtaccttttaataactgtaaaatttctctcagcactgtacgtaggtttgcatgtatgttttgatttggcctgtttcagattgtagtttgtacgaatttgatgagaaacagtttcgaattactacaaatctgatgaaatcgccgcgaaccgtacagaaacttaagtaaagtattagtggtacctgatgaaatctgcaagaacaagaacatccctgtcagagggagtaagacaggagtgtactggagtacagtgtactcaacatcatatttaaagcaaacactgtaaaaacattgcctgctccaaaatccaaatcagtgtcttcacagtacagaagtgcctgacaaagctgacagattcttgtgttctgcatgtgtagattcgatcaggaatgccataatggcatggatcgcgtttctttatcatcagatcatcacttctactctaaacaacagtacgattggtcctgctcctacacatcaccagctagtagatcacaaaactgaaata

SEQ ID NO: 5485 - DNA, 336 bp, Oryza sativa
cagtgtttttagtgctatagctagccttacaaaaacgtaaccttatatatactaattaagtttacaaacaaatggaaaatatatgctacattaattattatcaccttgcttcatcggaatgcatccctcctttttcttcgcatccccgtaggttccattgttgcataagcaaatataatctccaggcaaattaatgcacttcccataacacgggtaaatatcatggcgcgcacattcatcgatgtctagatgagtacaacaggcgaataatgtgatcagacatgcattttgatcatggaaaataaatcctattccctccgtttcaaaatgtttgac

SEQ ID NO: 5486 - DNA, 519 bp, Oryza sativa
aatgaagatgaattgataactattttaaagattttagtgtctacttattgaatgtgtgtcactaccttgttttgccagatgaactttgatatcagttttatgctctgggttgacgtttagtcaggaacctattggagtgtgttcttcatcagttgtacggtgtgcccactcagtcagtcagattagtttccattttgttattgcctagctgatatactgtaatgtaccactgttgatttttttcacgaatagccactgcatgttttatggtgtttgtagatttacttatatcctcttctacaagactggctcgcctactgcggagatttgttttggttacttgcaataggtctcaatattcggatcaatctatccttatttcttatgtgaaatagggaactcagggtagacttcattatacttgctggttacgtgaaacttataccggttgagctagttcaggaatatccaaaatccattttgaatattcacccttcactactcccagcatttggaggc

SEQ ID NO: 5487 - DNA, 4076 bp, Oryza sativa
taacatctttgacgggctggatctgtatggcccgttacaggtatctagtcacctgtgacgggccgtagccggatgccttaccgatggcggcatcccgtagaacctgtcaaaggtgatcctcatcactgaccaacacttatgcccatcacaggtatgtcgtcaaaggttgaggatatggcgtagtgcaagacgctttacgtgtattatttagtactaccttcatcccaaattaattgtaattctaagttatttaacatatattaagctttgaaaaacccttattgaatggtttgtaggtaagaatgaaagggtaaaatagaaagaaatttagatgagaagtgatttatgagatcgtgttgatgcaaaaaaaaacacacactggcctaagagatttgctttactctagtgcaggttctaaatttgctttcgggtttagagcgtgccagttggtttgatcctgcaaccaacaagaaaaaaagaaaccaaagttaaatctataaacgatagccgatcggctggattgccgatgacgtttcgtcagatatcaagccgatgcaatataacttggatcggcaataaagtatatagtagataaagaactaaattcactttatcggctgcagatattaacaatgtataatctatacttcaaaatatgtttaaactacgtgatcagggtagatcggatgttgccgagacagtataaataacatatgtttaaaagtacttcaaggtaaagattaaataagttcatgtcagccaataggtaaatctagcgtgtgttggctattgctccaatacttctttatactaagatattattatagattaaatatattaaacaagaatgataacctaagtagatcaatatcaagcgtaatatatttcaccttagtgagatcttaatataaagggtagatttagcatatcaagtaaatataagtgaagaacaagatagctaaaccgggtaagataggctgaaactccgatgctatctctgttagcaatcatgaagcaagttagatattatggttctagatattacttaatagatcaaacttaactgatgcagcattaagcataaagagaaacataagatctgatcaacaaaccaatgaaagccttttcgagatggtggatatactatataatctaacccgacagagttatctaattctatcggctgatctcgatgatggaggctagtcgacaagaccagatagtaatgtcaatctagattatatagcatatatgataactcgacgatttacataaacaagattagagtgtcataaagatgtaagcactaatcccgagaacgcaagtcgccataacaagctttacctctcgtcagagatcgtaaccgatgcagcccaactcgaaagcaagaactcgtcgaaacaatgaaagtagaaaaaggtggcgatgcgccgaaagtgttgttgaactggtgttaatcgtttacaaggtgtcgggcacatatttatacccaaaatatacaatatgtccacatcgaacacgactccacttctattacaactctaaaatacgaacaagtactttaggcagactcttaccgaaaatctatgaagaaactactagaatatcctaattaatagatacaattgccttcttcggactcaatccatgcttggcaatatttgtggaacatttaaatcaatcccgacaatgattctaagatcactttgccaaaattggctacatcggcttctccctatccgattcggtattagccggtgcaaacgatccgatgcgtactctgtttccgagaataacgaactccttccaaatccgcttcggttttgactccaaatccaatctatgatatattaaatttggtcgttaacacatcgttagtactctattatgataattattttgagacaaatttaaatcctaaaaatacaattgttatgggacatatgtagtacttagttagtacttacaagtactgatggcataaagctttaaccatcatatttgtaataaatgatcatagccttcaatgaattaatgtttgtcttgtgattttttttccttttatatcaatataaaaccttacactctcttatattattcatttcaaataaccaaattgttcaaattgattgtatggaccagcaaatgatttacaagttgttatagttattttcaccacactattagaaaacattttttttttacaaacgggccaaaatgatttttccagatggccatccaccccgcctgcacttcaagacctatgaaaatacatgatttttgcaagcggacattggctgattttgataggcggtatttccatcttcacaagcgttgtagccacctgcctgcgaaaatgttctcggcgaacaaaaaaaaaacgccaccgtcccatcctttgccgccccaccccctcctcctcccccaacccggccggaagatagattttcgtaggcagacggccatcttgcccccttcccatcttgcatgcggaatagtggtggtaaaattttcgtcctcctgtaggtatctcgtctgaaaaaatggtttttccaggagtgccaactaggccgtttgtgtaatagtatgtagatgcaatagtttgaatagatggtaatatatacagacatcggaagagatcgatgatgcagagggtagcaagcggccgagaagttatgacgtcgtcgtcgtcgttctgctgtttagcagcctcgctactgatgctgttgctaccgttctttgccatggcagcagcagctgcaggcgggagcagcagcagcagcagctgcaggcgggatcagcatcgagtacccgttctgcgtggagcctggctgctaccacccaggcttcaacctcacctgcaaccactcctacagcccgcccaggctattcctcggcgacggcacggtgcaggtgctcgagatcgccatcccccaagccaccgtgcgcatcaacagcggccgcatggtgttcaattctactggcaatcatgccgtcaacagatcattattggatcaggtgggaaggccgtacttcgtggcagcttcaaacaggatagctttgctaagctgcaacgcccgggttgacgtccgcgcggctgggagaaacaacaacaaaactagtactaagttgctcagttcctgcactgccatctgcccaacagacgatggaggtggtgctaccactatcctcgatattggtccagagggtccatgctcagggattggctgctgtgaaacaagcatgctactagcaggaagctcgactgctgcctacagcatccaggtccagaacttgcaggagcaggccgtcgtgctaaatcgaacggatgatctggtgtacttggtagatgagagatttaactataccttggacatgtctttcggctacagcagtcctgaagagctcccagcacggctagactggtacataaatagttcatcagcgtgtccgttgcccgcgtccgcccccgaatgtcgcagcgcgcacagctattgcgacagtacttacgacaacaaggcgtacatctgccgctgctccgaaggttacgaaggaaatccctacgttcctgatggatgccatggtaattaattaatataagcccttgctgctttaatttcttcatgttcttcaacaatcaacttctaattaactgatactcctatatccgttcaaaatgaagaaaaaaaaacaactcctaactgatatatacgcccttgctgtttgctagatacggatgaatgcagttctggatactgcagttacggcgagtgcaggaacacaccaggatcgttcatttgcaactgccctcgtggctacgagggcaatccatcgccaaaagatggatgcaaaggtgaactaaaactagctagctagttggattgcccacaaatctgtacaaggatagatttatttcaaagttttgcctctactttccttttgatcaaacttacaatgagacatttggttatttagtttctctcaattcttgtccattgcgacacgaatctattgaatatttgtttctatatctttataaatggagtatactccctccatacttataaaggaagtcg

SEQ ID NO: 5488 - DNA, 641 bp, Oryza sativa
atatatagtccacatcgtataatggataagctaagtcttgtgtaccgaggtggtaaattcaagtgccattgggcagttggggccaattgagttatctagtttccccaaggcaattagctgttccaattattggttcacatccaaaaagaagcagccactgcaattcaataaatgaaagaaaaaaatacaagaaggattaccttaagcaccaccctattgaatcataatgaagaaggccaaggaccttacgtcttccatcattcctacggccagccctccgttttaccactggaagttgcttgatacctttcacttccatgagcaccttagcagtgctcagatctgtatctggaaagcaggtcactagtcctctttcattgccgtggtactgaaaccctctagtgaggcatgatgaaacaagagaagaatttgcctgaaacaattaaagcatgtaagtatgtgcatcgctaatttcgatattactataagggcctgtttggataggggtgttcaaatttaaatactttggttataagtttaactgcacgtctgcatcctataaaattccagatccaaagcatcccttaaaacggcaattgctaaattaaattataggctttaaaggtgtgagattttgcata

SEQ ID NO: 5489 - DNA, 30495 bp, Oryza sativa
  unsure (1)..(30495): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaccgaaagctaaggggaagaggaggaacgaggagggagaacgggtaggaggcactaccgtgcggggtgaaggagcgcagtgatgatggccgatggcacggggcgtgatcgctccggcctcgggccggggaagaggaaggagagggtgtgcccggagtccacgtcacgcgtcctcgctcgtgccggctccttcgtcacgcacgacgacgaacggcgacggcgaacagggcagggcgcggcaatggcgaggccgaaaatggggaagattggtttggggaggggctcgggtttatagggcggcaacgtcggttcggaaaccgaccttgggcggcactagggggcgagggagcttcgaggggaagggataggcttcacgggcgcggtcaaacggcgcggaggacgggctggcgcggcgcggctgctcctctgccctggcgctagctccgagcggagggagagcagaggccgggccgagagaggaaagtgggaaacggagggggagaaagaaggctcgcgctatgccggtttggggaggaagagggatgggagtgggaggcactgcctcgcggggcagggcgcggcgctggcggcgcagcgcggcgcggggccggacggcgcaggcacgggcagcaggcggctgacgacggcggcgaccgcacgggcgcgcgcgcgcgaggtaacggcgcgcggggagcttgccggggatggagcggggagagagaacgggataacgagacagagagagggagagctcagctcgtcgtcggctcatgcgcatgcgcacgcgcacgcggcgcacgggcagagcgaggggagagctgagggggagagagagagagagagatgggccgagaggaaatcggcccaccgaacctgagggaggcacaatagacttttgcggaggaatttgatttgggaaggatttggattcgggatttgaatttgacgatagatcgaggattcgagatcagggattggcatggagacagacaacaagcaaagaaacagatttcgcaattagggtttttagaatttaaattttcccgctaggtgccacgacggaacgggcgctacataatccattatatatgttggcttttgttgtcgaaatgacaactacatacgtcgaaggacgtggttactcaacagtggttggaaggaaacgaagtgtattgaattttgaatttctttcttcgaatccccctattacatggccctaggggactatttatagccccactacaggttcttgctactagggtttaggttgtacaggggaatttacatgattacccttacgaaagggacatttacaggggtacataatgttataggagctcatgggtccctgatgggctgtctggcgatcgccggccctatagcccttaggcttgatgggtcggaaaagcttcctcggcccttgcgggggcgaacttgccatagcgaagttgtcttccttcggcagatagtcttcgccttgcacccttcgcccgagacgcccctggcctggcaaggcactcgtgcgactcttcgcctcatgccgttcttgctccatagccttcgccacgggtttcggcagatttggtcgaagggcctcatgccatccgccaacaagcccctcacgggcaaggggtgagattggagcttcggccgagaccgtgcaaaccatgtggtatggtatgtggcgccccctttcgaccgatgctcctgctgaaacctacattattcctgcgaatgaagtttgttacttgtgcggctattattattttgccgcgcttcgcctcctgcgagtggtggttatatattttcttttcccgggccgaacggaacagtgttgggccttcccttcgtgggctttttactgtgccgctcagacggtgggaatttactgtttcgcctacccttgcgacacgtggcgctttattattggtgggtaggcgaacggtcgcccgggtaacactacaccatgccccaagtttgcttactacatatctgtcaggaaaggacctatatgctgtcaaattatttgtcagcataacttttcccgacagatagggtctgtcaggccaagtgctgccggcaaaggtcttttccgacagataaatgtttgctgacatataactcgacagtcctacaaatgaattaccgacagacggaagttaccgacagatggtcctttaccgacagttaacggattactgacagatacgcagtttgcatatatcagtttttctaacatatattctgttagtgtgccctgcattgggttaaaaaaaatatagttcatggaatcaaatcctactgatctagaactgaatataccaccaacagttctcatgcatccacattccactagtactgaatataccaattccatttaattacaaatgccatgtacataggttagttgtacaaaaagagaaattctcctatacaatctacaaaatgagacaaaacgatggcaaatctacaacaggcaaggcatttcccttgtagagaaatgccactccaaaatatcttgtgaccgccatgataagttgagcatctaaaaacttgaatcagattatcagaaagacaaaagtattaagggtcagatatatagattataataatactccatttaatgataagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatattcctaataaatggattgatataagttggaaatggcttcactagtaaatagaacttggcttgagtagttgctgtactatgtggtgcatgcaaagttctcaattagcatttcaattattccaactggtcctgatagctgatgcatgtctgtgtgaaatcaataatagatcaaatcttaaaaaaaaatgttcaccactctttctagtacatatataataatgtctgccatgaaatgaaaaggaaatggagcaaacataatctccaattttattgaatagtgcatcatatagaagattagcacttaattgttaataccattgaagttcttgtaatggaaaagtaagcggaaatctaaaaatatgaacaattatccgtttttcaatttgatacattagatcagacagaaaaatgtccataatgtggtacactacatgagaaatagtgcattttcttagtactaccacatttctgtaaacattacagctaacttcatgagaaatataaagcagaactggagcattagctaagattcatggggaaaagagacaagtaggttcaccctaaactcttttgcaccagtattaagcatggttgcaatgcaagtttccatcccatggctatgaatgacagccccagctctcatcaaataagcctgcaaaataccaatgaaaattagacagtttagaacacactagccgaatgttcgctctttctcttttggcaaccatgattggacaatcaataaatgagaattctataaaagctcctaatcaacaccactcccgaatacggtatgctcgatcctaacagaagacacgagagtagccactgctcgattaaccactcgtgagggggaatcgagtgcccctcgcaggcaattcgtcgaacaggagccgtgcaggctgtaatgagagagagagggggggggaccttgggtgcccagaggcggtcgtcggcggcgacccagcgccaggtgctgcgtgcgtccaggagctccatcacccgccccatcacctcctccccgagcacatccacggggtcctctcgtctctgccgcctcctcctcctcctccccctcttccgcctctcccactcctccgcctcccgcttccgccgccgccgccgcccgcgccttggttgccgatgacgtcgcctgcaccttgctcgccgccgccgccgccgcccgcgccttggccgccgatgccgtcgccttgccgccgccggaggaagcgtgagtgcgtgacggctgggtagggaagaaaaggataaggttgtggggaaattagggtttggtttatatatgataggctagatgggctttttgggcttgcaatatggtattattaatagtctaatatacaccctctaagttttgctgacatataattagctcgtactcttacaattactgacagatattttgaccaaaaatatatttagaattactgacatataacatgtctcattatgcactattgctgacatatagtttgccaaaaacctttaccgacagatattgtttatttttgccaacagatgtctgttggtaattccatgtcatggtgtagtataagctatatattccacccctctttccttttcaccggtacactcgccatttttaccgcttgcgccctcttcctccgtttctttattccacagcgtctctcgacccctcaggtgtttcgcccattcgctctcttcgccaccgcatacacgccattcgccatggctcctcgcaagccaaaccctgcttcggcgaaagggccagatcccggccgagtcgatgacgacagcaccgcctttttgggggtctctcttgtggacgacgtcgagctggcgaagttggtcagctctgggcggtggtcgaggggcaggctttcgccccggggaaagccgtggtgccgaagtctgtcgacaatcggacggtggtgttcgccgtgttttttgaggcggggctgcggtttccgtgcaacgtgttgttgccggagatccttcgcctcttccaggtggagcttccgcagttgagcccgtcggcgctagttcggatctccatctttgactgggcgtgctgcacttccgggtttcagcccagcgccgagctctttggcgccatattcttcgccaccgtgaactcgaagacggtgattaccccagctgggacgaggatgaccgtgttcgggagtgtgaatttcaacgttcgccccgagcggtccgatctctggccggtgaacgctgccatgtcgaagtgggaccgccattggatggcgaggtggttctatcacaccatccccttcgaggctggttctgaatcagcgaaaaccctccggtgccggcgtagggcgattgcgccgaaccggaaacccaagatcgctgtggacggcgctatggaggcgcggttcattctgctgcgcaaggtttgctcccgccttagctgccgtgacttggtggaggagttctgtatgcttcgcatctttcccctctcccagtcatggaaagtcacagtcgagcaatgcgaagaggctaacggtttgccgaacttggttcttcctgaggggatgaacagtaaggccgttcttttgctatacactcctgtgctttgttattttaccctgtttggcttttaatcgtgattccccctacttgcttttatagtgctaaccctcgaccaaactgaagccgaagcccgcaagatgatcggcgatgtgtctgttgtcgagttcagccaattgctgacacggcaggcagctggtctggcgaaccgggtttataatggcgaactgcctccccgggcgaatccccacaagactgatgacgaaacaggaccctcgcggaaacggatacgcggtcagataaagcttgcccccaggaagcgaagggttcctgcttcgtcggactccgacgccgacgacgaggatgatgccgaagaacttgacggcgaggaggaaggagaggaagaagaggaggtggaggctgtggctgataaggccgcgaacgaggcgatcgatgatcgcgtcgacacccctggctacactcctaccccaagtccaggtcacaacgagactggagtggagtcgaacagctccccccttcgacgaaaggatttggaaggggcgaaggccctagttgcgttctcgtcgggcaaggcggcgaaaggaggtctggtcaagaagatctcaaaaaagaaggggctcgtcgacattgctcgcattttcagcgacgacgattcttctgacgagactccgacttcacctgctggtcgcagtttggacctttcgaccgctccccttgctccgctcggcgtcgctggggcaggcggtagcgccgccaccggggcttccacctccgccgaacggatcgtgtcggctgcggcgagggtttttgggagccctgtgcgcgagccagctatttcgccgctggtcaaggcgaaggggaagtgtgcggccgccgaagcatctgcctcggagtattcccttgcggcgccccacttcgcccctggtgacttcgagacctgggcggaccttattccctttgtggagggagtaagcaatcttgtcttgcctgccggcaccccgagcctgttcaccgaacttaacgagttcgacgaggggtgttccaccattaaaagtttggcggttcgggtatgccctttcttccctcttcgttttcctcttccctcttatttttacgtctcgcaattaacctttcgttcttttcgcccgctcctatctttcatttagatttttgcggctcactgttcgacggagcgaaccgtgcgggcccgttttgatggttttaagaaccgtcttcgggccaaggatgatgaaataagccgcaagaacttggaggtggagtccttggcccacaccctcaaggaggcgaaaactgaggtcaaacgccttcagtccgaattggacaaggggaaagaggcctgggccgaggttgatcgcctcaaggccgaactggagaaggagaaggcccattcggcggtactcatcgattactacaaccttactgagctgaagatggaggctcttcgccagaaggctagcagggccgaggcgagcgccgcggaggagtcgcagcagttttcgcgggagatggcgaagaccaccgaatccgtgagaacggcttgccaaacgctccgcctcgcccttaccgacatgggtgcgaaggtgcggggggtccctgccgagggtgcctcagccttcgacttctccgagtggacccagcaggctggcggatcggtttcggactgtgccaccgcgtacggcgattgctgtgtgtgcgtatcggcggcctttaccttaggccttttgcaacagttcggctgcgagcacgtcgccgagttccctacctatgcgaagggggactgggagattagcgcgcaggacatttcgccagctcttcgcgcgtggagaaaacagttctggcagaaggatggccagtccgctgccaaagcgcgccttctggagcaactggcgaaggcagaggcggcggacctttgtgaagaggaaggcgcggcggccggagggggtggaggcgatgcccaggaccacccagaggtgtgaggccctccgctcttctcttagattttcatagtttttttttggtgctcgctagatgtggcgaaccgttgtatattcggcaagctgccgctaaaccttagaagaggcctttttgcatacttggactgtatggcaattttaaccactttttaatgatcaaagcctttggcatattattatttcgctcatttcgcattatgccataccttccccttctgttgcctattcttactatgtaagtcgtgttttgccttttctgcactgtctaccagggggttcgccgaaaatcatgcattcggcccccttctgggagctggcgaagtcaaaacgagaaatttgtggcattgaagggtctgccgaaggtgcgatgtccatttcggcctgtttatcgcaaaatggagataaacggtcgcagctataaagttttcaaggttgccaactggctgcgggcgcaccccgggcaaaccttagaagattacgatcatgttcattcaagacgtttggaggatatggctcgcttttggtgaaaccatcagaagactaaacgccaggaatcgatctttcagcgtcgttacagtttagtctgtgtttcaccccctactcctcttaaggttgtgtatgatattagtagtgatgacgaacctagtttgtctgaccattcattagggagggataatgaatacgggggcgaagatgtaatttacttgtgaagtgaattgtatcgggttgtgaaccttgtgttcttcgattttttttttcgaagttaataaagaatgtgctttatttccttttcgctatttttcgcatcgtcacattttgtgcttttgttaggtcggaacatgccggcccctttgcgcatattagcgaaataggtgtactgacttttctgcttttcgtcgttcgttttcgacctgtagcattctgtgtcgaaagagacacttttgcttttatgttgatcgaatcgtaacgttgttcggctagttattttccgagacaagctgttgcggtttcaacgttcggcgagcgatgcttcgaccgattcgtttctcccccctggccttttttgctgatcaggcgtttgccttggggtttttccacaaattatcaatcacacgaaaaaataaaaaagagggcgaaggacacatacattttatactggttcgggcctttcttaggcccaggtgaacggcttcatattctcctgcattgttggttgtgtcgaactgcagtcttgctgcgtatcgaatcggcacacctttcggcgaaaataggactgccgcaatgcctgctcccttgtgcgaccacgagccatcggagcacatcacccagaattgttcggcgagctcggggtcggggacaagtaccggtgtccattcagctacgaagtcggctagcacttgagacttgatagcagagcgtgcaacaaaatgtaagtcgaacggggatagctctgccgcccacttgctgagccggccagtgacttccttgcctcggagtattttgcctaaggggtactgtgatggcactatgactttgtgggcctggaagtagtgcttaagcttgcgcgaagccatcaccagggcgtaagcgagcttttccatttcaatgtaccttgtcttcgctccttgcagcgcttcggagacgaagtagaccggtttttgtccgaactctgtttcttggacgagggcagcactgacggccaccggcgaagctgctaagtataatagcagttcgcttcctgggggtgggcttatcagagctggtgggctttgcaagtattgctttagctcgttgaatgctgcttggcactctggtgtccaattaaactttcctgtgccccggagggttttgaagaagggcaaacctctttcggctgcctttgagaggaatcgattgagtgccgcaattcggcctacaagcttttgtacttcatgtacgcttgacggaggcttcatttgctgaatggcatcgattttctcgggattcgcctcgatgcctctttcggaaacaaggaaacccaacaacttgcccgcgcggacgccgaaaatgcacttctccggattcagccttatgcctgctgtacgcaagctgtcgaatgtcttttgcaggtcgatcgcatggtcgaaagccttgcggctttttacgacgatgtcgtcgacgtaagcttccacattcctccccaactgcttgccaaggaccttgtacaccagcctggcgaaagttgctcctgcgttccttaagccgaaaggcatcctgaggtgacaaaatgtgccgaatggagtgatgaagaatgttttggggatgtcgagcgggttcatgtggatctggtggtaaccggaatatgcatccaggaaactaatgagctcgcatccagctgttgaatccatgagctggtcgattcgcggcaaggggaagtcgtctttcggacatgctttattcaggtttgtgaaatcgacacacatgcgccatttgtcgtttgacttccacactagcactggattcgccaaccactcggatggtcaatctcttagataacccccgccctgagcaatttttgtacttcggctttcgccgcttcttggcgatcggcagacatcttgcacaacttttgttttcttggcttaatgtccggtttgactgctaggtgatgcatgatgagatccgccgggacaccccccacctcgtcagggctccaggcgaagatattgatgttctttttgagcacctctaggatactctcaacttcttcttcgcccatgtcgccccccagtgaaacgagctttgtggggtcggcgtcatcaatctgcacttttgttatcttgccatgagggatgggctttggcgtgtgcttcggccgttcatgcggttcggtctcaacactgtgcactgctttgctgattatggctagatcgccttttgaagcggccgaaggatgaagccccttgactactatcacccctgttgggccgggcatcttgagcttgagataattgtggtgggaaatggcttcgaacttgttcagggttgcacggccgaagatggcgtcgtagttgtacgggatgtcgacgacgtcgaacagtatttgctcttcgcgtctgttctcccccgagccaaaggctatcagcaaaagtgtttggccgagaacttgaactgcctctccgccgaaaccacggagcgatgctggtgctagggtaagggcttgggtaggcaaccccatcttggcatatgcttcggcgaagatgacatcggccgaactccctccgtcgaccaggattcgtcggacttcgaaaccagctatctcggctgagattaccaggggatcttgatgcgggaacataactccttctgcgtcttccagcctaaaagaaattagctggttccgatactgcggcgccccttaacccgccgaagtgatgctatggaccatacggatctgcatcttcttctgccgtttggacaactggcttggcggatcagcccttgtaatcacttggattatccttcgctgaacatcttggcgttgttcggctgggggtgtttgctcctgaattgcttcgcgggatgcttcgacagttgttccctgctgcagccttgggtcttgcgcgttgccacgttgcctaatgtttcggcattgctccgtggtgtgcgaagagcgtccgtgaaaggcgcaatagaggtcttttcggaccttcttgtgggctggctgctgatggttgctcgcttgctgggcatcgaactccttgcggagggcttgcacttcttcgaccgccatcatagctttgcccgcacggtctgttctgaactttctccaagttatgggggcctggccttgccttgacggttgtccttggatcgccggctgagactggcgaacagagaggggaggtggttcggcaatttgaacttgtgcttgagcttaagcggcgacgacggaggctttgtcgtactcagcttgtatagcttgtcgtcgcttggaattctcctcgcccctcgcgaacccgtcaatgatgcgaagtaggtgctcgagcgtttgtggctccttgttggcgatttttcttgtgagttcgccctcaagcagaccggccgatgcggcgtttataaccgacgcctcggttatgtcttgaacttggcaccgggcttgcgagaagcgacgcatgtattcccttatcgactcccccggcctttggcaaatgccgaggaggtgttgctgcgtcttcggctcctcataggtgcctcgaaagttaaggacaaaaacatcgcgcaatttctcccatgagtaaatgctattggctggtaaattgaaataccaagaacagacgatgccgtctagagcgagatgtattaccttcgcttttgtattttcgtcaccatgagccgcttcgatcgctgactcgtagatgaagaggaactccttcgggtcagtttcgcctgaatagcgcgggaagggtgggaacttgaactgcggtgggattggacgagtcatgattcccccactcagcggtagccccttttcgcctcccgccctgtttactgcactttgctgcgggtacggtgtggcgaagggcaaaatcgcagcttgtgcgcgaggttgcgccatggcattcaactgcctggctccaattggaggtacttgctgagccgccatggatgggtcaaaaattggctgcgacagcgtcgtggcagcttggattggtgcttggtttgttccgaagcctggagttggagcttgctgccgaacggttggtgcctgagcagcgttgacgaagtcgaactgcagtccttgattccatggcgaaactcccaggcccggctgaatcggtggcaaccaattaggcacaccttgacttgtattcccctccgggtgggccgatgggggtgtacttgaaatgcagtggggttggttgagttgctgaaggaaagcttggagttgcgcctgcaaggccgaaaccccttccgccactgtttgtggtgcttggccgggtggttgatggtgtacttgggcagcgactggttgagcttgcagttgcacgtgaggggccgaatgcactgctgcggccgattgctgcccgacgaagtacaccggcgcctgcgcggcttgtggcggaacgggctgggtcgtcgcttgcggatggacttgagatgggacataacctgccgaatactgaaggattggagccgacatggccttggcccgcctcgccgcctcgtatgcttgttgttgctcttgcatttggcgaagcatgtcttggagccgtgtcatgttctgccgcatggcttccatgtcggcttcggcttgtgctttggggtcagggctgacttgggcctgcacaacgacgggcgcagttggggccgctgccggctgcgatggagcggcttggggcaccaccagttggcttgtcgaaaggatctccctggtctggagtgcccttgccgccgcagccgccttcgccacgtcggccgcgttcggcacttgctcggaggttgcgggggccgaaggcggttgtgatggcgcttgtcctcctccatcttcggccacgggcgccaaaggctgtgctccttcctcggtggccatgtccagtccagcgtcgcttaccttccgtctggcaaccttctccttcacgaccctcttcggtggcattcgctctcagtggtttcgctcgaaggtccccacggtcggcgccagctgttgtcgaaatgacaactgcatacgtcgaaggacgtggttactcaacagtggttggaaggaaacgaagtgtattgaattttgaatttctgtcttcgaatccccctattacatggccctaggggactatttatagccccactacaagttcttgctactagggtttaggttgtacaggggaatttacatgattacccttatgaaagggacatttacaggggtacataatgttatagggactcatgggcccctgatgggccgtctggcgatcgccggccctatagcccttaggcttgatgggctggaaaagcttcctcggcccttgcgggggcgaacttgccatggcaaagtcgtcttccttcggcagatagtcttcgccttgcacccttcgcccgagacacccctggcctggcaaggcactcgtgcgactcttcgcctcacgccgttcttgctccatagccttcgccacgggtttcggcagatttggtcgaagggcctcatgccatccgccaacagctttaagatgggctaatagtaggaagtgagctctactattatccttgctctaaacttacttccctctttttcatgcgcacactttttaaattattattccctcagtcctaaaatatactccctcatttccaaaacctgagtcttatttctttttcaccaagaccaagaaacaattaattcattcactatgtgacaaaaccaatgaacatgtaaccaataagcattaaaatggcttcttggttcctatcaacaatttaatttagcacataatgactacaaataggacttagacttttgaaaaaaaaaagaatgaaataggtcttaaacttttggaaggagggagtagcaaccatttactagatgggacacgtcctagtacatagtacaatgaatctgaacatactgtccagattcattgtactcggatgtgtcctatccagtacaaagttgctatattttaggacgaagggagtatattcgtaaaggaagtagtttaggacaatgtttaagtcaaaccttgggaatataaatcaactctcaagtttgaaaatgtaaaaattatataaatatatttgtcttgaaaactactttcataaaagtatacatatatcacttttcaataaatatttttatagaaataaaatgtcaaagttgtgttttagagaccgtgtcgctgtccaaaacgacttcctttatgagtacggagggagtatgtcctttacaaaagttttctatagcaaaaaataatattgatatattttacaaaagaaaaactaatagtcctcaattaattacgtgttaatggatcgttgttaatggatcgttccattttccatacgggaaggtggaactggaacatagccttaagttgttctttacagttgtgccaatcatcctattcagtcgttctatgttctctctgtttcttagaggttactccagatggctttattttctacggtagatagagatgaagttgcaaaacaagaaagccatggggcgtgattaattgagttttagttattataaaattagaaaatcgatttatctcatattttaaaaacaacttatatatataattcaccgttttagctgtttcagaaatgtagatgaattggaggcagtatatactattaaactcgctcttaaactaataaagtgtgtttttttaaaaaaaaaagtttctacacaaaattttctataagagtcatatcaagccatttttaaatttttttaagctaatacttaattaatcatacattaatccgtcgctctctttagcatgtgaaagccaagagcaggtacaatagaaagctataaacaggccctaagagcaagtttaatagtatagctaactactagctccaattcatctatagccaatttaatagcttattcatacaatagttacatactacactattaatacctgatcccacctgtcagacacatactgtgtcttagagtccatgctacaactggctacaaatctgtagcccgctgccattctctttccttatttatcttcttaaaatatgtttatagctagtttatagcacgctattttaacttctcgaagtgtagctccatgaggcagatgcatgggtgtttcgctgcgaatccgtaggaaaggcgtcgatggaccggcgcgttcgtactcgtgaacagtgtctcgtcgctggttcggctttacgtgtactcctattaagtactactcgggtcgctgtgttgtgcccgaaagcgtgctaagcagcgggcagacgtgtcgagctatggttggaagacttggaagactgaatttgttcgtgactttcgtaggcatagtaggattggatcagtgagtgaccgcaaacgagtattacatgtgcgtggagattgattttcgtctttcaaggtctttcgcgttttatagtggagtatataatctaaattagatatcaaaatatgtttaaaagtttagtaagatagattaatatataatataccatttcacaagtatgtaagttcatatccgatctatacaattataaaaaaacaataaatttgactgtagattacgtattctatttgatattaattttatttttgtttatgtatagtataagcttaatttgaatttttcaggtttgtgaagtgatataggagtgtcacattgatatattttatatttttttataactttttaggtgacacgtaaaaatgaggatcatctcctcgagtgacgaatagactttccctttttatccctttgcatgattctcattgttttgtatagagttatatatagggtggtttactcttatacttcttagtcgtaggggcgtatctaggggtagtccctgtgggcttgggactacacctgattttggcccacaaacacctatctcttcccccgccaatagccgctcgtgcccaactctttcccgtcgttgcctcccagctccttccctcgccgcccacgctaactgcaccgccctgccgtgcggttgtgcccagctactcccccagcgccgcacgtggagaagagaggaggggagaggagagaggaagagaggtggagaggggaggggaagaagagactgacgtgcggggcccacgtgggccccacactaagtcaactgccacgtcggataaaaccggagacaaaaccgctgagggacctagttcgtactggttttctaagtcgggggatgcgttatatcggtttttttttattcaaggacgattttgtaactcgataacaagttgagggaccttcggtgtactttttccttaaaaaaaccaggcccaaacaatgaaacccaacagcccaagaggcaacttgggttgagtgcaggtggagccaccagggcgccagcgctactcccttcgaggcttcgggcttcgcttgtacaccacgccgccgccgacacccccgacaccgctttgttgtccgcgcaacgccgttgccaagtcttgtgggtctgccattcgtgactccgcgccgcaccgcaccgctcgcattcgtgggacgcctttccttgcgtcgcctcgcagcgagccagcgatggcggctggctattcgttctccagtctgtgcccctccggtactcctcctcttagaataatgtgggtcccatttacatttgtttttattttagtgccacgcaagcgccacttcgatgccatatggaagtaaacccgtcacgtaagtgtcacgtaggacaaaaccacctccgaaaccgacgagggaggtgatttactctggttttcagagaagaaggaggcgttatacccggttttccggttgagggatgttattcacacaagagcaagagatgagggaggtaaaatggacttattcctttgaaatttcagttctcttttcagcatcgagagtgggggagtctatccaaagtccaaacataataggaataagttcatctgaggtcccttaacttgtcaacaaatccgattttcgtctttcaaccgaaaaaccagatacaacgcgtccctcgactatcaaaaccggtgcagatgaggtccctcggcggttttgacggcggttttggctgacgtggcgcctacgtggctggtttgactcggtcttcatttcatgtggcattgacgtggcgcttacgtggcaattcgatccgaaaaaataataaaccccatgggccccacatgtcagcttcagccaaattaataaaaaatggtggggcccacgtgggtcccacacgtcattcccactcttcttcttcctcctcctctctccccatcttccctattctctctccaggcacgacgggaaagtcatcggcccgaggggaattggcaccaccaccaccaggcgacggtgatcccggaggagagcacctaccacacaccgccgcacatccctcctccatcggcagcagctggggatactgtcagccaccggcggcgcacgcggcgagtgcaggggcacggtgggtcagcgtccggcgaggtgcactgacgcgtgctcgccgggagagggtacatcagctactagtctttgcgccgagacagcgtcccgtgctctcgtcgtgacgccagctactacaactgccgccccggcgcctccgccaacccctaccactgcggctgctcccgcatctcccactgcccgcggctgatctcctcctccgccgccgccgaatccaccggggaagatggcattgtcatcgtcgtcgccggtgtagtaaactagtaatcgagctgttgttcttgtgttcttgcagtgccactcctacctctactaattagctactactgttaatattcctttgtttgatttgttgctgctaatccggccaccaagcgctctctctatctctctctctctgcttcattagctccccgtggcagcgatggcggctcagaggaggctgctcgccgaggcgcctccgtaccagccgcactcctcgcggcaccagcagggcgcactagggcaccatctgccgccggcttcatggggtggttgatggtgggcatgaagccggtgatgacatagcgggtctcgtcggagcagcggacaatggcgacctcctcgttgcggaagggggagacgcgcgggtttggtagccgccggagcggaaggagtcgtaggattcgatgccccggtggagctcatcgtaggggtgcggcacgcggaggagggctacattggcgtgcgtgctgatgactcggggatcgacagtgaaccggtaggcctcgccgccggcgggagatgaagaggggggagatggagagaggagaggtgtgagaatgacatggggacccatgtgggccccactatttttttattaacttgtatgttaaactgacaggtgggtcccatagggtttattattatttttggatagaattaccacgtaagcgccacgtcaataccacgtcaaatgaagaccgagtcaaaccggccacgtaggtgccacatcagccaaaaccaccgtcaaaaccatcgagggacctcatctgcaccacttttgatagttaagggatgcattgtatctggtttttcggttgaaggacaaaaatcgaattcgttgacaagttaagggacctcagatgaacttattccaacataataatcatcgttaagaggaaagccctggttcggcccggcacggcccagccctacaatccctcccaactcccgtgattctcacaggatcggttgctccgtcgtgggcgccgccgtcggcgccgagaaggacgcggcgtggacccagagcagcgacgccacggagacgaagaccaccgaccagagcacggcgatggtcggcggcgcccggtctcgcggcgccaggagcccccggaggaatccctgaaggtgcgccaccacccacccggcgagcgccagcttcgcgccgagcgcgccccacgactggtagtacccgtggtccaccccgtacgccaccgccgccaccaccccggcgaggttcgccaccaccacgctcgtcggcgccaccaacaggttcgtccaccgcatcgtaatctccgatgccaatgctgcctcctcttccccgtcatcgtttcctgccgccggtcgcttgggtggcgaagctgccgtctccgtggagaaggcgacgtcgatcccggtgcacgcgctgaggatgccctggaacacggcggcgaggctcgccgatgtggcggtgaccatccagagcttctcgtctcgccaccacgcccgcagtggcacgcggctccacctcagctcgagcgcgaccgacgcggccacggagaagagcagcaggatgaggaggacgccgtcgtagtagctcacgtcgctggggaacgtggacaagccggtgaagaggcagacggccgggagcgcgcagtaaacggtgaacggaagggaggcgagcgggtaggaggcgcgggccacgtagcccagccgctgcaggagcccgaggcggcggccagcccagacggggctgtgccgccggctcagcaggatccccatggccgccaccgctcgccgcgacgcccccgcgaggacgtccgcggggctggcgcgcgcgtaccgcctgaacgccggcctcgccggcgagcagtacgccgacgaccacccgcgcgcgtgcatccggaaccccgtcgcgacaccgccgccgtacatccatccaatctgcacgagaacaacgacatcaacatcatcatgggagcggaaggcgaagtgatcatcggcgaagctgccacctctttgccccatctcgtcctctcctcgaacgcgcagctgacgacatggatggcctccttgaggagagatcgcgctggcgccacggtcgcgtcaggcgagccaccgtcgccgccgcgtcgccgcccttgctcctcgaacgccgaggcgatgaacgcgggagactggccgaagtggcgctccagcgcggcgcggtacgcgcgcagcctcctcctcctccccgccgcctcctcctcctcctgttcgtcggagtcatcctccgagtccagcaacggcacggcggacatggacctcctcatcgcgttcatcctcttccccctcccgaagcagcacatcctcctccagtccgccgccgtatccatgtcgtcgccgtcgtcagccgccgccgcgggctcgaacccgtacagcgccttccggctgaagcagcaaccggaaccgacgtacaccgggccctggatgccatcgaggcatttcatctcgatctgaaccagatcgagcagcaagaatcagcgaggttacgcaattcagcaacatggacatttcgtctcttacatcgaagaagacggagtcgccgccgccgctgtcgcgcagtgcgaactggacgaagcacgtcctgttcccggcgaccgggtccatcataaagcacatcgcctctctcagcgcgctgctgttgttgacgcagtggtcgcagtccaggttgaggacgtaggcgccattggtaagcacggcggataccctgagctgcaccgatcaaaccaaaattcacatcgcaaccagatcaacgccatggacaggcaggcaggcagtgtcgcaacgcaccagcgcgttcatggcgccggctttgccgtggtgccggaaacccggtcgcttctcccgcgacacgtagaagagacgcgggagctcgccgccgtcgacgtcgcggtcgccggggtgacccaggagcacctggagagacgaaccagcttgatcaaaatggtgacaagcgctcgagagaagaggcggggaattttatggagaggtttttttgatcgatcacctgaatcatggcagggtgatcccgcgagttgttccccggccacggcgtgccgtccgacatgatccatccttcctccggcaccttgcgcgccctcgcggcgaggtggttcatcctcaccttgaattcctcgtactccctctgcaacaacggcgacggattcatcgatgcgtgcatgcctacaaggtgttcggcggtatcgcctcaccccaccttcatggcacggcggtccttgacgaaggacggcgcggcccggtcgcggaggtagtcgacgccgcgggcgaagtagagctcgggggccctcggctccacgccgtggcggcggcagaaggggatccaccgcctcgcgaagcccgccgcctcgaagagcgactcgaacaccagcatgtcggcgccgtcgtcgtggacgtagcaggcgacgccgcccgccgggtagtccgccgcgagcaccgacagcacggtgttcgccgtcgccagcgggggctccctcgccgcgtccgccgcggcgacgaacacgtccacgcccgccagccgcgacgcctccccgcccttctcgtacctgcatgggcaggaggagtctctgtctcagtgtcttgcctcacatggccgccggccatggcgatcgagatgaccttgaggccagcctgtcgaggtacgtgacgcggttggccggggagagcttcgggagctgggcgatcagccatgacgcggcgagccagagctcgcacgcgacggacgtcacccacagcgcgtgggcgtcggcgacggggcgggtgacgcggtagcggaagaaggcggcgaggaggacgagccggagcgcgacggcggcgcggtacaggttgagctcgccggacggtacggacagcctgctgctgagaggctcaggtatgtcatggtcatcaccactgcaaaaacacaaaccccaaaaatttcatcaattttttttcgcttccaatcttaatgaccatgttactaatttgattacccattttcagaattggttatgaaccattagcatggatatggtttagcattgtggggattgatgctataactgataacattttcagttgttacctttctgaagatgcaggctcaggatcagggcattctacaggcattatctctgggctctctccatccatctcggagctaacaggtaacacaattcagcaaaacacttgattcagtttttactctatctacaaagtcatctcaatagcgtaagtttggatgctactaagagtctaagaccagacaaaactctcttaaaaatggtatctgtataactgtaccgtggtgtcaaacccaatccaaccctaaatggctaaatcatatatagtggttatgttttaactatccaactagacgtgacaaaatgccgtattaataacttcctgcgatgattgcaaggcagcctcggtgaaagaaacaacttagctagacaagcaaactgcctctgtgcagtatcgccaagtaacagacaacgtggataatacagaggatgaattcgtagtacagacaacgtggataatacagaggatgaattcgttatgtacgtgctgaggaagcgaggaatcaggggaggcagtatctattgattctctcctgtaatttttactgatgtatataaagagtgagctatattgaagcctaatgacaaaaaaaaacacatactacctccgttttttaaatagatgacgccgttgactttttctcacatgtttgatcattcgttttattcaaaaaatttatgcaaatgtataaaatataaatcacacttaaaatattatgagtggtaaagcaactcataacaaaataaattataattacataaatttttttgaataagatgaatggtcaaatatgtgagaaaaagttaacggcgtcatctattaaaaaacggagggagtacaccacagatgcttagacagaatggtattcttatttcttaccggtgtttgtgcagggacaaacctgatcgacttacaagcggaacaatccggtgcttaatcttcgatctcttacaggtaaatacaaatcatatagggaaacatagaaaattaaatccgatgcgatcatgcgagctctgaaagaagttgcatttccatcatgcattacactcacataatcacattcctactgaataccggctactgttcttcaacaatataccgtactgacactgtcatcttcaacagtagacgtttgtgcgcaccatttgacggccggaatggcggaattacatacatttattacacttttgcagggctcggccaatccgccaataggaggtagacatggaaacaattatatgccttccagagttgattcgagaaggcataaataggtaagttcatttgtctcgatctggctagcactaacgagtacttattcaggtgcatagccaagaatggttgtatttaatgtagtaattaattttatctaagaaactacaaatcaatcaaaagggagcagcttccctttgagtcttagttgtgactctgccaaatggagctagccaagctaacaaaattaatcgaactccagattccagactacagattgcggttactagctgtctccgccggcactgctgtctggccctcttctgtttgctgttgtgttcttcagcacctggaaataacacatgaagttaaacatatgtcatctcagcatttactagcacaattatataatcttcagatacccttctataggcagcttttctttttttctgcagtctgattctcgtatcatgtactatttatgtatatatatatatcaggggtgttagttgacaggaagcttaattacaaggttatcaacataattaaaattatgtcaactgtcaattaagtgtgtatatatgaagagctgatcagaattcagaattatgcatatgcacatgtctgcttcgaaatacagttttattacctgcctaagcatctggttctcgttttgcagggtagagagcctctcctccagctctgagttgctcctctccaggtccttcaccctcgcctccagctcactcatgtacgccttcttcctctcccgagcctgctgcgctgacacccggttcctcagcaatctagtggattaattcccaaacgcccgccacaaaattaaggtcttatagaattaatttgcgagtgtgtatgattgagaacaaattatatggtgttctatatgcatgggcagtcaaaaatagatgtattacctctagtcacaaaagtatgccattttagtacttgtgtaggcaacacaagttagctttgatcataattattattttttctaaaattttagcttacagacatatgaagacaataattaaggtagccaactttgtcctagcacaaggattaaatattcaaattatgccttgttgatttagagaagtccaaaatgtctttcttttgcaaccaccaggagtaacattctaagatgtttttttaatcggaaaataaatggtttgattctttgggtagcagtgatttgttattggtacctttatgtagacatagagttaaaataacaagtaatacaaaaatatggtactagtaatacagaagtacatgtgattggatatggttctatattataatattattcaatcaaataaagataaacgtgagttaattaacttgaaaataattatttgcatatcagagtcaataactcaatatagcttgtgtaataatatcaattttgaaatgcattagaataaatatgtagcttggattcaaatgtatatataaaattacacccatcctattttcacacctacagatatatggcacaagttccatgtgtcaaagaatttgcattttgcataaaggtcaacatatatcatgattggaataacatcaccatatgctaaagtactgctaacgaaccttcccccatagacctgaaagtgttgggcccatttgtccaatataggacatagataatcttcacatgtagattcgctcgagtacaaagcatcgaacatcaaacaacttgtcccaaattgttggaatattgttaataagtttgtgtcacatcagaatctttatcatatgttaacatgtcagctgtttaaatggttggtttatactatgccaaatttgaaaggatacaaatggaaacatcccaatttgatttgttggttattacattttctaagaaaatgtctgtatacaaaatagaattttacaaatttggcatgtacagtttacatggcatataatatatgtactccttccggttataaatatacatcgccgtttgaatttttttgtcaaacctttaaaattttgactaccaataaattttaaaatacgtaatgcatcgatttgtcttcaaaagtaatttcataattaatctcttaaacttgctagatttaataaaaatattttaatgaaaaatagtcaatgtcgtgcatcgaagaccgataggaagcttaatgatatatatttgtgacctaagtgatcgagcattagacttctgatgggagattaatcaatattcatagtaatttttttctaaaacagtagaaatactcaagcaactgagcaaaaactagccttctagacccctaattaatcagtatatatacaggagttctctgaataaaaagggacgtggcgtacagtacaaatgtacaatacacatataaggactactccatccgtcccataatataagagattttgactttttgctacattgtttgatcactcgtcttattaaaaaaattgtgcaaatataaaaaataaaagttgtgtttaaagtactttggataataaagtaagacacaaataaaataaataataattctaaaattttttaaataagacaaattatcaaacagtgtaagaaaaagttaaaacccctttatattataggaagaatggagtaattaacatgacgtacgtatatatacagtacacatacgaagtggaggcctacactacacaccttttgaggcgccggtgctccttgtcggcggggctgcgtccgcggcggcgcccgctgctgctgctgccggcgacgccggcctgcgccgcgggcgacgacgacgacgtcccggccgccgtcgccgccgcgtcacctgcaacccgaacactacctctgcccgacgtcgacgtccccggcagcgccagcccgaactccggcaccctccctactatctcctcgtcgtcgctatccacccctgccaacgagatcgatcgctagatcaaaaaaatctgcataattaattaagatcgagacaacaagcgacagccatggcgatcgaattggtgatcatcgatcgatcaagaacacacacaaaaaaaaaaataaatcgagacatgacgatgagagatcgagcgtgtgcgtgccttccttgccgtcgtcggtgtttggggcggagtccgacgacctctcgctgctggaggcggccgccggcggcgagctcctccggtgatctcgttgcattctcttccctcgctgtccagcttatcccactcgctatcagtctatatgcagacactagctagctcgatcgctcgatcgatcgtctgggagctgagatagcaagcaagctagatagcagggaactagtaattgtgggcacgtttctctgtcccctggtgtgtctcactggattcttgttttgtttgattcgagtaagtaaggggggtatagcacagtgcctgtgcgtccggacatggccactctttttgtcgaaaacaggcatatggaacatgggacatttagcagcccaacccctgtcatttccatgtattacatacaagtgctcactacttttaccttttctttttcaagtgacaaagaagacgcacacacgcacatccacgaattcgcgaccttaacactcgctttaagagagaggtcgttgtcacatacaaattttgtatatatatactggttcaaatctactgctctaaattgcttttttttaatcatcaacgttggtaaaagatccaggggtctttcatgcaatgatgtaaacatatgtttttcttgaactggggatttttttttttgtgttaacaagtaatctactctcttgagtacgtatactacggccggtgtggtgcaaggtctgctctggcaaagctgaatatgcaaataataacatgtttttcacttgcgtcttcacagggcatttgtggagatcgatcagaattcatctttcatctattcagtgatagatcgcgagattcttcaaccccctgctaccaattctgagtttgtgttcaaggcattctatctcctttgtttctggcgcggtggcgcctatgaaatcatcgacatgacaatgtattccacggagaaccttcatcaatccaaaagattttgagattatctgtgtggaagatgcaactctttggatagcaagaaagaatataagagagcacgatgtagtttcgcattggaaagaactcttctccaccttcatttgtaatccttaaaagacaataattctgttaattttggtaatggaagttttaaggtgggggaaagtctctcccccgtctaccttttgaaaaaaaacatactacctctgttttttaaataaataacgtaattgacttttgaacatagtatgatcatttatcttattaatgtaactagctgggtggtccgcgcaattgcgcggctagcacccatataaaattatatatttttaatatgattttacttaaaatttattaaatagttatctcattgtcttaaatttttttagacaaaaccttaccatccctgtgtttctaattttatagtttttcaaagacacatcagttgctacccttacttctgtcatattattttttttattatcttgctcgatctactactgtttctattcattctccttggaacctttaaaaattagatctaaaaacttatagttttagagtttattgttctgttgggcttcttttttataataatttctaaaagtcctatcaaacgctgccattatactcctctacaaccatccactgcatcttctctttattgtcattgctattttaaaattcgaacataattatcgtttaggttcgtgtttttactttctagaagttctgctaaaagtcagggactttgtcactatactcctctacggttcgcccgctgccgcccttctttcttgtcattgagattttaaaattaagcatgattaccattgggatttatttttttactttttaaaagcccgaacctttaaaaattaaaccttatagtttttagagttttattgtctcgttgggtttatgctttttataatttttagaaatcccgtcaaacactgccactatactcctctacgacccgtccgctgcataatctttattgtcattgggattgtaaaaatcgaacataactaccattggaattcattttttactttctagaagacccaccaaccatcggcggctctaccattgtacttctatacgacccgctgcctctcttttttattgtaattgagaatttaaaaattaaatatgattattattggggtttattattttactttctagaagtcccccgccaaccgctttgactgattgcttcacgacctgcccgtcgtccttccttttaatcgtcatttggattctatttggtgttttattaatatattttagatgtctcatcaaccgccaccactctatttctctataggcttgttacttaattaatctcgtgatggtcttttctttcaatagtcttatttttattaccaattttagctatttataaattgtattcctaattgaaatattttttttctttttctaatttcagaatttattttatttattattatgttcttttgatatttttattttttattttcaattttagttgtttcaaatttatattcatactttaactctctttttaatttgcctaatttcggattttattttattctttattaagaattttaattaatctactatttggttcttatatgtactcttatttcaatattgcttatatttaattccgaatttaagttaattttaaattatattcctacttgaactcttattttcttttcttttttctaattttgatttttttattctgaattttaattaatctcgtattggattgttgtatggactcttcttttaaccttatttttaactccattttagttatttataaattgtattcctagtcgaactcttcttttttctttttctaattttgaaatttatttttttattattccgaattttaattaatcacgtattgggttcctatatggactcctctttccatattgcatatttttaattccgaatttcagctatttttatattgtatttctaattggactcttcttttctttttcttcgattaatgtgggaatttctaacctccacagcgaacgtggtgtctcctttcaaggctgttttaataatataatagatagatagatagatagatagatagatagatagatagatagattattatttatttttatgtgagttgttttatcactaaaattactttaaacataatttatatcttatatatttatataaaatttgtgaataatatgaatggtcaaaatcaatggtgccatctatttaaaaaaggagggagtatgaaattgtcaaatactcctactttacttattaggatgcattgcgtatagtactccatataacatcaatttgcaagaagtgaatggggtcaagtgaaaaaagggcagccctttttgtaagatccaccctggcgttcccatgccgagagggactccatccaaaccggtcgatcggacggccc

SEQ ID NO: 5490 - DNA, 3636 bp, Oryza sativa
acgttgatcgtgattggattccacgactgcagcctgcagaaacttttctactgcagatgattattactcccttcgtactcgcaaaggaaatcattttggacagcgatacggttttcaaaacacaactttaacttcttatttctataaaaatatttattaaaaagtgatatacttcctccgtccaaaaaaaggcaaaccctgggttttcgtgtccaacgtttgactgtccgtcttatatgaattttttttataattagtattttcattattgttagatgataaaacatgattaatactttatgcgtgacttgtctttttaatttttttcataattttttcaaataagacggacggtcaaacattgaacacggaaacccagggtttatctttttttttggacggagggagtatgtatacttttatgaaagcacttttcaagacaaatctattcatatgatttttatatgatttttacatttttaaactcaatatcttgagagttattcatgatttatattcataaggtttgacttaaacattatcctaaacgacttctcttacaaaaatattgcaatttctatcctaaacaatgaatctggatacaatggatataggttattcattatcctctatgctaggttataacatttcgggatggagatagcatcgtagaaagacgagtcgaatatttctcagtgtgaattttctacgaaaatcatgagaacgatgtttaaaagatgacattaaaattatgcgagattaactattctggccgtgttcatccggttaggatgtagagtctgaatttttagtccatttaaaaaaattaagaaagaattattggcatcgtgataatgataaggtcatgggcaccatctgaatttaaatctcgacatcaatattgcgcgtgagtagatatataggagtacgtgaggctaggatttttattggtctgtctttatttaagtgtgttaatatctgagagatgcatttaaggcgacgatctaagaagtgtttgggctgagctattcaacggtattcaacggtatgtgatacaagataaaccattaacccatgattaattaaatattaactattataaatttaaaatatatatgtatttaacttttaaaagtaatcaatatataaagtttatgcaaaaatacatatatgtagtcatttctataaattttgatatagaaatttgattttggtataggagtaccaaataacagtttggcaagcatacaagtgagaatgtaacacctcaacagcccaaacaaacagcacccttagaccatctccaaccctccatgtcatctagtttccatgatattaaatacattgccacataagtaaaaatcctatgtggcaagggagttaatgaggagagaggaaaaaaaatgaagaaaccatttctcatggaagaaaccatctctacacaagaaccaagaataaaaacaagatgatatgtggataaaaggagagagaagagagataattggataagaatttaatttgaagacaccatctattgaatacatagtttctacacatagtgtctatatgacatggcaagtatgaaaactactttatagtttctgggttgggaatggccttaggtatgtcgtgtacatgtagcgatttgcgcgccttacgtgggatggaaaataaatcctgatgttagactgtcagcaaacatgataatttcggactagctatttatcgacaacttttccctagtcggtacattccattagggactaactatacatattgataaattttctcttaaaattttattagatgtaaatatattacaatcatactatggccatgtttagttcctccaaaaatttttgacgtatacggacacacatttgaaatactaaacgtagactaataaaaaaaaattacagattccgcctgtaaactgcgagacgaatttattaagcctaattaatccgtcattagtaaatgtttactgtatcaccacattgtcaaatcatggcgtaattaggctcaaaagattcgtctcgtaatttacatgcaaactgtgcaattggtttttttcgtccacatttaatgcttgatacatgtgtccaaacatttgatgtgacggaatttttggaagtttgaagggaactaaacacaacctataatacattttaacttgcatgtaaatacaataaaatttatatataacattaatccaaactttcaatctaattatagttgcaaattataaagttactagcaaaatgcccatgcttcgctacgggtaaaggaacggttaaattctatgaagtacatcgttaacatgtatataataatgttccaatataggcaaattgttcattgcgttaatgataatcaagatggataaaaatattcctgtttagctcgcatcgcgaaagaaaaaattaaattaaaacatattaaattctaatttaatgaaatataattttttttgcaatattaattacactctttgaaattatagcaaaagtgctagtgctttgcaacgggaagtgtatagaccagaaaattgaggaaaagttaagaaaaatctacactatgtaattaattaaaatacaaattttctaaaatatttaatattttaagtaggtaggtgtaaaactaaattaattgacaagtaaagtaagtgtgagaaataaaatgacatggttaagtaagtgtgagaaataaaatgatatggttcaatttaattttattaaattcttcatgattagttatgctctttggaattttatttaaattttcagagcttaattgctatttttaataatacaaacatcatttaacaattatttaattggaaaaaagaataaaaatcctcccttttaggtttgggccgaatatggcaaagtttatattacctcccttttgcctatcctatgtatctggactattctttctccgttgaagttcattttacgtcctcatgcaaacacgcggtccattcagcggcccactaatgtggtggcccaataggccgacggcccgatgcgggagcagctggagccgtccgatcgaatgaacggtctagattgatcctaacctaaataaatacccaaaacctaaccctagaatacattcccccctccctcccccccggcaccaccctcccccgcgagcggcggcgtcggcggcggaggcgctgtaggaacgagatgtcgactagagggggggtgaataggcgatttaaaactaaatgacacctaatcaaaactaacctaagttgctaggcttggtgaggatcaattctaactaagcaactaagttatgttttgcaaacctagggtgatagtggctcaattatatctctaggaaagtaaatcactcctatgtcaatgtttagcaatcctagggtgatatgatctcaagtttatctctagaaaagtaaattgcacaaatgtaaatgcgacaatcaaatgagagaaggagacaagagatttttcaccgaggttcggaaactcaccggtttactactccccgttgaggcgagcccaactccaccgctcaaccacgaagccaccgcacgcccccttcgtcaaggggtgggcaaggcgaaagctggcccacggagaggactacccaagcctcgatcaccag

SEQ ID NO: 5491 - DNA, 17491 bp, Oryza sativa
ccctttaacacactagatggatgaacacaaagctcaagtgagtgtgagagaggtgcaaggggtgtatgcaattgaattgggtgccaagagagctcccttgctgctggtgggggagtatttatactcccacccaccaaaactagccgttgggggcgaaatcccccaactttgtgctctgccggtctgatcgaaggtatgtggccggtcagaccgtgctactctgcaacggctagaaaactagccgttgaaatgctgtcagagggccccatcggcctggccggtcagaccggcgtagagtgggcggtcagaccggcctcggctcggtcagaccgccatcggctcggtctgaccgactacggctccgccggctctgtatcggccatcccgcgcagcatcatctcggcctctagggggccggtctgaccgctcatgtgctgccggtcagaccggccctatgcgacggtcagaccgccgtcttgcggccggtcagaccggccatggcacgccggtcagaccgccactatgtggccggtctgatcgtccctggtcaggtcgaacccagtgaatttgcaagtgaatgtgtgtgtgatgaaaaagagaacacaaatgaaaatacaatgacctaatgtggcaattcaatcatctctatgctaggtcattacccctcttaatagtacggcgaaactagaaaataaactagcaattttgatcgccctacacctcgatcaattctaaactaaagcactagttttaccgtcttctttctctttgctttgcgtcgtcaattttaatccatcgataatcatcgatgcgcacatatgacgtggacctaacttaaaatgtatagctcaaagacaacggttagtccataattagcgcttgtcattaattaccaaaattaacaccgggggcctagatgcttcaatctccccctttttggtaattgatgacaaacaccacaaatatatataatcaaacatagagcacatggacatatattgcattgacaagcaaaagctccccctaaacatatggataacaaacacaaatatcaaatatggagccaatgcacatttcaatttcacatttcaacatagcacaacacatatgcaaattataatgtgaacttcacatatgaatcaaccgaatgcataagatggtcacaagtatatcaatgtcacaccaaccatccatcatagcacaagttcacatcaagaccacataaagggctcacaaataaatgtaggctattacaagaccacgaagggtccaaatgacatagagagtttaacaaaacaacaaataacacacaagatagagtaatagcccatactcatacaaaatatagcccaatcctccttaacctattaaatatgaggtgactaacctcactactactagtcccaacccaacaaaacataaaacacacttttctcccccttttggcatcaagcaccaaaaaggtcttcactcgtggggaggagaaggaggacgcgccgaagtggaaggatgagaagcatcacgacgacgatgatacacaaatgcttgggagctctccaacatttggactcgagaatccaatgtacccactcgagtgtgcaatctccccacagaagcattcaagtctccaacgtccgtgcgcaagccacgaacatcctcatgcaaagtttcatgcccggtagacaagcgttgaatgctttcacttagggtattaatagccccaagtaccgggttgaagtattcgttggattgcattccaaaataggcatactgcggatgaaagaagacatttggatcatacccatgaggaggaggaggtgctgaacttgagctagctccaggatgagaggagggcgccgtcctaggagcacggggagctccaggctgaaggcggggcttgtactgcttgtgcttcttcaaatttggcccagcagccccaagcttgtcttgaatcaatctcatgatgtaaggggcataatagataccctgagtgaaggtccccttagagatggcaatctcttgcatcatgagagtcacagtgtcgaactgacggccctgaatgatggcatcgataacgtgccaagccacccccctaatgtcattattgttacccaggcgagggaggatggtagctctcacaatcctgttaaccacactcgggatggttctcaagccggcaaccttcccatgtgtgtaccgcgctccatcttcataaaactgagagaggtagtccatggagagcggattatgggtgtgctcctcatgcaagtcatctccaaagtccaagcgaacattgaggagccgccggaattgcctcctagagatagaacactggagggtgtcggacatccacttcatctcacaatagtccccggccacccacactgtagcataaaactgccggatcaaatcttcattataatcttgcttaagagtcacaatccggtcaatgccaacagtcctgaagagatcctgcaagccttcaaactctggagtctcattaatgtctctccaagagatccacttatgttctgcaaaagctttccctgcatagacttgctcatacacacttttctggaaagcggtgtgaaaacggggattcggggtgtcccgaggcctcaaaaactgatgatggtgcctcaagatggtatactgtgatggattccgcatgttcacaacacactggatggagggatcaatgttcatctcatcacttccttcatcctcatcctctccacttccactgtcatcatctccactttcatcctcgctagccccctcaacattggcctcaacctcttcatcactttgagcgtaatcctctccgctcgattcctcaggctcactcacgggatccggagtgggcgcacgacgaccatgacgagtgcggggaggcatcactgaaaaaacaggagcaaaggatatataagcaataattttagaaaccacatagtgaagtgggaggaaggggagtgctgcctgtcaggggcggtcagaccgagagccacggccagtcagaccgcatgcccaaagtcggttagaccgacgtctcaaggccggtcagatcgccagcactaggccggtcagaccgcctctgacagtagtacaaccgaatccttccacaatccactcaaatgattctaaaaattgctaggacagtgttgcacaagattggaacatgaacatcaaggtgtaggactatttcatcaagattgaagcaatgggggaaactatccttaaccctagagattgaaatagaccgatttgagagcaatgcacaagagggagagagatttaccggttgaaggagttgaatcacaccaagaaactaccctctattggtgcaaatcgaagaacacctcttccttcacctagggttccatgccatggatcacaaactcaataaaaactcaaatcaatccatagaatagagagaggaagaggaggaaattcacttacggtataaccggagtgattttgacgattgaaccggatggagttggtggagggaggtggatagggtttgggagaggagagaggagaagaaatttcgagttggagaagtgaagagatgagatgggatgaagaggggtcgggtagaaggaggaggaggaagaaaggacaaagtcctgggcccaccatcccaggccggtcagaccggctatatgcggccggtcagaccgccggggtgctgccggtcagaccgggcccaagaagccggtcagaccgcgcatatagcgccggtcagaccgcctggcccccagccgactgtgcacagcccttgcacagttcggctacccccacacaataaaattcaacaaaaaaaatttgattttttggagcaattttgaaatgtgtgagttgaaatattgccaaccattcataatatttgaaatttatgaagatttgcaacaaaactcacttgagtgctaggaggtgaccttttatggtctataggggttttttttgggcgaatttgattttcaaacaacttttgaaatatttggtttttgaatatgatttgaataccaaaaacatttcaaatcctcctctctaccaattttattttgaaacttttctcaaattccttctcaaactcattttggggtttaatctcattttggccaaaaacaagaatatagtttcttcaaaagagagccaaaatgacattttcattcaaaaattatttttcttgcaatatgaggcttggaaaacatataaggacccttttgaaacattttccaagagatagttttccaattacattgattttgcaaaagttttgacttatgttgacttgggcattttgaaaatactactaacatcactagttgatttgctcacatataaaaggaagtagaacacatgcaagagtgcaaaactcccccttaatgtgacatgctccattttcgcaatgaagaatcaaatggcaataaatccaaagcataagagcaaataggagcaaatatacaatatgcaaaagaagcaactatggtgcaccatctcaagccacattagagaagtctatgacatttaactcattcctcaacttgcaaaagcgggtttcatcaagaggcttggtaaagatgtcggctagttgatcctcggttcttatgtggctaatgactatgtcacacttggcaacatggtctcttaggaagtgatggcgtatgtcaatatgcttggttctagaatgttggactgggttatttgctatctttatggcactatcattgtcacataggagtggggttttggtgaaggatatgccataatccaacaaggtttgtttcatccaaagcaattgggcacaacaattacctgccgaaacatattccgcctcggcggtagagagggctacggagttttgtttcttggatgaccatgacacaagggatctaccaagcatttggcaactaccggatgtgctatttctatccactttgcaaccggcataatccgaattggaatagccaacaaacttaatttttgcaccttttgggtaccacaagccaatagtagaggaatgctttaaatatcttagaatacttttcacggccactaagtgacactccttaggagcggcttgaaaccgtgcacacatgcaaacactaaacatgatatccggcctagatgcggtaagataaagcaagctaccaatcatagaacgataaagctttaaatctaccggtttacctccctcatcaaggtcgagatgcccgttggttgccataggtgtcttgatgggcttcgcatcctccaagccaaatctcttgagtagatccttgatatacttggtttggctcacgaacgtcccatccttgagttgcttgatttgaagtgcaaggaagaagctcaactctccaatcatggacatctcaaattccctagacatcatatcaccaaattccttgcaaaatacctcactagtagaaccgaatatgatgtcatcaacataaatttgacacacaaagaaatcatcaccaatgatttttgtgaaaagagtggtgtcaacttttccaattttgaaatcctttgaaaataaaaaatctctcaatctttcatactgacggagctcgtggctcctcaccgggagaccgcgcaggcccccctttgccggttcggccgggggcttagggtgagatctcaagctctctctctctctctgtatatggaaagatcacccgcccgcaagacacacgagacacggcgatgtatacaggttcgggccgccgcgaagcgtaataccctactcctgtgtttttgtggatttgtgtatggacaagttacaaaggattaactccctttcccctcagccttccaaaagggaaaaaatcctcctctaaatgggcaaggtcctccttttatatcttaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtacatcagaccgccagtcgccacctaacccgtgatctgaccggtctgtgactggtcacagaccggataaaggaacgcgctgtactgcgctgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccctcgggggaaatcaggaggagggcggacacctcaccctcgggcccgacgtccccgaaggtgccaggccacgtcggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagattggtctcgcccggagatacggtagcgccgcttcggtcggcgagcgtaattaacgtgcgcacgatacaatccatttcgattgccacaaccgcatatccacttcatgcgccgtaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttcttaatcatctcttcctccaccgccatggcacggggctctgctctgctcgacggcagtgtactaccgccttcccgcatcgtgagcgagaggcacgccggactgccgcgccgcttcatgccggagtccgccaccggtcgggagatagtgatgctgggcgaggggcgcccggcaccagactacccgaggcggtccatcttcttcctccccttcgcaatggctgggctggtcccgccattttcttctttcttcatggatgtcctggagtcctacgatctccagatggcgcacctcacccctaatgcggtgatgacattggccatcttcgcgcacctgtgcgagatgttcattggggtgcgcccctctcttcagctgttccggtggttcttcaccgtgcagtcggtgtcaccgccgtcggcggttggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgtcgccggattgcgccgctccaacggcgcgcccggagcgcctgggagtacactgggcctgaagactacatgcggacccaccagggagccagatgggattgggctcccgaggacttcaagatcgtggtccaaagggtgctgaatcttagctccgtggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagttgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccggggaaacctgatttcccctccaaggtggtcattcaaccgaccccctcgcaggttcgtctcactctcattgcaaccatctttctcccaaaaggaagttttttcttactcattttgttcgtcttctggttttttcttctgcttcagcgatgtcccgtcgcattcctcccgccaccccaagtccggccagtccgaggccgaagatcctgcggccgcggaggagcggaggcgagaatctgaccggcgtgaagccgtagaccgccttcgggaagctgaagaggccgcccgggaggccgcccggattcgccaagcggaggaagctgctcgggaggaggccgcccgggctgaggaagccgctaaggaggaggccgcccgggctcgccaggctgaggcaacagctgctgctggcgcgtcaactgggcccactccttcgggcaaccctcaggcgacagcctccggggaggctcgcgacgaggccgcgggcacatcgcctgggcccacctccccgggcgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctggatgggtttagcgcccaagtggaggccctgcgcgcggaacgagcggagctcgaggccgcatgggcacgcgttgaggaggggcggcgctcggtggacgccatggtggaggtgggccgtaaagctcaccgccgtcacgtctcggagcttgaagcccggaaggcggcgctgacggagatcgctcgtgaggtggaggaggagcgagcggccgccctcatcgctaccaccacgatgattgcggcgcaagacgccctccgccttcaaaacgccagccgggaggcggagctgaaagaaaagctcgacgccgcccagggagtccttgactccgccgctgcccgagagcggcgggtaacagagactgaggcggcgtcccggcggcgcgaggagtcccttgaggcccgtgctatggcgctggaagaacacgccggcgccgtggagaaaggcttgacgggccgcgaggccgccgctactctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcattggagcagcgggctgctgacctcgaggcgcgggaaaaggagctggacgcgagggcgcatatcggtggggcggccgcgggcgaaagcgacttagccgcccgcctcgcagctgccgaacacaccgtcgccgatatgcagcgagcgctggactcctccaccggggaggccgaggcccttcgcttggcgggcgagattgggctcgacatgctttgggatgcggtctcccgcctgaagcgcgccggtcggcaagcgggcctctggaaaggccagacgacggtgccccccaccaatctggaaggcctcgctccgcacctcaacaggatggcctgggttctcgaacaactccccgaggagcttgagaagaccatcaagtcatcctcgagggacctcgcgcggggagcggtcgaactcgtgctggcgagttaccaggcccgggaccccaacttctctccatggatagcgctggaggagttcccccccccgggaccgaggacgatgcgcgcgcgcgggtccgggatgccgccaaccacatcgtccaaagcttcgaggggtcggcccctcggctcgcgttcgcccccagctccgacgaggagggcgacgccagcggtgaggatgacggtggcgacgaggccggcgacccgggcacattggaatgagcccccaggcccccgccaatctccaattttttctttttctttcttctttttgtatagatcaacttaatctgcaatcaaaaatgatgaaaaatttcttatgttaactttattttgctatgcatatgagttgaggatgatttgtgccgtggtccttttgcatcttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggtaaggttgagcacgagtgaccttatttcaagttaagattcttcagaaggaaaaacggcacagacacaacctttaggaaactgaaactgcttttattgaaatgctgaaataagaaaagtaaggctgtgcatgtgtggtagcccccggctaaccctgcacacccgaggggggtgcggggttagcccgagcccaaaacctgacacccgacccccctcctcaggggtagaagcgacgaaggtgttcgatgttccacgggtttggcagctcagtgccgtcgcccgtggccagccgtacggagcccggccgggggacaccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgtggctcggagggccgcgcgccgccttcgctcttccaagtagtcgaggtcatctctacgaagctgatcttgatcagcctcgcagtacatggtggtccgaggagacctcagggtgagctcggatgggagaaccgcttctgcgccgtagacgaggaagaaaggcgtttccccggtcgctcggcttggtgtggttcggtttgcccagagcaccgctggtaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataattcggttaggcactccaaaacgggccgtgatgcccttaatgaatttaagagcagagtgcttatcgatcttgacaaccggataagcctcgggccacttagtgaacttgtcgatcgcaacatacagatactcaaacccgctcggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggctcatccgtctcccctaaggggtcgggtcgcgccgacggctgggtaagcctttcttcaaaggcgcccggtggggtctgggctcgcgaggacgcgagccgcgagagttcgtcggctatcatgttatcccgtctgggcacatgccgaagctctatcccgtcaaaatgacgctccatacgctgcacttggcgtacataggcgtccatttgcgggtcagagcaccggtactccttacagacctggttaacgaccagctgggaatcgcctaacaccaggagacggcggatccccagtccggctgccaccctgagtccggcaaggagtccctcgtactctgccatattattggtcgctcgaaagtcgaggcggaccaggtatctgaggacgtctccgtttggagaggtcaacgtgacccccgcaccagcgccctggagagacagagaaccgtcgaactgcatcacccagtaggtggtgcgaggcagctgagaggggtccgtgctggcctcgggtattgagacggtctctggagccggggtccactctgccacaaaatcggcgagggcctggctcttgatagcgtggcgtggttcaaaatgcagatcgaacccagaaagctcgattgcccattttaccactcgtcctgtaccctctcgattatgcaagatttgcccgagggggtaagacgtaaccacagtgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggcggggccgaccctctttgctaggggccgcatccccggggcgttcttcgtccaagtggcctctcggggcgcactcgttttctgtgccgatgacctcggggtcggaggatgacaggagcggccttcccacagtggcctcggggccgtcctgggggtcgggggctcctggcatcgtcggacaagcgggcaaaggtcctactccggtcgtcaggggcctcaggcctccgttcggctcgggggcctcttctccctgctctttcccgggtcgagtcagcacagggttagccttggggtcaaagggcgttaagtgcggccttcccgcagtggccttggggccctcatgagagtcgggggcacctagcaccgtctgacaagcgggcagagggccgactccggtcgtcaggggccgtaggccaccgtccgactcggaggcctctccaccccgctcgctcccgggccaagttagcacagaatgggggtgcacgaaatgaggattattttcatcgcgctccacaaccaacgctgcactaactacttggggggtcgccgctaagtaaagtagcaggggctcatttggctccggggcgactagaaccgggggagagctgagatatgcctttaactgagtgagggcatgttcagcttcctccgtccaagtaaacggccccgagcgcttgaggagcttaaacaagggtagcgccttctctcccagccttgatatgaaacgacttagggcggccatgcaaccggtgacgcattacacatccctaagtttgctgggggggcgcatccgctcaatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacataagcctcaacattacgtcctatttggctacccaaagaaattcgagtagtacgttgaaaagtaggacctgcattctttaacccgaagggcattgatatataacaataggttcctacgggggtaatgaacgcagttttttcctcatcctccctagccatgcgaatttgatggtaaccagagtatgcatctagaaaacacaaaaggtcgcaccccgcagtggagtcgacgatctgatctatgcgaggcaaggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccatctcctcgcggatgaaggcttgacgctccggggcctgccgccgcactttctgccggaccggccttgcgcccggccgcacggcgagacggtgctcaatcacctccctggggaccccgggcatgtccgctggtctccatgcgaagacgtcagcgtttgcccgcagaaaggaaacgagcgcgtcttcctatttgccatccagaagaccaccgatccgtgtggtcttggatgggccgtcgcccaaggcaacctccttgaccgggacctcgtcgcatgtggcaatccgctgcctcggggcggtgggggcggaggcgccaagcctctcgtcaccaccctcgggcttggtcgcagcagcgaggtggtccgcgcgctgctccatgcaggcgagcgcgactttaaggtcgccacggacagagatggggccactggggcccggcatcttcatctggaggtaggcgtagtggaccgccgccataaacttcaccaacgcgggcctccctaggaccgcgttgtagggcagactgaggtccgccacatcgaagttcacccgctccgtgcggaagttggctgatccaccaaaggtgaccggtaggtcgatgtgacctaacggccatgtgtgccccggcgtcacaccaatgatcggttgagacagctggagcaccatccccggggccttgatagcatcaaaggccgcgggggaaaggatgttgagagccgctcctccatctatgaggacacgccccaacttcacattgcagatggtgggggaaactaccatcgcaacctgccctccccgggcaatgcacggtgggtggtcggtctggtcgaaggtgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatcaccatcatcgatgtcaaaagcgggggccttctgtctggcctcacttcgccgtttaccggagggaactgccgcagacttgccctcacggcgttcctgcctcctgtcctcctcccacttcctcgttcgctcagccaagtttttgactgcgcgacagtccgcgagatcgtagagggaggtgttgtggacagagcaccacttgctggctgggcgctcccggatgggagtaccagcctctttctttttgtcgctcgcaggcctcccctttcgggtggcccgcggagcgccctcgacggcgaggacgtgaccctcgtcgccggaatgggctgaccttttcttcctcctcctgtcacgccgccctgtctgagcggcggatccgggagcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagcgactcatcatcgcctcgctgtactgcatgcaagtccgcttcttcgcctgggcgcggatatgtgccttgaaagttcatggtgaactgttggcacagatcctcccaggagtggaccgacgcgggtggcaggttcattagccaaccccgcgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacaccctggacgaagaggcaccctccgttgcgcggggagcacgccgatcactacgtcggcgctcgatgtcgaggcgggcatccggctcttcatgctgatcctcccgagtcggaggtgccgacgagggagtggtagccgaatggcgtgcagcagccgccgctcgccgcgccctccgtcttgacgacgcggaaccggtagtggcggcgccggaggtcctggtggtggcggaccgtccgccagcacccaggcgttgctgtgccgtcatgaccaagttggccacgtcgtccagccatcgctgggctggagactccgggtcagggacgacaggcgggtgacgtaggagcgcgccaacagcctgaagcgcgccttgaggcgtgctgccgtcgccgtagacgaggaggcgacgctccccatctcgccgttctcctgcaccacccgcgactggcgatgctgcggatttttcgactctctcgagcgcctccccccgcttgggactttggcgtggaggaggtgggggagtgcgagctcgacggcgtgggtttggctccccgtcgtcgccgctcacactcggagagagatcgtgtgcctttgcttgctcggccattaggctgaacaagaaaaacttggcgcacacggaagagtctgagagctcagaaaacacacactgagccccctacctggcgcgccagatgacggagctcgtggctcctcaccgggagaccgcgcaggcccccctttgccggttcagccgggggcttagggtgagatctcaagctctctctctctctctgtatatggaaagatcacccgcccgcaagacacacgagacacggcgatgtatacaggttc

SEQ ID NO: 5492 - DNA, 3271 bp, Oryza sativa
ttgagagtttgtaaacatggttaggatttttaggatcttcaaaatcgggaggttgttcaacaaagacaagttcggcaatttcaccatttaaaaaagtacttttcacatccatttgaaatagttttatgtcaaagcatgatgcaaatgcaagaaggatgagaacagcctcaagtcttgccacgggggcaaaagtttcaccaaagtccaaaccttcaacttgtgtgaaaccttgtgccaccaaccttgccttgtttctcaccaccaacccgttctcatcttgtttgttcctaaagacccactttgtccctatgacattgtggtctctaggtctttcaaccaaagtccacaccttgtttcttgcaaagttgttgagctcttcgtgcatagccttcatccattccggatcacaaagtgcttcatctacatgttttggctcaagacaagaaacaaacgagtaatgttcacaaatcgaaacgacacgagatcgagtttgaacacccttactaatgtcacccaacacttgatcaattgggtgatccttggaaagagcggtgtgtatccttggtggcataggtggatcttgtgccttctcctcctccacttcaacttgagcttgacttggcgtagcggaagtagatggctcatcttgagtggaggtggatggcttgtcttccacttcaataggcttgacatctccaatagacatgttcttcatagctctcatcaagccttcatcacctacatcatccaaattctcgtgcccctcttgggagccattagtttcatcaaattgaacaacggcggtttcttccacaatacctttgttcttgttgtagacccggtatgtctcgctatttgaggcataacctagaagaaacccttcatcacactgactattaaatttggttagtctaacacccttttggtaaatataacacttgcaaccaaaaactcgaaaataggcaacattaggcttcctcccaacgattagctcataggaagtctttttcaagagaggatgcaaataaagtatattggttgcatggcaagcggtgtttatggcttccgcccaaaaggaatcagaaacaccatattcatcaagcatagtccttgccatctcaatcaatgtacgatttttcctctccactacaccattttgttgagatgagtaggtagcggaaagttcgtgtttaataccaagatcatcacaatagtcctcgatattggtattcttaaactcggaaccattgtcacttctaattttcacaagagtgcaactaaattcatttttggccctttttgcaaactttttgaaaagctcggcaacaatagacttatcatgcaaaaagaacacccaagtatatcaacaatcacaagacaatgactattaccaccaatgctcttataggttgttgggccaaacaaatccatatgcaagagctccaatggtctagatgtggacatgatactcttagtaggatgagaacatgcaactagcttgccggcttgacaagcactacaaagcttatctttctcaaacttcacatctttcaagtccacaactagatcacgttttgaaagtttgttcaattgattcatgccaacatgggatagccttctatgccaaagccaacccaaagaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagccaagatcacaaatttgagcaaccgaaagcaaattgaaatttagagatttaacaagagagacattatcaattgaaaaatcattggagatagcaattttacctaacccaattacctttcctttgctattgtctccaaatgtcactttctcttgttcattccctcctacttcaaatgtggtgaacatagccctatcaccggtcatgtgttgagtgcatccactatcaagcacccaatggctcccaccggtgtggtagttcacctacaaaagaagatcaagctcttttaggtacccaaacttgttcgggtccttggaggttagagaccaaagctttgggcacccaaatgacattctttttaccaccgagtataagggaacccacatatctagcaacaatgctaccatcatgagccttcctaagcatataatgagaattaaacatgcatatgttaggaggcttaccaccggggcaatcatttaccaaatgtccaatctcatgacacttggagcaatacttaccattgctcttgacaaaacgagtggcacggtgagaaggtttcttacccttctttggaatgaatccaagtccctccttattaaggatgcaccgttgctcactcaaaatcttgtcaagagtgttcttacccttgaagcacctctccagctcttgttgagcttagccacttgctccttaagctcattgttctcaacaacaagtgaggcatcacaaatagaaacacaggagctagagctagagctagacatatccacaagatcatcacaagaggtagaaatgctagatgatgcaacatgagcaatatagcaagtagcactatcatcaagcaaatcacaagatatgccaacatcaatgagagctccatgttgagtagtggaaaggaggttgtcatgagcttccttaagcttctcatgagaaatggtgagtctcgcatgataagtctttagctcctcatacaagacctccaaagaagcatgatccttctttagggccttgaacttgacaatctccttctcactataagcatgaagctcctcaaacatactcacaagctcatcataggaaacatcatcacaatcatcatcactctcactatcactaagagatgttaccttagaggagccctttgccatgagacaaagtggagcgaagagtgatggagcctccttgatggcaacaacggtcatcttcttggagcttgcatcatcaccatcttcttcctcggacccggatgaggcggagctctcctcatttgagtcccattccccgatgaaggcctcaatcttcttgccttccttcttaagcttcttcatgagcttgtagcctccactctttttcttggatgacttgtctccatcatcatccttggaagggcacttggaagcaaagtgtcccttctcaccacactcaaagcacctcaagttggagagagtcttgttgggtcttctatttcttctcctatta

SEQ ID NO: 5493 - DNA, 2158 bp, Oryza sativa
aacctacatccacaatactccaaatatggaacctcatagctttgaggtgagtagacattttaattttccaagtggaatagtttgtgccattaaacatgggagccttccctacatggttcacctcgttcgacatcttctctctaggcggtgaagcccaatcaagagagaccaagctctgataccacttgtaggaacgagatgtcaactagagggggggtgaataggcgatttaaaactaaatgacacctaatcaaaactaacctaagttgctaggcttggtgaggatcaactctaactaagcaactaagttatgttttgcaaacctagggtgatagtggctcaattatatctctaggaaagtaaatcactactatgtcaatgtttagcaatcctagggtgatatgatctcaagtttgtctctagaaaagtaaattgcacaaatgtaaatgcgacaatcaaatgagagaaggagacaagagatttttcaccgaggttcggaaactcgccggtttcctactccccgttgaggcgagcccaactccaacgctcaaccatgaagccaccgcacgcccccttcgtcaaggggtgggcaaggcgggagccggcccacggagaggactacccaagcctcgatcactagggtagttcttccttcactctgaaggtggtgaactccaaaccactcacaaacaggtaccgggcctcctccacaatcttctcggagagatcaccgggcaacttctccacaaaccgtctaggaggcggcaacctccaagagtaacaagcaatgacccggcgtggagatgatcaagtgccacactagctctacaatggaagcaaatgcacttgactcttggctaatcaaccctctaacacactagatggatgaacacaaagctcaagtgagtgtgagagaggtgcaaggggtgtatgcaattgaattgggtgccaagagagcccccttgctgctggtgggggagtatttatactcacccaccaaaactagccgttgggggcgaaatcccccaactttgtgctctgccggtctgaccggaggtatgtggccagtcagaccgtgctactctgcaacggctagaaaactagccgttgaaatgctgtcagagggccccatcggcctggccggtcagaccggcgtagagtgggcggtcagaccggcctcggctcggtttgaccgactacggctccgttggctctgtatcggccatcccgagcagcatcatctcagcctctagggggccggtctgaccgctcatgtgccgccggtcagactggccctatgcgacgatcagaccgccatcttgcggcctgtcagaccggccatggcacgccagtcagaccgccactatgtggccggtctgaccgtccctggtcaggccgaacccagtgaatttgcaagtgaatgtgtgtgtgatgaaaaagagagcacaaatgaaaatgcaatgacctaatgtggcaattcaatcatctctttgctaggtcattacccctcttaatagtacggcgaaactagaaaataaactagcaattttgatcgccctacacctcgatcaattctaaattaaagcactagttttaccgtcttctttctctttgctttgcgccgtcaattttaatccatcgataatcatccattcgcacatatgacatggacctaacttaaaatgtatagctcaaagacaacggttagtccacaattagcgcttgtcattaattaccaaaattaacaacgggggtctagatgcttcaggcgccctccccccgcgagcggcggcgtcagtggcgcggtgccctccccccgcaagcggcggcggcgcggcgccctccaccccgcaagcggcggcgcgctcccaccccccctcactctctccacttctccccctttctctctgtgtggcggcggcgggagggccagcgacgccctgccctccgctagatcggggggaggggaggtgcggcggcgggtcggacggcgtggaggcggccggctggacctcgcgtccgccagatccggcggcgctgcggccaggacggcgtggaggcggcgggctgggcctcgcctcctctagatctggcggcatggaggcggctgtggcccggcggggcgggaggggcggcggcccggacggtgtggaggcgg

SEQ ID NO: 5494 - DNA, 2889 bp, Oryza sativa
catagccacatgcttgaatgggccttgccaacatgacagaaatggcccatgggctcattcacgcacgcgcgcacggacatctaccacggcgcatcaagacgggctacgccattgatgacgtcagcgagcgatctcccttccgaccctacctaccggaggagaagcagcagcggtactactacggagtactttaatttccgggttttcggacagctcaaaagtagcgaagtacccgttaattaaacatggtccattctccccctaattctacagtattattatatatttgaattaggtgcacagtctggatcatagatgatttttataattataattgtgtttctgtgtgctaaaggaggggcagaaacagattgttttcttttttggatatatggagcggaaagggaggattcctggttatttcctctgtccagtaaaagagggtgcaagcaaatatggttttcttttgatacctagttgcaataatcagttagaaaaagaatcaactataggattccttcaacctaaaatatagatacttgtagcgcttggattttgttccaaaatacgtactcctcacgtcaaccaatcacaaccatctctcacttaaattcttaacatattttctcatcccaattaatcataaatatcgctcatttaatttcgaccatctccgtaagtcagtttgagataactgaaattgatggatggatagattatttgattttttttaatagctatttaagagtataaatgaatgagttaactcctacaaagtaaaaaaaagttattctagaaaagtattccaagaaaaaaaatataaagattttctttatgaaatgcatttagaagcttgggaaatgtacagatgaaaatccaaaatattgacttagaaaagaaagtggccttgatctctgcgaaaaactttagaaatacttgtattttgggatgtaacacaactttagaaagtggttttttctagtagttttggttttcctaggactaaatatccactcgattatgaaaattgtgaaaagtaaagtggacataaagagagagtttaattactgtttaggttcaaaatttggaatgaaaaaacaatgagggacaattctggaaattttgatttttttaaaaaaataaatttaagcaattatcttttgctaagtttgaacaaatagtttgctaaattgagacaaatacagcattttctggctaactacatataacacatcataccggtcccagccggtaaacccgaaatttcagaaactcagtgcagcaagatcagtgaccgagacaattagctccaatcattgagagacccaggtcatgcacttgtaaaccagcttaacgctcaccaaatgatgtcaattaagccagcaaggaccttaaattggctccaacctaaaccgcagagacagtggctcaagaacacccaagagaaagactgaaagagacgagcaccaagacggaagaggatgacaaagagcccaattattgggacacttaggtggacggtatgaatccaagggaactagtagacttgaagatatgtattcatgtcagcgtcggaatggatggccgtccccttcaaattcgatgcacattgtggtagtgaacggggtaacgatcatcatggggccctatattttgatgggatgttaattcctcgtgaatttatagcttgttatggtttacctggtgagtggtgaattggaattttattttagtggtgaattggaattttattttgcaggtttagcttgttgatcgcttaggatcagtgacagatccaagatttttttgagcctgaatttctataacgactgtttgatgagaaaatgtcatattcaatttatacagaaattattattgattgttccctcacgagaccgggtagccatccaaaatcgtggggcggtaattcctcccctatatatgtttcactacgattctctcgtcaatattataattctatcatcaattttatgggattaaatttagtttttttaacctgtgtatacatttgcccttgtcatgtgcaatgttgtgatccattaagatcatatcaatccttgtcaggaatcacgttgcagtgtccctatgatcccttgtcccttcgttgctgtgctatgagaaagagagttgccatctcgcaaagaccatcgtcttacctcagttctgaaaggaggtgcggatccaaatcagcttttgtaactgagaaaaagttcatcaacgatcaatttgtccttagttttgccttagacagcattagggtaactggacctaccgcggtacactccaagaatccatccaatgtttcgtaagggtgtgtatatatattccatggaaaacctagactttgcttcaaacaaaactatatccaattatcatagagtctgcagctcaatccatccatcttttgcaatggataataatatatattacctctgtcctaaaatgtaataatctaagatgggtttaggtctaataacatcctagactacgtatcttattctagattgctacatttttttgacagatggagtacatggtataaacccaaaacaccgatttaccataataatgtatttttggaattcagggatgattttacaaggatttcatcagaattagtttgttttccgaaggaatcaggggagaaatactcaccattcaagattttgagatgaaggtattttctgtatttcataaagaaaaagaatgccagatcagaaatcatgcctagagcatcgggcgagagagagagagagagagagagagatcatacctagaggtacgggtgtgtctagggcggcgaaatttcgccatgccgaccatgccatctgcacccatgttgaaccatgatcatgtgcgccacatccc

SEQ ID NO: 5495 - DNA, 1313 bp, Oryza sativa
ccaaatctcaatagctgctggttgctagtactaataagctctaataactatgggtttgagccatggatctggatcgaggagctgatgaacaaaagagaaggtaaaaaaaagaaaaaaaaactaacctgacaaatatatatgtgtttataagcagtacaaactcatgtgtcactcgagtgtatagacatgccccagatccatggctcacacggctttacagtaacagatgatgcagcaccaccgggaaggtatgtatggttttttatatgtcaccccgtttgtttcacttcttcctcggcttggcgcggcgcgacgtcgccgacgacgacgagccggagccggagaagatggagcagaggatgcagccggacaccctcggcgacggcgggtcgacgtccggggcgatgtccttggtcctgaacacctgctggctgcggttgtcgtcctccttctgaccgtccttcttcttcttcttcttcttcttcctctgctgcttcgtcgtcttctcgctgtcgtcgccgtcgtcggcagcgacacggcgcatcatgccgatgctcccgacgctcttggaatgccggagctccggctggggctcctccgtgccgccaccgccatcgccatcgccggccttggccgcctctgcgtcctcggtcaagaaccgctcgtcccagaccaggcctgacgaaccggaccttctgaatgttgtcgctgatctttgcaagccagccatcatctgcaccaccaaaaccaccactcctctctgcaaaaaaagaggaagcaacttatctgcaattgtggagaacaagaggtgaggatgaactgaacggtgtgttctcttcttctcctggggttgggttgattgcctctgcaggcttccaatgtgtgtatatatgtgaactgaaaagagacagccattaatgtacagacagaagagcagtcaacagccggtgccattggaaaggtaccaggggctgtcttccattaactaactaggttaagcagggattagtttatcaacaacaggtagaagaacagtacggtaaaactcaacagattaaactatgcacctttctggtctaaaccccatgcctctggttttacttttccatcacaagcatgtggaagaggagaatccaatccaagtgtgctgaagaagttcgaccattaccaccataaaaagaggacaatttgctgagagcaacaagaccctgcatgcataaattcttttggcaatttgtgcacattactgtgtgaaaaagattgtccatgatatgtcaacacaaaaggatccatagaaaaaatatctaaattgt

SEQ ID NO: 5496 - DNA, 3580 bp, Oryza sativa
attatgtaggcatataattttacatatttcacaaaagttttgaataagacggtcggtcaaacatgtactaaaaagtcaacggtgtcaaacatttcgaaacggagggagtattttggaacggagggagtatcatctaaaacaaaggtacaatgcatcgatcatgattttaactcagtggtgacaggtgaattttaggtgcagaataaatatctaatgtatatgtaaatcaccaacatctgtttactccctctaatttttagtatatctctaatgattgaatcacacatgcccccacaggtctttctcattccttccaacctcactatctctgtgttgcagccttgcaggtccccagatgctacctccctcccctgtttccacatagtttccttctgatgaactccgaaatttctccatctgccccagtaatccacagtacatggcaacaatttcatattacataatagaaatcatcatagagttgcaaagttttgaaagactgataaatatagattggtgttcctaaagaagtgacaatatatctaccctgtagatatacctaatcttctgtgtcactcacacatgagcctctcatgatgacatgaccaacgcaaagagctgagctgaccacaagcccaaactactcacattgaaaatagcaacacgatttcgattaaagtaaggcaaagcatgggtttgatctaatagagtactaaaagtcacctatcgtggaccacaaacattcaactcaaaaatgtgaacgttaaaacatttaacacaatcgtgtcagctactctgtcgctgccttcccaaacttactggcatacaacttcatcttaaatccctacacttagggtgagtttgaggagaagtggattgagaagattcggaagatacgcaaaataagatgagccattagcgcatgattaactgagtattaactattttaaattttaaaaatagattaatatgattttttaaagcaactttcctatagaaaatttttgcaaaaaatgcaccggttagtagtttgggaagtgtgcgcgcggaatacaatgggctttctcacccaatcccccaggaaccaacgcacccttaatacttctggcataaaagaaaaacatatacgggattactgggcacatatcccaaaaaaccagactagagaaaagattatgtgaaacgccttgcttccaataagaaaaccaatctaagcaagaacaagacagaatctattgtgacatttatcattcagaaaatcaagatctggtcaacagaacccaagccgactttcactgaagctaatagtcaaaatggtggtccagagtgcaacaaataaaattatcaaagtggcaattaagagttgtacctgtcacattggttgatatgggagtactaatataaaacatactccatattgggcttgcagaaattcttctacttcaaaaattcaaatttagaatttgcaaatagttcaaagaggaaaccatcatacatgctaatttgaagtaattatcaactagctatggtctcagatagggatctcttgaatgcaactcgatggtcaggtaccccatcctgttcccttctatcctcaaaccacttaacaatggtcttccgtggaaggcttgtcacttgaactatgctgctgatcattgtattctggatccaatgcaagaacaaacataaaatttaagcaatgaagtgaaatgtactccactgaatgaaaaggatgatcatagtggaaaattcacttactgtagggcgtttggttcgggagtagactctttctaatgtctccagttgcaccttttttaatcttttctgtgaagaccattctgcgcacatgacatgaacaggaagttccgtctgtggcttggtttcagtgacatcagcgttatcaactactggagagggctctatttccttgatttcaggtttagaagggtcttcatcaggcaaagaatcagacatgaatagaagttttggaggtggatttcggagcaattcaatgaccaaagtcctatccaggcctagttcccctgcaagattgctttatctgcaatggaaacaattcatataagacaacagaaaaaaaaaccttcgataatttaaagtttggatatatacctattactactataaaggaacgcttcctacaaacagaaactaacagatttcagaaatggaaattaattagaatccaagtggatatttatctactcacactagttttacggcgacctattttgagagcacgagccagcctcttaagttgccagtttttcagctctggccgtttgatttcatccgttttttcatcattcccataagcctcagagcctaatgacgaaccctctccagattcatcagcatcagcaatatccccgattgcctctgccaactcctgctcaaatcttgccatatcttcttctgaaattccatcgtcatcatcctcaacagacaaatcatcattcttgagatcttcttccaactgcttaaaaagtgcttccagcgcgtcgtcatcgtcttcaccaccaccgccaatatcatcctctactacaacctcctcattctggattttattctggaatacataacattttatcaacaacccttccagccacagcttacgtgagggaacatttaggggacagacacataaatctcaaacacatccgagataaagatatgcatgcaacaaacaaaaaaaaaaatcgataatattctccaactacagaataagataaggtcagtacgataaggaaaacactataaacgattctgcaactcctctcgatgagtaggtgtaaaacgcaacaaattcagcaattcaccaacccgaatttccagtcgctcgcagggcgccatctcatctacactactctatctacatctacagtaaaaaaaaaagaagaagaagaggggtttagaggaggaagcagtgactgcgaggtgaccttgtacttggagggcctccggcgaagggcgcaggcgacgccccgcggcgagcggcggaggagcggccgtgccaggaacactcgcgcccctggcgcggcggcggccgcggccacggcgagcggcgcccccaccatcgccgccatttccgcgagctctctcttcggatattttcgctcccacctctgccctcctctccgtgggatttttggtttcgcagagtccagaatccaaatgggccgtctctcttcgtctgggcccattttgtcctcagttctagcccataaataaaataaaataagttcactttcggtttctctatttttacgtcgagttttcacttttgcatggtgttcttttgtccgaagatgaagattaagattaagttttttatgtaaaatgagatggtattaacatatgattgattgagttttaattattacaaacttgaaaaatatattaatatgatattttagagcaactttcatatagaaagtttttgcacgaaacgcaccgcgtgccacgaaaatcttaatcttaatccaactcttgttggagaaaagaacatgactgcaataccggattatccaatgtccgagggacgcacccgtgcttcgccact

SEQ ID NO: 5497 - DNA, 19969 bp, Oryza sativa
tggggcccatctagcagtaggagtgggtagttagccgaaccggtcagagacgcgtcaagaagacgacgccaacgcggcggcggcggcggcggcgaagaggaaggcgaggagctcgtcgtcgccggcacgcgcgcagcgcagcgcagggtcgccgacttgcgtgttgcggtcgcctcgcctcgccgccccgcgctgttgatcggtcggcgaggacaggaggcgccgaggcgggggtgatgcggcggtcgtcgagcggggcgcgcgtgtcgtcggagggcggcagcggcggcggcggagagatcgaaggagtggggctgccgacgtgcgacccgcagtcggcggcggggcggagggaggcggcgcgggcgcgggcgctgcagcgcgccgtgcactgcatcccgctcgtgctgatcctctgcgccctcctcctctggctctccgcctcttgagcctcttcggtgagcaccaactaatctccatatctctctctctatgtcgatggcgagatgctaattagctcagtaggatagcgatcgtcgcggcgtgagcatgatctgatcgaatcttgcccccatttcttggaaaaagtgcgcttcttgtctgtatgatctatttacgaatcacatcccagcatcaagttgaaaatttttgagcaacgatccgaaatggtttcaggaaaatgcttaataatcccaacaatatcaagactggtatcgtctcactgcaatctgtaactctctactcctcttgtttcttcttgcttgcttgtaaatttcgttgctgaatttgcttttttttgggatgtttccgcaatcctcgtcagtacaagcagactaatatattcccttgggtgcatcaattttgttcctttctcctttgagatcgtttgatttcccgtcaggattagcccttttccttcttgctcagtccgatcttagcgaaaataactgatttgcagatctgcactagaattaattcaagaggaaagacgaatggtctggtggtgaggaggttgtttaacagtttaagctcccgaccactcgagttattggatattggggatgattggcatgctactatggcagtccatcccctctaatgtgagtgctagaactcctgtttcaaaaagaaattcatgaaatatagttgcttcagcacttcttttgcaaaatgtttctttacctttggtgaaatggaagtacggcaaaaacaagaagacataaactgatagtcttaactagttgccaatcataaaaaatcctgttagttacatgcaagcttttgttgcttatgaggaagagatgttggaggatctgggttagagaaagattgatccttgtttatggtaatcaacctccaaccttccttcctgtctctttgagtttgctttatccttagtgtgcgtgcgtccgatttgtactcgcaaaagagaaacaaccataaattagtataagctatatttatattttgtaaagaaataatgggacagattggttcaaccagtagggtaaacttttattgatgaaataattgacattgtttgagagaaattgacagctgattacatgtgatgtgataggaatataatatacacaatggtcgaacttgaaaagaactttagcatgcaatggggatcatctccagcatccgatgctaaagatgcttccctgaggctcctaaagtctttcactcctcataaatggattttctccactttgcagtttcaacgcttgtttttgcatcctggagttctgtcacatacatatatatcttttttttattcgatcagttatcgctgtagaaaatatgctctgttgtgacatcgcagtgcaacatgggatgttatgcacttgtcctcagagcagtccctttgtatgccaccactactaaaccacatcaatttctttgctatggttactctacctcgtgaccgatgaaccaattttttatagcaatcatcagttgattaagaagtgtgacaccagatcgaaatgtgctttcaactgcaatacacataaactgattttgcaatgacttggcaatctaggccttcttatatatttgattgctcattgtagatagggtccttccccttaaggcctcactgttggggcataagctccctctttctacccatatatgcaaggcacctctctaccctgtgttttagcttgcacccgtcattgtgattttgcataaatatggttatgtttgctttcgcacccaaatgctttctgacgtcaatgatttttctgatgtatgcagattgataaccaatgggtgtttcaagtggatctgacgccacaatgtagagtttatagagaaaacaaaatacaagtgaactagatcaggcatgatcaagtaaaacacagagacattaagttacaaaaagattaccacagcaagaagctcatctactacagttatatttttttggtttcccctgaaaagggtagctgttttcggtatagatattctttgaactttagattggagatgagatgatttggcgaccattacagtttgtatacaaaggaagtgtgtactcttttcctacactaagcatgtataatacttacatctgatgctattcttccaaattctatacacatgaatatgtgatttcgctggcagctaatttgctgaggttttagcagctgtgcttgtttgttgtctaaatcgatgtgaagtttttctgtagcctaagccttttctggtctagggtctgttgtaaaactttctctccttcttaatacaaaacttggccggtttcttttgctggcccggcgaaaaagagaacatgtgatttctttgcttgcctccagtttgtgttgtgcatatacctctgttgtaagttatccttttattctgtgcttcgattgcatcccccggtgtataaagggtcaaatgatagttcatacaagtaaatatatatgattacatttataatatttagatccatgattacattgataattttacatgattacattacaatccatgattacattgatagtatttagatgaataatttttttcttgttttaaagtaaatataaaattttaatccactgtaatttaacttacaaactctagatccagcactagctgtgccagacaagaagttaaagccaaactccattccatggcaattcgtttgtcgtaatcgtagccatttcgacaaaaaaatgtctaaccataatttgttttggtcgattttgacacccagaaaccaaattcttgtggatgtcaatggcagaccgaactgtcactgtttcactatcgcaacaaccatattattaataatattatcatacgttatcacaaaaggtatccatctattacaccagaaaagtatgatctatccagtgagataggcttttggatggttactatataatctgcaactctgcacacacggccacaaacacaaaagctcaattcagaaaaagaaaattgaaaccatgcaaattctggcgaaagaaatttcatgtgtcctaataaacgcaacaaaaatccgagatgtctcttttaaaatttggccaggccaatgggagccacccgttgcatccgaccaaacaaggcttgaaagccaagtgctgaggaatgttgtaccctttgtgtccaactcatactatctcgaattaatctagtttttgttggttgattaatctgtaaaaaaaacttatctttgtgcagtttttattgtttttctttgttggtcatccactcgtcctttcctgcaccgcaaggaatatgaaagccaagtgatgaagcaaagcaaaactgacggtttgctcctaaacttgactgccaagccagaagcaacccaacgaatgaattctaggagtacaatttatgcgctaaaccttggctactatttaagctagaaattttttttaaaaaaactctcagcaaaggaagcattggagttacaatcgtagagtagttgatgcataactatacttacaatctgtaaaaattatagtgaatataattatacacatataattatacactcgtacagcaaaagtgcgactatggtgcgtatctgtattttctaaaaatcaaaaagttatatacttgcactcaatttgatataaaaaatgctagcatgaatgagttgccaacgcaccaaaacttttattcaacacccctatatttattataataattcatttgcaaaactataatatttaccgaaatagacattaaagatatagtacctgatcagtaacatgcctatttcatttattgtaggtagtgacgtagttttcggtgacaagctcacacatacgtaaaagctaagtttacaactcatcattctattttagattttcaacaaaccattaaaaaaatatgctatggatgatttatgaccattcctcaggtatcaaagaaatgttatatacatttatattttgaatgcctatttaacaaatacctaattaaaagatgaataacataactataaattccttaatatcataccaataatgtcaatattacatttctcgacgatcagtcacatatcaacaaatattctctcagtactttaaaagtataaaaacaaacaaaatgaccacaaaaccccatcggtcaccgacccttctccgaacaggaaaagaaatcggcttgcaacagcaaaaaaaaaccgacagccagccagtcaccgactctcaccggtggcagcatcgccaccaagaaccctatcctccgctggccatccgatctcgatcggacggccagcagctgccgcgctccagcgccgttccgatccgacggccgagatcccacgcgatcccatcccaccctcacatataaccgcggccgcatcacggattaatagcgagtttaatcacaagaagaagaagagagagaaaaaaagagagagaagaaatcacaccgcattagcagcagcaaaagatttcctcgtttcgcttcacgaatttttgttgccctcgcccaatccacagcgcgaggagagggagttctcgcggcgatttctcgtcgcccctctcggccgctgccgggatcgcagctcgcaaggttcgtgaccccttccgattttgtgttcattttcttttctttttttctcttttttggtgttgttcctgtgcgggaattggggaggaaaaggggaggggagaaggggtggagccgcggtgaaattttggggggtggtgattgatatgctctactgtttgctttggtcccgattgaccagttcaaatgttcttgctttggtcggtgctcgggtttgatttgacgcttggtttagatcgtcttggtgcgcgtggtctggtatcgtcgtggcgctgttcttgcgcctcttgtgttgtgattgctgttgtttttctttttggggggaatcgcttggttggagttcgtagtttgttagagttgctgttttgggggtggtgtatttctcttatttttgtttggtttgttcgatttccgggcgggatagttgttctgattttgctgcaatctgccgcaaaatcgctgttgctgaggtgatggatggtccgtgcggttatttcgatcggcctatgtgatccattgcgagttttgttcttgtaatagatcgatagacccgtatgctccggatgtaatgcttccgatttccacaacctaaattgcgttaagtagtgatctatatagggcaatagtcaaaacaatttattgattcacgaatccttgttcatagcatatttcagatttcgcattgcaatctgttgtgattttagcaatgttataaactaggatacgtttttttctgtgtaatctgcattagaccttgtagaagttgaaaaaaaaattgtattgtgattcatcccgtaatccactttgctagattattgattattactgttctttttttttgtttgtgccagttttggaaaggaaacaggttgatgaagttggtcaaagggagcaaggtggaggtgttgcaggaagcggaggtgcccctaggttcttggaggggtgctgagattgtattaggcaatgggcagagcttctatgtgagatatgatccttctccagttgactcttgcgccgctgtcgagagggtgcagagaaggttgataaggccttgcccccctcgagacgattcagtatgctgggctgtgggcgacatccttgaggcctttgatagctactcatggaagattgctgagatggtgagagtgcttggcaaggatttctatctcgtcaggctcctcggatcttcgctggagctgagaacacatgcgtcggaacttcggttgaggaagcattggaaagatggcaaatggactgttcttcagaaggtaatggtccattccttcaaattcatgatatggaattattcatgattagttttttttactgaaaagtagaataagctactttatttccttaagttgaataaatcagctggcagattgccactgtcttatcttcagcaaatctgttattgaaaattcgattttaatgtatcgataaaacatcctaatgacttgtctccaattgatttcaggattctacaaagtgcttcggtggttcattcagaggtcaaccaaaatctggaaatcttggaagcaattttggcaagcaaaggcagccatattgtgcaatggacaacaatcttctactgaagaaccaaaaagctttggagggtgataagtctagaggcatgaagagaaaatcatctgctattacacacccaacccagtgcagtgaagtgactagaggcatgaagagattacagacaccccatagagatggaaggcacgcagcgctggttgctggagtttctcctcgtttggctgaaaaggtagatgctgttgattccccatgcttaatgctgggtgaaaaatacatgcatgcttccttaaataagagaaaaaatggtgttcatacaactaacttggctggggtaaatgtggatactgaaaataaattccgtcctttaacaagtgcttatcctagtgacaccgagagtatctcatcctctgttggtagttgtagtccaagcagtagtccctgtagttcacgacacttttactcagcctaccaaactggtgatatctgtagtagaactgatggtgctgaagctgccgtatctgaaagagaaacatctcaacatgataagattataccaaaggaagatacccatttgctggagttgcatgcttatcgtgcaacaatgttggcattgtatgtttgtgggtcaattagctgggagcaggaggctttgttgactaatctaaggcttacactgaacatatcaactgatgaacatctagctgagttgaggagtatggtttcctcggctattacttctagatagcagttgtagttacttgcttggtgacttttatgacatctttgttgtcttgaaatcattgtaagttgggaaatcccattaagtatgaggtatttgagtagttgatgttctgtattacctgttaaaagagttacctagtcagatcatttttgtaccatagaccttccaagaaacatgaaattttgctacattttctcaaacaattactgttcttcacttattcacactgaagtttgtagctttacattgcttatatgttgcttgtgatcatctgattgaattttacagtactatgatcaaactctgctttcatttcagtggtacaatatgaaagtgaggtctacgttagtgaagtccagttgtatatatttgagcctttatgctgccaatgattttacttacccgggctacttgatccattgtttttttattattcaacattgttagatgtcatgaacatttgtgcaggacctatcatggtgagaaccccattattaagaaaaaaactgttgagcagcgagtaatattcgtatgttatgttcagatgccattttcttgtctagatagttaactgaccttacaaattgcaaatgcatctttgtactcgggaaattaccactcaaggattgttcttggcaaagtctgcaatgagaaaagttggaaaatggaaatctgatacttatcatgaattttccagggccgaagtcggaggcttgtaaagcatccttctgtaggtccatgtcgatggaggagtctgccacatggtttgctgtatgttaaatgtggcaacattccatcgaacttctgttggtaccttgtttgtttttgttattccttttgctttagtattatcttttctgctgccttttcttgtgattggccactaaatttctcgagaacattatgaagtgcataatttccataagtttacaccacattcatagaaaataaacaaaagtacatggtaggcacatctggatcaattaccactaaaaaaaggaagatgaacttattttcatattgacatattttgatatatttttttctctttagaatgtgaggcaactgagaggagtacctgcagattttgcatgacatggtaaatagtgtttacaattggtaagtttaaatttgtaggtcagtaatgataatacaattataaacatcgtagttctaaccatgtgatttttaacacctatttgcaatatgcacattaccctttgttaccaaaaacagaaattacagagggatcttcaatctgaatatgacctgcaaagactttgtaagaggccttatttcaaggtatatatggtgactactgaattaatgtatgcaccatggcattgttgatcactgaggcatctagctggcttgttgaattccatcacaagtcactccttagtgcatgacttattatagttgactcacatggttgcttagtgttgtttgaatgagttttaccatctaatatttctacatatggatgcacaaatattgtattagacatatggatgcttcccacagtgctctatcgttgtttcatgatatcctaggaagctcaatttctatgttcagaagagtgtgatgctgaattgtttttgcttaggagagagtgtgcagtcagctcaactttcctatgcagataagttgtttgcagtatgaaaagcagggaaaatttccaaaagattactggtggtgtcactttgtcaacaacaactacttgtgttactggtggtcaataccctcaagaactcacgtgagtttgctaagttgaggacctgcaactgacttccaatttaaacagaagttaaggtaggcaggcgcaccttgcaattcgcagcagcaagtcaggtgaggatgcaccatattgtttgcctcacctgtactcgtatctgcaaaatataatttacctcttttaatgttcatctggaaaattactctttaattcagatgcttcacaaggactcaggaggttctcacgcaaaacgtgtgtcatggtgtttgtgtgtcaatcattatttgtttttaattgcaagcatttcaagtggcttgtttggcagcaaagtgttacaatttattagagtacaattaattatgtcctgaattaatgatcaaagtacgagacacgcactgaaaaaggctagagagttcttggccgtcttctgttctgtgattgtggcatcttgcatgcagctggtatactttgatggctcctagctgcaattctttaagttgtagtacagtgtaatatgccattacttgttccggatgtactgaaagatgtaaagttgctagatctgcattgctacgaataatttgttcaggttgcacgcatttgacaagttcccttttcagaagaagcattatatggtgcacctggtgttttcagatgagcaagtgagaaacctccgttgaagccaactgcaagcaaagaatatatggaacatgtcctttgtctcattagtttgtattaaaccgatggtgatgcattccttttaattccataaaaatatatgatgtgtttgttattgaactgtgtaataatacagacaaatgtctgttcaaataaagagtcactcttttattctctcacttgtggataatactgcatatcaaagttttaggcaggtctgatagcccacccggattgggccatcaggcctaatggtagcgcaactgggctgttcattgctttagtttttaccttttaggaaaaagtacattgaaaggcctcttgtcaccgcattacaaaatcgtccttacgacgcatgtgggcccccacataagcctcatcatttttttagttactatttagtgaaactgacgtgtgggtctaacttttttttttattttttttcggatcaaatcgctacttaagcgccacatcggatggagactagtcaattgagccacataggcgccacgttagttaaaaccagggataataccaccaaggaacctaattcgcactggttctgtaagttgatggatgcgttatattcggttttgcggtttaaggacgattttgtaattcggtgacaagataagggacctccggtgtactttttgctactttttactgctgaaattatcctgtcgatatcgattggattgaaaattcagaattaggccctgaatacatcatattccagcattctaattgttctcaaatgaatgtttttttctatgttttttatgtggcatcttccaattctttggcgacgtgtatccttctagatacttccaaaaacatactacctacatccctcaatgtttgcgaaggttcatctcgttctgacatagtggtgaaatctgaaactctgtcatcaggtttgaagttttgaactcaccgagtgatttcagaggctttttcttagaggaagtttgtaaagcatggtcttcgttggttagatcgcctccaaaatttcccagtcataatctttagactattaatagaaaaaaaatatttgtgtttctacagaatattttcgcctcgtgaagcacatgagaaagagggccaataatgttccatttctgaagaatggcaagtttcttcaaacaaaaaaaaaaaacttctttccggttaagtgatgatgatctagttgacgcattggttcagagaaaataccgtgtgttgtttgatgtgctctgcattgggtatcaacatcatgaaacggaatcatccacagaagcagagcagagaatcagagagtacaaacggatcatcaggcgacgcagacactttcaggtttccactcaaggcaagcaacatgtactacaatgttctccatttccgcataaaaaagtccaaaaacgatttcaaggacagcagaggccggccatccatcctgtcctggcaagattctgcaagaaagaatcaatgaagccaagccaagccactgcttttatcagcttatggggctcgtggattctccacgccaaggtgttcgagcaaatgccccaacgaacgaggctctggggccatgcccatgccaggcgggcgcgcgacagcagctcgaccggcgaccggctggccttcccccccggggaccagcggcgacggcgacggcgagacgacgacccaccctgcaatcgatgcctccccctgtacgccgctgccgcgaccagctcaacgaacactggcagtcagccactgctgctgctgctgctgctgtcgctgtagtgaatgtttatgctgcatttgcagtgcatgggcatgagagatggagccatggctgacgacgacgatgatcctgagcactggaacaaaagcgtaccagacgctgcctctgcctgcattgatgctgcgagatcgatgatgcagtgatccagtatgctctgccaccaccactgcatgattgtgtgtgggctgatcagctgatgcttggttgcattacatgctagttaagttgcatacttttgccgggccggccaagaaaggccaaccaaatttacctaagattgaaaaatatatacaaatatacaaagttataacttcaacgagaagctgtcgaactaatggaagttgtcaccggagcaacttcccaaaagcaaaagattacactaaaagactactctcctatatttatgaaaatcccagcttctttccaaatcgccacttcctttttgattgaaccaaataggaaaccggctgagcgccgctggttctgaaacacacgcgcattcaaatgatcgtcatcattcaaatgatcgtatcaaagagcaatactttccgtttatccaaagcaaattaaaacgtgagaaatgctcaagggtcttccagttagtttcataaggtgatgggctagccgacctgagttagaagtctcatcatttctatttatttgatattacagtagatcattccctaatattcacgtttttagcaaattaaaacgtgatatggcatttgacaagtaaacgcagccaaatggcaagcaaagctaagctacttcctactacgtatctactactaggctgagatgccaacaacgagcagcaactggaccaaactcgtgctgagatgatctgctgcgtgtagctttcgtcgccacactcacaatgacaggttatactcgcccatttttgagcagttgcttctgtttcctagtccttatctctcgtcatgtcggtcatttgatgatggctgcgttggatatagcccaagaacatgtctagtgtaggctgtgacacttggcatctctcacctatagctagccattagattaatgatgattagtaattgccttaatttcagtgttagttttgggcttttggcacctttggtacactattatatctctcactactgaagttctactttgagatttgtactccctccatactcataaaaaaagtcgtttatgacaatatttaagtcaaaccttaaaaatataaatcattaataactctcaagttgttgagtttgaaaatgtaaaaattatatgtatagatttgtcttgaaaaatactttcataaaagtatacatatatcacttttcaataaatatttttatataaacaagaagtcaaagttgtgttttggagaccgtgttgctgttctaaacgactttctttacgagtatggagggagtaagttgttagtagtaagtagtaagtttacgatgaagatggctagctactgacaatgcaggttagttgcagtactgctcatctgtaacagagtagttccattgaaaattaatcagaagtttttgagtttctccatgctccgatcttgtgtagtaactcagtaactcactgtacatagtgcatgacttggattagctcagaatataatacatgccctctcattaatttcttgtcaagacacagcatgtgttctttagggacagattagcaagaatctatagcaactgaaggcactagctagcctaccaagctagggtagtaataaacaacttagttagcatacagatgtgcatttaatcaattaagcaaggttagtactagctttctaattgtgcatgtgccctattaactgcatcttgtatcacaagtcctagttgcatgtgctgcattagttaagacttgaaagtaaaactttatccatgaggaatcaaataatggtactcagggcttattcagtttgttgcctaatcaacctattaaaatttggcacatttggtttccttaccaagtttgagtagtgttttttaagagagaacttttggaactaccaaattttagtatggtagtaagagtatgtttcatttgttaccctactaaaatttggtagagttgaaaatggcaacaaactaaacatgcccttacatgtagtttatacaagagttactgtgtcacactctccttcaatgctcaagaaagtgcatggtacaacactccatgaggtctcggattcatccgtatcatccacaattgtaggcatgtgcatatgatggtgtatatgcatacatgtctaccttacaatacaattaaaaagaatataaaagctacgatcgatcttagttttgtcggttaatccatgccagctagcttgatctaagcacattttagtattttggcgccaatatttactagttctagtctcattatattttggagatgcattcatgtcatgtgctgatcatgcagcagagtgtcagttaagtagtgctaaccaaattgtccttggtcttcatgtgctaattaagcttagcttaacctctccagccatcatctatttcatcattaactatagcttccctagtggataattgaggtgacacctgtctattacatccctaatgattgcatcattggtttgtttcactgatgattgcgttggaattcagcagtcagaagcaagcgatgatgcgtaagacaaccaactccttaattgcacatgatgctgtgccacatttttctcataagagtcatactcatgatgctgcaggatgatgatgatcagcaggcacaagggcatggagaacgatgcttgagaagcactagtttagtacaagatttttgtcttgtcttcagttatagctcaatccagcttcaaagatgtgtgagtgcaacatcatactgtgatacaattcaaggggttctgcatgctgttttttttttgttgttgttttttcattcagtctagttttcagagttgtgcagtactactgctgtttattcatgagagttaggtctaccactgttcctgctttatgttcttgtcgtgttcaatgcaaacctaaaaagaaattaggagcggaattgtgaccagcgaacaagaatttcaatcatgcaacgttagcatcaatcatattaactccactctgctgccttaggctgatctctcaaacaaacaaacaaacaaacaagatgtgtccctagcataacattgcttgttggctggtgatgatgcagatattgcttgagacatcaggatcagatggtgagcactgaacaaagaggataagtgctgctggtgcctgcctgcaaggagccaaagggacctcttgcttcctacctgccaatcacttcttccctagctctctctcaatactttggatctgaagcatcaaaacaatctagctcattgtctgaacagcagcacatcaaaactgcacctgctactacactactactccatttgttactacttcacacctgtctctacaaaggtaaacatgccatgttttggccataaatttgctgttccttaaagcaaaggtgagaagtagtaggctaccaatcctaggaaaatgagatgaacactttcagactactgttcagatcaaaccaaggttcatggacctaaaacccattgatctactacatgatgcttattaattaattaatactcgaggaattgagaacaaaataatgcactgcagaaattgagccacatgggctcctctcccccctctattttatgcataggaacaactgtttgcagagacttgcagcaattactgcacacatgtaggaaacaacaaagaatatatcccgttttctactgtaccacatgcctctccagggggaccagaattaaaatcacacatgacaaagaacacaattgcccatctcatgcatcccatcttcatcctcatctcatgacacaccttggctagctgctgcactggaacgaaacggcttctgaagttctcttgctgtgctgcctgcatttgcagcaagtcacattccattgcagaggatgcttttgcatgggctttgtcagatgatcaagaagaggttttcaaggctgcaatgctcctgcccatcaattgttgatgctctgatggaccagtgattttttttcccctcaactctgaagactggaccagtaaggatgtctgcacttgtttacatatggatgtaactgagtggcttctatacttcaccggctgggtgtagataatgacggccactgctatcttgggaccgttcatcttttagcaacctacgtatcgacggaaaagtagccatcctgttgctagatgcagctatcttcctaggttaaggtcccttaatagtaattaaataatgcacatacaccctgtgttttcaattattaacagtgtgtaattccctgtattccatttatagtgtgcttttagaagtacatgccaagcatctataaatcatatacttcctccgtttcacaatgtaagactttctagcattgcccatattcatataaatgttaatgaatccagacatatatatgcgtttagattcattaacatctatatgaaaatatgggtaatgctagaaagtcttatattatgaaacggagagagtactgcacatccaatttacaaatacttgtcatttttaacacgaacgatatcaaacttttaaattttttaactataaataaattttgaaatatttaatttagccaaatgtagtactataatgaaattatacatttgttgatattttctaaatatatatagcaatagaaatagtggtcaaagttattttttacattgtctaaaacgataagtatttataaaattaacaacaagtttttctttaaccatgtatatatatatatatatatatatatatattcactataactaagaattggtcaggagcttcaatttgatatccatagaaaccgagagagataatcttgcttcactttaagatttaaaccctcatggatagagaattaaatttgaaaatatattggtcattcatttttctctcagaaatatctgagatgcaatttagttggtagaaacataccaccgatatcgttgaactgttgcacgaaaatgatgagggcgtgacaatgtgggtggtctcgcgtggcgacagagcgagggtagaatactagatgcctgggaccacgttactattgtttatttctcctccttcatattgacatttttttttgtttctaccaataaatgatgagctacaaaagaattttttttatcacaagtgattactctttttttttccattttaaagagtggcattcgatgtccaatgtcttaatcgaagtatggatgtcagaataaatagaataatgataaatggaaaaaagagaaaaatcctttaattgtataaggggcggatgtagccaagtggattgtgaatccaccatgtgcgggttcacttcccatcgttcgctcatcccaatattgcaaatcctaaaatgcagttttccatattcctagttacgtatttaaaccagcgagaccgatcagcatgccaattcaaatggactaattagttaattgctaatcactaattaatcaatttccaaaacgctgtcgcttttggtctcgcacctcgccacgcgagatcgaccacgtcgtcacgctctcgtcatttttacataacggttcagcgatatctgactatatttctatcaactaaatcgcatctagatatttctgagaaaaaaaaatgaatgagcagtttcaaatttaattccatggatgtgtaatctccccatacggggaagcaacctgtctaaaagataggtaatctccccctttccacctttccagaagcggtgagtggtagttcttgtttggtgtagaccacgtcctttgacaagtgcagcttaaactaaagccagagatgttaccctcacgcactcaccatcaaagagaacacacttgcaagatctttgcgcctaaaaacatggacacacatacacacatatcataatcaaccttgcaatattacggcgcctaaacatcaacggtttgtcacaccaaaacgcatgagatattccatcgcgcgtgcactagattatttctgcgtggtgcagcaccataaaaactgatcaattctttttccctttctctgatcgtgtccagtttcatctttctgaaacgtactttgaccgcaccagctgctgggacagtgactcacgagtggcacgactcgagagtagctgacagagccaagcaatattgatttcgataccgttgacgtcgttgcatatgcaaatagtacgtcttcttgacatgtcttttgacgtcctgtttcattggttttgctgtcgcgtgttagtaaacagaaacctccaaacgtgtgtaaaaatttctcgcccccgataacacggtaaagcttccatccatgtaaaaaatcaaccaaggaaagagtaaatttttgttctctctgcatggcaggaataattgttactactggtaactgtatattgtgcaatggtgggtccataattttttttttaaagcctggacaacggtcactataaccattgtcgggaagtacctatacatctttcgaaaaatttttatgacacagatttttaatctttgaattaaaatccgatagatataataaaaagcaaaaagcaattaagaaacaccataatggacactaaattaccatatcctcaagaaaaagaccaaatccaatacaaaatttaaaatttacatgcgaagattcaaaaattatagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgctattgtcgatattgatagatactggtgacacgatatgtctggccttttaatccgcacaggtaattaagcccagacggctaccgtctctatttttaaataaaccaaaacgatttatttgaaaatataaattaatttttaggtaaaattttatatgtgttcatatcgacttaaatgccaatactaaaagaaaactatattgaaaatatcttaaaattaactttaaaattaagattgaaaatttaaattttaacttttgctttgatttattagtgcaaccaataggctcttattgtccaccctgttgaagagagcagaaggtactactacaaaattccatggcaccatgtaacagaacattttttagatcaaacaccatccaaaaacattgggaagtgcatatgtgaaattgttaaagaacatgctaatgcttttcttttgataaagttcctaaaaactgtgatatgcaccacctttcttcccctttggtgatcgataataattaataagctgctaaataaggttaagatgtggtttaggtaagcagccatgctggacttttagggtttggaggagaggaccttgcggctggcggttgagaacttgagatcgatggtagtgatcagctcgtggttagcagttgaggtggtagtgcgagaaaaaaaatagtaggagagacaactacggggaaggagaagaaaggtgaggaaacatatcatatgcttcgttaatgttgaagtaggcaattgccgggtgcaaaggaaacaacatgtacattaacatgtagaagtgtagtgtcgatccaaaaatatataggattgaatgtacgtatctttggacacaacgttggtatttcattaatatagaattaggtgattatagccattggaactatgataataccaaattattttcccaaaaaagtatgatatatccattctcatctgtcggtgtacatctagctgaggtttttcattgcccactacgtatatgtacacatgccgacacgtcaccgtgctgatggaacccaactgtttgacgaaaaaattgaacacaccggcctgggagatctgcttagctccagtgcaggtccaaatatgatgagatgcgggcgtgccagtcaatttgatcctgcaactgacgagatatgcaaatattagatcaaaatagccaatcggctgacaagccgatggagtagttccagccgatacccgatgccgatactagccgatagcgatagggtttaagcaatcggctatatgtcaaatgtagataatgatataaaggcaatcggctgatgatgatgtaatatagtaatataatccagtagaaaccaatcggctaacaatatgatatagtagaacaagtattgatccgaaggttaaagcacccatcagctggaggtccgatgtcatgaaatccacaagattagattaaacaatgaaacatttgttgtcatcggctaaatccaacttatatgtatatgcaatccttatgagccgatgcaacgtccagataactcaccggctgaaaccccgatgaaacccttattggcaatcaataagcaggttagagattatggttctaagcatgact

SEQ ID NO: 5498 - DNA, 1040 bp, Oryza sativa
tgtagatgatacaattgcctgggccgacggaacattggacttaccctttcactggagatcgaacaccgatgcagccccgcgtcaggtgccaagtcccgccggacgataaaataaagtagaaaaggtaaaaggtggcgatgcgccgaattgtattgattgtgaggatagattacaatgaccccaggtgtacatatttatacccatgggttgatacaagttcttgtcggacaagaaagaaaccttcctaaagataaaaggaaaatataaagttcttataggacacgaaacacactttcctagagataaaaggaaactaacaaactattcctatttaatagataacttgacatgccgcattctctttaaactcggtcacttatggataagcttctattagtagattgatttccttagccgaatataacaggaatccgactattggcgacttgataactcccatcggctgatcccgagatgctgcagccgataatgactctaagccgatgacgtctttgccgattaccaaatttcatcgttcgaatgttttttcttattttattagtagtcttatagtagtcttagattttacattttgatgagcctcgttttaaagaattcagattataagacttttctactattgcccacattcatatagatgttaataaatctaggcacacatatatgtctagactcattagcatatatatgaatgcaggcagtgctagaaagccttataatatactccctccgtcccaatatattaaaacataggacatgatgggacattttctagtactacaaatctggacagactgtctgtccatccagattcgtagtacttaaaaaatgtctcatactatcctaggttttaatatattgggacggaggaagtataagtatgtcaaacgttgggctggtgtctttggaaaccgaggatctcaaattctcaatccgcgcgcggtcccgcgggtagagacaagcaaaggaggagaaccagcgccacgccaacgacgaccggtcgatgcatgcccggatgc

SEQ ID NO: 5499 - DNA, 8098 bp, Oryza sativa
gcccgatttggcggtgtcgtccgtcgcgctacgctagcttgcgtgcggcgcgcgcgcggccacccaccacacgtcgcgtcgaccggtcgatctacgcctgcgcgcgcgtcgtctcgtctcccgtcgcgtcgcgtcgcgtccgcgctgagctgagctgggggggccgcgcgctgctgtctcgttacgccatcattcatatgcgtcgtcgtctggcgcgcgcctgatctgaccggaaaggctgccgttttgcctgacgtgccggccggccggtccgcgcggtccgtgacttcctccgatcccttgatcacagcccgtggattttgcccgtcacggcagggggaacgtacgtgtcatcatcggcctcctcgtcgatcgatcatccaaaccacaactccacgacggcctacgtaacatcgatcctctcgtttcgttacctgcgctctccttttccgaccgagatataactttccacgaaaagaaaacgagctttctctacatggagttcaactaccctactactactactactactagactagtatgattacatgctgaattgctagtgcttctagtagcaacataattaatccaagctaaggaaccatttgaatagaagaatagaaaaacactggtttattacaaagtattgtaaaatacagaaaaacacagaaataatcatttgattaatttaacctttttttcgcgaacgcgtaaaagattgcacgtcaatatatttgaagaaaaagagtttaagttacatgagccaatcagccagaccagcctattctaggggaagggagaaaaagcaaatgaaaaaaaaaactgaagcttagggagactacggcggctaaaaacagactccaagcagggggaaggggccaagccacgctagactcccaacaaatccccaaaagcggcgacgccagctaaagaccacagatggcccttagagtggatggactccagaaccactgagaccgaagagagagcggagtcgaaaaccctagagttccgctccttccacagatgcaaagagaccagacgcaccagggagtcgaagttgtcgcggaggtgctcaggtaagcaggccctggaggacggccaccagtcctagaaccagctgccacggtggggagagagggcagcccagctaggaggcgacaacacccgaaaccagacctgccgagcgaacacgcagtcgaggaggatgtggttcgccgtctcaagatcctgagcgcaaaaggggcaggccgagtgactatcgatgccacgcttctggaggagatcagccgtccagcagagctgctggaaagcaaaccaaagaaatgacctgaatttggcaggaccctttgcattccagagaagatcagcatatgcaaaggaatgctggccatagaagaatgcatggtatgccgaatgcgctgagtagcgctggtcagccgtccaacgttaaatgagatgatccttgacacccggcgagagctgtacatgaagcaccgcatcccaaataaggagaaattgggagatgaccgggatagtgagggcaccgcggatatcagagacccaagagttgttgctaggccagaagcaactgtgcgcgaacctcggagacactggggaacgacgaagaggagatctagagccaaggacgccaccgagcggccgtcgatccgttggtcagaccagaagagcatagactcaccatttcccagcaaaaagaaggtggatgccatgaacatgtcggagacggtttgctcgactggggccttcaggccatcccaataggggtgccctgagcactggagccagagccagcgaacatgcaggtcaaaccctgccaatctgaggttagggatccccaacccaccacaagttttggggcgacaacgttcgtctaggacacccgacactgcccaccatgagccgagtccgtacctgtccacaggaaggcgcgacacttcttgtaaaaggccttaataacccagactggaaggccgatcgccatagatacatggaccggaatggaggagagaactgtctggaccagcacagaatggccagccagagtgtaagtcgtcccttccaaggcaggagtcgatgggagactttatccacaagcggttgcaagctggccgccttcggcaacttgcgaacggacaacggaatgctgaagtaggtgcaagggaaatcagaaaccgcgtagggaaagcaggactgaaccaactccaggtcctcagccgagcaacggatcggggtgatcgaacatttggcaaagttggtgcgtagcctggacgcggcaccaaaaacataaagaataccctggatgaactcgagatcctgatgaatcggggagaagaagaggaccagatcatcagcatagagggaggcgcggtgttgcaaggcccgatcattaagcggaaggaaaccaccggagtcggaggcgtggcggagcatcgcattgagtacatccataaccagaatgaagagcatgggagagagaggatccccttatctcggaaagtcaaaaatctaacgagagtccctaaagcacaaacatttccctaaatgtttgggctttctagctattgatgaaatcaaaacctcattggtcaataagatatgctgcagctgctgctgctactagtaccagtaccatgtgaagaggagctactccagcaggcttcggttacagattctactcgatcgatgaatgaatagattgtcaacacaacaaccacaccgaccagacgctagaaaggagaggagcacaaggctggaataccgtgtacaaccaattaatcaaatctcgatctctcccttcctctctctctctatgttttcttttttgtatgttttttccaaatggaattctcctttgctgtgaagtgccgggtgtcccgaatcaaaataatcacacccctgtacacaacacacacatacaggtacatgcattgatcgatacatacaccagaatccacgcgaaggagaagagaacaaatggaagcaaccgagcagtggatgtgtggggctactgctactaccctactactgtctctcttcttctcttctgagagtttctgacccatcaaatccctaaaagttgtgctctgatcgtaccactagtctgttagcgagggcattttcggaatccggccctgcccctgccacgggcagagccttttgttagttgtctcttggccttttcctgtgtcactatgcacacaacggacaggggctttcctgtcttttcctagctagcaatactagtactcctacctagtaatagtagctaattggacggctgagattggcgcggccggaagatcaacggcgcgccgtactgcgggtggagcagcatcagcacggtgggggcgtgcacgtaggtgggcgagagcgcgaggtcgaagcgctggaggaggacggccatggtgagcttggcctcgaggatggcgaggctctggccgatgcacatgcgggagcccagcccgaacgggatgaaggcgagcgggtgcttcgccgcgcgcgccgcgccgctggcgaacctcgccgggttgaactgggccgcgtcgggcccccacaaccgggcgtcgtggtggatcgccatgatcgggacgagcagctccgtgtcgcgcgggatatggatgcctccggcgtcgccgtcgccaccgccgccgagggtgacgtcgaacttggcgcggcggatggtggccaccgccggcgggtacaggcgcagcgtctcgttgaggatcatcccgagctggaagaagatgacagcgagaaccaacaaggtgagacttttgtcggcgtggaattacgggaatacccccactgggccatggatatggtttggtgtgcgtaccgtcttgagcttggggaggtggtccttggtggggagctcgccggcggcatcgccgcagacggcgaggacctcgcggcgggcgcggtcctgccagtccgggtgcatggcgagcagcacggtggcccaggtgagcaggttggtggtcgtctgcttgccggcgaagaagaaggtcttgcactcctccaccatgtcctccaccggcatcgtcctgtccacgccggcattgatcatgagccccagcaagtcgttgaagccgctgtcctgcttgtctttgagctcggtggtggtctcgtcttcctcgccgccgtcgccgccactgcgccggccgatgagccggaccaggccgcgcctgatctccctgtccaggccccacgacatcctgttcttcttggtcggcaggaacctgttcgatcgaattccggcgccaaccgtgagcccaatttcggcgagaatggcgaatcgtttgggagttttttgggttgttcgtggcgtgtaccgtacctgtatcccgggacgagcaccttgcggaaggcctcggaggcgaacgccatgaggcgggcctgcaagcggaacacgacgcggccggagtcgtagctgcggccgaacgtggcgcgcgtgatggcctcctccgccaccgcctggaaccactccgccacgtccacctccacctcgccgccgccggcgcacgccatggcgcgccacctctccgccagcgccgccaccgacctgccgacgtgcggcaccagccgctgcaagagagagacagagacagagcacgtgtcagccatcgtcgtcgtcgtcatcgcgggtgcgccccgatcgatcggaggatgaagaaacagaggagagactcacgttgaggttgtcggggtagaagccgggggtgaggacgcggcggtggtgagcccacttgtcgccgtggaggctgacgagcccgtcgccctccagctgccggaccacggggtgcgcctcgtagcggtcgaacgcctcggcgcgcgtgaggaagatctcccgcaccatctccggctccgccaccgtgagccgcggtgtcggcccgaaccaaatcaagaacgtcggccctgcaaccgcgacgaccgccattaatccatctgatcagacacgagcaagcacacaaaatccatccgtcctcaacataccgtagatcttcctccagtagtggtagaacgcgagcaccctggggagcgcgttgtgcggcgcggcgggcggcatgggcttcgcggtggcctccgccatgagcgccaccatctccctcacgcacccgacgaggaaccggtacggcgggccgcgcaccccctgccccgcgaagtgcgcctccagccgcctcggccgccaccacaccgcgtccgccaccctcgccgccacgtgcagcagcagcagcaccgccgccgccacggccaccgcctccatcatctcctcccctgtttcttgaaacagagcacacaaacgcagagagatcaggtcgccgccggtggttgcgccggtgagtggtggcggcggttgggttgggggtttggattcgaaatgggaaggcgaggatggcgggaggaggcgggggttatatagcgaagcggggcggcggaggtggggcccaccggcccagcacgatgatctgttggtggtggctgcttggtaaattcagatgggatggagagagaaaggggggaggcgtcaacgaggtaggtgaagtgtgagaaaaccgccttcagttcagctgaccgagcttgggggtgctgacgtggcattttcattctcttttttgtagaacaacattttcattcgttgcagttgggaaaaatgagaggaggggagtgaaggcaaggcttttgcttgcgtgtgctgcttactcttgagtgatcgaaagtttgtgatgtactctctcagccccaaataaacccaaataaacgcaggcataagtttttttttcaactttgatcatctgttttatttaatttttttataataatattttttattgctattagattataaaatataaataacattttatatgtgattatattttttagtgttttcaaaagaaaaatttaaataagacgaacgattaaagttggataaaaaactcatggctgcacttattttgggacggagggagtacttattatatgtgtctactatgtacttatgtcagctttatagtatttagtgcaaaaaaaattatattctaaaatttaaactggtttatctggtttttaatgtttaacattgtttattgactattcattatattgaaaaaattacgtgattattatttatttttgttgtgatttattttaataagatctatacttttgcatattacataattttttaataagataaatagatattttttaatgccaacagtcaacatcttcaaatattaaaaaccggatgaggttttttttttattatgtgaaagaatacatacatcgctattcgcacacacccgcggatacatcttctatcatctgctaaataaatgaaggtcagcacctctcgtctctcaatttctattgaaaaagcagctgcttccttagtaagtaaaaaataaaactactgcaccagagctatacaaagagagactaatcagctacaattaggaatggtgttaatacggttttcactgtaaccatgagaaacacgttccactgtttagtgcttgaatatatatatattggaaattgttttggatgttaatgtggtagggtagttcagaccagaccacaaaacttagtatgacccagcttgtccctgcctgtttacgcaggtcagaacacggtttgagcaggccgcttaatttgggatgtcttcctcctacctacatgtcctgatatgatgtggtttcttcaagatgcccaatgattgattcttcacctgctaataataattattaactctttgaagttgtgtgttgattgaaaacacccgatcgaataaatcttttgcttatttaaattatggatagcgctgtaccgagtccagtgattaggcatcacacttccattattagaaaaaaatctcaggtgctaattaaattctaaacattgtcccagtttggtcaacatctatggtaaattgattcatatgagctcatataactgagcgtatgcgcagatttggtagagtcgtatgtgtatgatttcactcgacaggttctaaaaatattaaagacaacaaattggttgtgttcattcctaattagcgcaaagacacaaagtttatacttgtattaaattatctgaaaaaaaacaaggtttcaaaattcaaatgataagtaggaactgtctgatactactagtatgcattttcttttcgcttgtgcatttaatcaactaattgttgtgctagtactttgcaaagtgacctgcatgcaaggacaaggagctctcaacaaagagtgacccaatataaatgtgacgtgcagcactcatttaatttttgtgcgagtacgtccagctttatttttatcgatcaaaattaaatctacgtcaaaaaatagctttcaaacttttttgtaggaaagaagctaggcattattattttctgcagaagacaaacagatcttcaccatcaaaaaggtcagagatgtcgacaagcaatccttacatacgagcccacatttttccacttcaccataccgtccaagtcacgctaagatcgagcattggagattttggtttcttacgcccccaaaaaccggacgagcaaacgtaagcatcaacaaacctcttaaaattaattacttctcgatgaaaacttatcgcccactactcacttttgctgtgaattaaatgtgcatctgttcatgtgtccaaagcaacatgtttttgagggagttcgttgaatcgatcgatcgattatatgtgggcaggttttaagaaaggattaaatgtgaaggccagtacagagaatgattcgattttcagtttggacaggtaatggccgttgcaggtagaagctgactagccatcgacgaggcaggcagagccacatgcagctcgagctggcgaggcaaccgtcgcatgcatgttcgttctaatagcttccatccgcttcgtatacaaattttgacaatttgaccctttgtaaaaactatttttataaataaatcgtcgccaaaacttattttaaaactgacccttttgttcagcgtcaaatcgtgtggcgctgaacttgcgttggcacgctgacttaacctcccatccgtggtggcacggc

SEQ ID NO: 5500 - DNA, 3832 bp, Oryza sativa
  unsure (1)..(3832): unsure at all n locations
cgagatctttaactatcgataacttagaaaatatactaattagatcaacatagatttgtcttacaaaatactataataaaaataaaaatatttctatttagttatatattataataaaaaacatagttaaagtatactccatccgtcccaaaataaaccaactcgtactagaatgtgcaacaaatcgatatagagtatgtttaaatttgttgtactactagattgatttattttaaaataattgtaatactccctccgggctgggtttattagtcgttttggctcggttagctgtggatgagaaaatttgtcgttggagcatttttcccacgcatgagacgagattgcccttgtgcattgatggcgttattgttcccagataaccttcttgttactccttttaacgcttcgtttccatctcatttaattttcgcatgccctcgcgcgctatctgtactgaagctgcatgggctacactcatgcatggtgccatgcaaaattgccaagacaaaaaaaaaggtatgtatctagagcagaaatcgaactcaggtcccaagacaccaatatgaatgcactaaaccaactgagagagtagttgttggttgtttgcatgctacacctaaccgtttttaatagggataaaataggaaataagaaccatacttaatgacttcttggtttttgaaatcctgtccgaaacgactaataaacccagcccggagggagtatttttgtagatcatgtccgaagaaactagcttctcatactcatagaactacacaggtccgaacaaacctctctgaactgttgacgaccgaccaagtacacgcaatgacaccaaaaaaaaaatttatcaatggcctgtttcgtttggcccagaagtacacaaccgcgcgcgatgattgaccggccggctgcatatcgctgccgacgtcaacgtcgcgagctaagctaataagctagtagccaccacacgcactatcacaaaatatgtgatgcattgtgtacatttgcagactaaaattgcctacgtctctaaaataacaccagaaactcgtggaatatataacaacatagtccatatatctgtgataactagctttcttggttgaggccgaattaatcctctcttgaccaatcatcacggacgcgtacatatatagaagaatcatacttgtacacgatatatattggacacagacgcatgcctgtaaccaccgttctgatggacgctgctagctaacctatacccgtgtctgtgtgatgaacgttaaccccgtatgtaatcaacgattctggctgtgttctttgctcagtgttatcaactcatcttcctcatgttacacgcgtacgcttttcaacatgctaaacagtatgttgttttaaaaaatatttctatacaaaagttgtttaaaaaatcatattaattttttttaaaaaatagttaatagtacttaattaatcaaatgctattaatgaatcttttcgttttctatgcgcaggagaaacgaacccagccactgtgtgtggtggagccgtacgtggatcggtggatggatcgggctgaggcggtgtgtgtgggcgtgcgtacgttgcgtcgcgcgatccggcgtacgtttctgcggggggccgtggaaagaggcgcgcaccgcgggacggtgccgggagggcgcggcgcgcgggcgggcacggagcaccacggttgggctccgcgccgtccgcgcgcggggaagtatattaaccaggcatacggcggttgttgcttgcggctgccgcgagctaacttgggcgaagttgcatgggtgggctgaacgagacagagatagatagggagagagctagctaggaacattcctgtgcatgcacgtctctctctctctctctctggttgagacctggccggcctcgatcctagtagtagacaaaccagcaacgagttgtacatgcatgcatgtgtgtactttgtatatagacgacatgatcaatacatgggggtatgaaacgatcgagtaacatgcaggataccatgtattgtcgtactaggtcatagtaatgccataaattaagttatgtgtctttgctactttgagatagatttcgttgcagcgacattttttttccgggggtgaggatatgccacaattgtccacatcttctttctcttctcccccctttaacatcggacatctctccattactagctttcactacgattgtcggcatccatatcctttcgtgtccccttccttttccacacctgcacccagtggcgaagccagaatttagggatagggggtgctggcacgagacgtaagaactcaccaacgtctcggtagacaatggtatggatcttggtgctcagatcctgcagagtggcagattggcctcacccagttgccttttgttcgctctaatatgcgtagtcacccctcgtataattatatttagaattttgtggttatttgtcgtttgcactaatatatacataaaatgattgttgatatgattttggatatatttcagcacattcttctagatttatatataaaattgaacttattatagaatggagcatgtatgttccgagtccgaatttactttaatatagcataacaagaaccatttttaaactatgtcactaaatagcaccaactttactcaatacttgaatgacacgatcgacatcatttctatttattctttttagttttggagacttgcaaccatatcgcttagttacgttaattaactcaggtgaacagctagatatatgctcaacttgcaactaattaatgagctaattgtatagattagatggctaatcacccggggtttgcatgtagcgcatggggatgggggtggcttcgccactgcttgcaccaccaaactcaccgctagccgctccttcacccttgcacggtgaacatgcgtggttttgcatacactatccctcaagttactgactccacgtctctcgcctcctgataatcggtgatgtgcttcccaggtgtggccgtttatgggctatactccttccatatatatagccattcgttgtgcgcctctcgggtctttcctacctcttgcatgaggaggagctccacacttgcattgcctcgagggatgatgttaggtgtgcgagtgtgacataggcgacagaagtcgtcgtgtttcagtggtgaattcgggcgctgtgctggtcaaagttgggcgagatggtggcaggagttggacgttgaggcaaggtgagaggaggaatattagtaagaaaagaaaacatgagtgattttggtacatggcattcagagtaaaagagagttatccccctaaagtttgtggtatttcttcacaaaatgaacaaacttcatggcaaatgagcaattttccattgtttaaaatatgcgaaaattccaacaaattaaaattaaagtagatgcaacaaacacttcaaaaaggagaagacaacacaaatataactgtgtgcatgtttgattgttactacggtatatctacttgattataggaaaaaaatacttttataaataaacataacaaaaaatttaaacaagtgaatctaagatatataatagaaatcaatacaatataagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5501 - DNA, 15154 bp, Oryza sativa
  unsure (1)..(15154): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtgagctctatagagtgctcgtcatggcttcgccggcgtcggtcgccggcggtggtgaggatagcaatggctgcagcagcctcatcgacccgctgctagtgagccgcacgagcagcatcggcggcgcggagaggaaggcggccggcggcggcggcggcggcgccaaggggaagcactgggccgccgccgataagggggagcggcgcgcggcgaaggagtgcggcggcgaggacggccgccggccgctgctgttcaggtcgtacagggtcaagggctccctcctgcacccgtacaggtacgtacatccgatcgagtgtacgatcgaaaaatcagcgacattgcaatgaaaatctttttatgcataaagattattattagtactgagcttgctagatacagaatctggacgctatacttttgttacttcctctgtataagttattttagtatttcccacatttatcttgatgttaatgaatctagatagatatatatgcttagatttattaacatcaatataaatgtggaaaatggtagaatgacttacattgtgaaacgggggagtatctaaaaattagttaagccgggaatgtatgcgttttctagttggtagaatgaagtatatatatatgcaagtcaatgagcacgttgatcatttggatggatcgtgagtgatatatattctgctcccggatttctttcagtgctaatccgttgactcgtagtaacccacagtacggcctcatgtttccaataatgtctttgcagcttataattggatcaagaatatttaccctttctggtcacctgggcatgtgcatttacttgcatttctagaaataattgtttttaagataataaataaaattcagccttcgtttcaatagaaattaactacagtcggatcatgttttttttaatctcttacagggctctgatctttgcacgcttgattgccgttctcctcttcttcggatggcggatcaggcacaataattctgacataatgtggttctggacaatgtcagtcgccggtgatgtttggtttggtttttcatggctacttaaccaactcccaaagttcaatccggtcaaaaccatacctgaccttactgccctaaggcagtactgtgatctcgccgacggaagctacagacttcccggcatcgatgttttcgtcaccaccgctgatccaatcgacgaaccggttctatacaccatgaattgtgttctctctattcttgcggctgactaccctgttgataggtcagcctgctatctctctgatgatagtggagcattgatcctatatgaagcattggttgagacagccaaatttgctactctatgggttccattttgccggaagcattgcattgagcctagatccccagagagctactttgagcttgaggcaccatcgtatactggaagtgcaccagaggagttcaagaatgactctaggattgtgcatcttgagtatgatgagttcaaggtgcgattggaagcacttcctgagactattcgtaaacgatcagatgtttacaatagtatgaaaactgatcaaggagcaccaaatgcgacttggatggctaatgggacccaatggccaggcacgtggattgagccaatagaaaatcacaggaaaggacaccatgctggaattgttaaggtacataactccaccttaattttttttctaatgtattactaaggggataatatcatattgtgcaatccgcaattaccttgttaagtggattcaccataaattttccattaacatgacctacatatttgtcaatttgaacaggttgtgttggaccatcccatccgtggccacaatcttagcctgaaggatagcacgggcaacaatcttaattttaatgccactgatgtgcgcatcccgatgcttgtctatgtgtctcgtggaaagaacccaaattatgatcataataagaaggcgggtgcattaaatgcgcaacttcgtgcctctgctctactctccaatgcacaattcatcatcaactttgattgtgatcactacatcaacaattctcaagccttccgtgcagcaatttgtttcatgcttgaccaaagagaaggtgataatactgcctttgttcagttcccacaacgctttgacaatgttgacccaaaagaccgatatggcaatcataatcgtgtattctttgatggcacaatgcttgccctaaatggtctccaaggaccttcataccttggtactggttgcatgttccgtcgcttagctctctatggtattgatcctcctcattggagacaagacaacatcacacctgaagctagcaagtttggtaactccatactcttattagagtcagtgttagaagccctaaaccaagaccgatttgctacaccatcaccggtcaatgacatatttgtcaatgagctggagatggttgtgtcagcttcattcgacaaagaaaccgattggggcaagggtgttggatacatatatgacatagccacagaagatatagtcacgggttttcgcatccatgggcaaggttggcgatccatgtattgcaccatggagcatgatgcattctgtggcactgcacctataaatctaacagaacgtcttcaccaaattgtacgttggtctggtggatccctagagatgttcttctcccacaataacccacttattggaggtcgtcggctccaacctctccagcgtgtctcatacctcaatatgacaatctacccggtgacatcactctttattttactctatgctatcagccctgtgatgtggcttatccccgatgaagtatatattcagaggccattcactaggtatgtggtgtaccttctcgtgatcattttgatgattcatatgatcggatggctcgagataaagtgggcagggatcacatggttagattattggcgcaatgagcagttcttcatgatcggctcaacgagtgcttacccaacagctgtgcttcatatggtggtcaatcttctcacaaagaagggtatacattttagagtcacttcaaagcaaacaaccgctgacaccaacgataaatttgctgacttatatgagatgagatgggttcccatgttaatcccaacaatggtagttttagttgctaatatcggtgccattggtgtagctattggaaagacggcagtatatatgggagtatggacgatagcacagaagagacatgctgcaatgggactcctattcaacatgtgggttatgtttctcctttacccatttgcactagcaatcatggggagatgggcaaagaggtcaatcattcttgttgttttgttgccaattatctttgtaattgttgcccttgtatatgttgctacccatatcttactagcaaacattattccattctaggtgcatagataaaagattgtattgtttaacttttgtaataaataatattgttcttgaactaatccaattgtgtcaaatatttttggacttaccttatatgagaactttcatatgtattaccaactgtctttacatattcatgtcatatatattcttcatattgaacatatagaaaaatcacttgagtaaatagaaaagcgagtggtttacatcttaggatgttggtaatcggtataattggcaaggatgcgtcaacctctttaatataactttcttggtgaactttaaaaagaccacacttgggctatatctatatgaatacggtggaccgtgaggtttaacactgaaaaaatgctaccactgtagatgcatgctaccattcaacaagcatctaactctgagtctgttcaattttacttctttggacttcccttatatgagaactttcatatgtaccatcaactgtctttatatattcatgtcctatatctttttcatattgaacatatagaaaaaccacatgagtaaatataaaagcaggtggtttgcagaaagaaatttaaaaatatactgttcatttatttttttaacaaaaatattcgggatacaattgttttggcagaaatatacgtccgatctcacacgatcgttgtgcgaaaatgatgtgggtatgacgatacggacggtatcgcacagcaatggtgcgagaccgcacggtctcgcagatgaaaagagcgagaccgaacagtctcgcgaaaggaaagagcgagaccgaaacaatgtcgcataatgaaacagcgataccgaatgtgttgtccaatggtttcgtttaactagtgattgattaccataattagtgattaattaatgatgattagggattaattagtcgctaatcaatgtgattaaacattaattattggccctgtcgcagccatgccgtgcggtctcgcacaagcaatgtgcgagaccgtacgctctcgcggctaaccaatacgaaaccgtggcgcatcgtcaccccacgtcattctcgcatagtggatcagcgataccgtatcgttttcgcgctttcatccagcgacgatggtatacttttgtaaaaaaatttgtatcccgaatgtttataagaaaattataaataaacaatatatttttaaatttaattcgtggtttgcatcgattttaggatattggtaatcagtagaacatgcaaagatatgtcaccctcttcaatgtaacttctctggtaagttttacaaagatcacacttggagtggatctaaatgaatacggtggaccgctcaacactgaaaaatgctttaccattcgacaagcatctaactctgattatgtttgttttttttccttagaaaggaatttgaattgttggttcaaagcagacaaaagtaaaatccaatatatctgtctatgctattcggttttgatttttttttcacctttctagttctccagaacagaatttagaccgctatttagaaatacctattactaactctaattaaacaagttacaagaactgtgcaataatgacaaatcaagtggtgtagctttcatgtgtccaattctgctggtaaagaatctgatgaactgttaaaaaaattagatgtctaaggacaccaattataaagtgttaaataaaaagaacgagagtatgtgtgtgagtttaggcaggtttaggaagcacacgaactgattcggagcaaattgcacttagttaatatggatttgctgaaacactatattcaacgggcatgatttggtcagaaattacggactaaagtacagacttctctcttttcttttgtgctaacccttcctcagaaaaacttaaacaactccgctggttctttccaaagaaacataaataaactaataaataactcaaatggaacatctcagttattagagtatcttcccctcgaaaaaaagttattagagtatcagtgggcgagctcgtcagctgctgatttcatttcaccgttgctatccccatcaagtttggctgtccaccacttgatcactgtctcatatatactcgatcgatgctctccttgacctctctcccttttatttttcctcccctctgaccagcacggcagctaggtacgtacacatgttttaactctgtcttctcatacaaaacccggcaatattttttttgaaaatttgagcttacgtacgtacgttcgtacgtacgcgcttgataacatcatcaggagttcagaactcagaaaggccaacacatgcgtgcacaattttgggcataatccatgcacttgtttcgatatatatactagtagtaattagtaacaacttgagtacgtactcggttcggttttttgttcgtgtccaagtggacaacactatgttctcccgtacctttcgttccagctgtttttatgattttgacgtggaagctgcagcctatctctatcttttttaatcacctgagttaatcatcaagtgaatgatcactcgtttattacacataaactaaggtgattataacttttttaaaaaaagaacgacaagaatgatttatatgaaatatattcctttctctatctcaagatataatggattttgaatggatgtgacacatcttaatagtacgaatctggtcacctaaaatataagagatttaggatggatgagacacattctagcattacgactttggaatctggccaggttcctgtccgaattcgaaatattagaatgtaccccgtccatcctaaatctcttatattttgagtggtcagattcgtactactaggatgtactgccacatccatctaaatctctaatagtttttgaacggaggaagcattcaacaagcatatattaaatttaaattcaactagtataaattgtaaaaaaaaagagacaaatttgactacaaatatattacttagagtttaatttgttataacatgttgaatttaaatttgaacttatatgtttgtagagaatgatatattgcatattaatttattttgttaggtactccttccttattgtattataaaatgttttgattttttttaagtcaaagcagagtttatagaaaaatgttgaagtattttttttataaaaatgtatcaaaatatatttaatgttagatttaatgaaagatgttatagatgttgctactacgtttattccacaatataatcaaattaaagaaaactaaaaatgtcttgtaatataaattagatggagtaggtctctactgttgctggtgcagatgtacacgttttatttttccttgtttctgaagatgtcacacgatcagctgacttggctgctagaggagaaccgagaatctgtagtttctgcgcccgactggtgaccttgtgccggtggtttttgatcgccaacacgacgatcgttgccgagtttgatcgaaagagaggaacgaaaattacatacgctgcagagaggaaaaatgctcatcagcttgctgcactgtgacagtggcggcttctcttgtaccacgtaggtagcagcagtattttgaccaggcagggtgagacgatgatttaattaaactcatgtcgtttcgccgcgctatataagccaccacgatgtgttcaccagttcgccacggagcttacgtagttagctaggtgcgtttgcgtgcatggagttggctacggcctccacgatgtccgcggcggccgtgactcgccggatcaacgcgggcggcctccgcgtcgaggtcaccaacggcaatggcgcggccggcgtctacgtggcggcggcggcggcaccgtgctcgccggcggccaagcgggtgaacgacggcggcggcaaggatgacgtgtgggtggccgtcgacgaggcggacgtgtcggggcccagcggcggcgatggcgttcggccgacgctgttccggacgtacaaggtcaagggcagcatcctgcatccttacaggtctgaccgcctgggcccacactgatgtcaaatactactaactactcttataaacttataatcaaacttagacaaattaattgcgaatcaataaagtgtgattaatttacagcattcattttggttgcccttatgctgttctctaatatacgaacaggttcttgatcctagttcgactgatcgccatcgtcgccttcttcgcgtggcgcgtacgccacaagaaccgcgacggcgcgtggctgtggacaatgtccatggccggcgacgtctggttcggcttctcgtgggcgctcaaccagctcccgaagctgaaccccatcaagcgcgtcgcggacctcgccgccctcgccgaccggcagcagcacggcacctccggcggcggcgagctccccggcgtcgacgtcttcgtcaccaccgtcgaccccgtcgacgagccgatcctctacaccgtgaactccatcctctccatcctcgccgccgactacccggtggacaggtacgcctgctacctgtccgacgacggcgggacgctggtccactacgaggccatggtggaggtcgccaagttcgctgagctgtgggtgcccttctgccggaagcactgcgtcgagccgagggcgccggagagctacttcgcgatgaagacgcaggcgtacaggggcggcgtcgccggcgagctgatgagcgatcgccgccgcgtgcggcgagagtacgaggagttcaaggtcaggatcgactcgctgttcagcaccattcgcaagcgatctgacgcgtacaacagagcgaaggatggcaaagatgacggtgaaaacgcgacatggatggctgatgggacgcattggcccggcacatggtttgagccggcggagaatcaccggaaagggcaacacgctgggattgttcaggtacgtaacgtacgcatgaagcgagaatttattccttttccaatatctaaagacagagttattgcattttagtttctgtttagggcatccacaatgtgaccataagagtgagccttaagactttttttcagctatatacattgtggacatggacataagacattaaatgcttaaaaacagctctaaccttacagttgaacttaagagattaaaaaatgatatctaatggagcctatcagcatatgattgcgaattggtggtatgtttcttctttgatgggacccagtgggacccggcttgtttctcatccaaggccataaccattgtagagatagatatagctaaagctatctgctcattcagcaacccaacattgaggttgcccttataatcttgttctgacgacaaattttgtcgagtggagatggactattgttcatagagggacgtgtccctcgtctcgtttagtgcatatcatttaaaaaaacattaaactttttttttagaaaaataaataagatagatcaatatgtgacatattattccacaaacacaccagttcaaatttagtctatacaataagaaataaaagtaatagatttgactaaaaattgcacgttctatttagaatcaatatattttgttatttttgttttttcttatataagttcagtttaaacttgcaagtatgtaaaatatcatatcccatattgatctacttacttaaaaaaaactagctaaggcccctacattgcaacaaatactgtaagagataaaagaaaacacaaaaaaaaatacaagtttatagcatagttaatggattagaatataatgcaatatctaaaaataatatttacgtgtggaccttatggtcacatggcagcttgtaacattaacgacaactagcatggcggcccgcgcagattgcacggctagcattgttagattttttttctcatacaatagtttaaatattttcatattttattattgacaacataattttaaattcttggttgaactaacaaatgtgtgatatttttattgtattgtatatatgtgatagttatttataaattatatttctatatggactcaagaatcatattttaacattccttattttaaattttgaattttctttgttcataaattatattcctatatggattctggactactcttccaatattcattttttcttagctctgaattttagttatttataaattgtatttctatatgaactctaaactcttctttcaatattttttttattttgaatttcaattattagtaaaccgtattcctatattgactctagacttcttttctcaatatttttttaattttagttatttctaaattgtattcctatatagatgctggacttttttttcaagatttcttatttgttaattttgaatttcagttatttataaattgtattcatatatagactatgacacttctcccaatcttactttttttaattttgaattttattaattctaaattgtatttctatatggactctaacttctaattttagttttcctattttttaattccgaattttaattaattctaaattgtatgcttgtatggactctagtatactctttcaatattcattatttttaattccaaatttcagctatttttaaattgtattcctatatggactctactttcgaatttcctttgtttataaattctattcctatatggattctagactactcttccaatattattttttcttaactctaaattttagttatttataaattatatttctatatgaactctaaactcttctttcaatattttttagttttttaattttgaatttcaattgttggtaaagtgtattcctatattgactctagagttcttttttcaatatttatttttttaattttagttatttctaaattgtattcctatatggacgctggacttttttttttccagtattccttatttgttaattttgaatttcagttatttataaattgtattcatatacggactatgaccttctcccaatcttaatttttttaattttgaattttagttatttctaaattgtatttctatatggactctaacttctaattttagtttttctattttttttagttccgaattttaattaattctaaattgtaggcttgtatggactcttgtctactctttcaatattccttatttttaattctgaatttcagctatttttaaatagtattcctatatggactctactttttatttttcttcgattaacgtgggaatttctaagccgtgagagcaaacatggtagcttctttttctattactttccatctaggctcttttttcatatattagaatttttatttctctctaattcatgtgaaaatttttagtctatgagagtggtggctccttttttatttctatttctttattaagataatagattgagtttgccttcttgttttgatatcgtttcagctctatggtattttagagcatcagttagttgctattttcctgaaacacttgcttttatctcacaatttttttcatcgctaaaagtcggattcgtacagagtttcatcactattttgtacttaatctttttttcctttttttttgttgcggtggattgtggagagaagatttctagcgtactatttatatattaccatggcatgtaatttgtgtacaattcagattgcatgaatctgacgatgatttttttttagtctgtcttttattagtgtctcacacggttttcaaaattagtgtctgatacgttttctaaatcgaaagaaaccttgtccgtttcctgtatcctacgaaagcatattagtatgattccgttttcctttttttagtttttgactgttgtccgattcaagtatcttagttttttttagttttttttgcctttctttagtttttaactaatcctaatcctaatcttagttctatttttccttttttcttattttttaattaatgtgagaatttctagaccgtgagagcgaacgtggaggcttctttttctattactttatagatataatagattttagacaccatcactaatatcttttaatgcagtataaatataattttttttaactttgaggcaacatgcacaacctagacattccctccgagaatataatagactttccccaaagtgagtggttttctttgtgtttttgacaggttttactgaaccatcccaccagtaagccacggtttggagtggcggcgagtgttgacaacccgttggacttcagcggcgtggacgtgcggctccccatgctggtgtacatctcgcgcgagaagcgccccgggtacaaccaccagaagaaggccggcgccatgaacgcgctgctccgcgtgtccgcgctgctgtcgaacgcgcccttcatcatcaacttcgactgcgaccactacgtcaacaactcgcaggcgttccgtgcgccgatgtgcttcatgctcgaccggcgcggcggcggcgacgacgtggcgttcgtccagttcccgcagcggttcgacgacgtcgacccgacggaccggtacgcgaaccacaaccgcgtcttcttcgacggcaccacgctctccctcaacggcctccagggcccctcctacctcggcaccggcaccatgttccgccgcgccgcgctctacggcctggagccgccgcggtggggggcggcggggagccagatcaaggccatggacaatgccaacaagttcggcgcctcgtcgacgctagtcagctcgatgctggacggcgccaaccaagaacggtcgatcacgccgcccgtggcgatcgacgggtcggtcgcccgtgacctcgccgccgtgacggcgtgcggctacgacctcgggacgtcgtgggggagagacgccgggtgggtgtacgacatcgcgacggaggacgtggcgaccgggttccgcatgcaccagcagggatggcgctccgtgtacacctccatggagcccgccgcgttccgcggcacggcgccgatcaacctcaccgagcgcctctaccagatcctaaggtggtcgggcggctcgctcgagatgttcttctcccacagcaacgcgctcctcgccggccgccgcctccacccgctgcagcgcatcgcctacctcaacatgtcgacctacccgatcgtcaccgtgttcatcttcttctacaacctcttcccggtgatgtggctcatctccgagcagtactacatccagcagccattcggcgagtacctcctctacctcgtcgccatcatcgccatgatccacgtgatcggcatgttcgaggtgaagtggtcgggcatcacggtgctggactggtgccgcaacgagcagttctacatgatcggctccacgggggtgtacccgacggcggtgctgtacatggcgctcaagctcttcaccgggaagggcatccacttcaggctcacgtcgaagcagacgacggccagctccggcgacaagttcgccgacctgtacaccgtgcggtgggtgcctctgctgatcccgaccatcgtcgtcctggccgtgaacgtcggcgccgtcggggtggcggtcggcaaggcagcggcgtgggggttgctcaccgagcaggggcggttcgcggtgctcgggatggtgttcaacgtgtggatcctggcgctcctctacccgttcgcgctggggatcatggggcagcgggggaagcggccggcggtgctgttcgtggcgacggtgatggccgtcgccgccgtggcgatcatgtacgccgccttcggtgcgccgtaccaagctgggttgtcaggtgtcgcggcttctctcggtaaagcggcgtcgctgaccgggccatctgggtagggacgacatgagtccggatttgaatttgatgaatgatctcgcgggggtaataatccgggtgttcagatatatctcgttacgtcatgagggcggcagctgattatgtgctagtctactctgatcgagtgagacttgaattattttttaaaatgtgaagacttgaattattttattttattttatttgttcagtgtgatatgttggcattaaattcatggagaactttttttttctctgtgttgttttttcttaaagagtactcctatatactgctataaatatagatgacacaacattacaagtttaattaattaagtttaagtaccattttagtgtgttatatacactactagtcacatgcccatgcattgtaacgaatctaaaggaaaaccgatgaatgggtatgggttcacaatttttaagtcatttttaatactttttcaattcgagtaaaattttgtaatagaacttctttgtttcattatttaaaaattcaatacttttaacataaattttgaaacttttaacttaaaatttagaactttcaaattgaaattttaaaaacactaacccaaattagaaacttttcggctcaaaatttgaactattataaacacgtaataggaaaaaaaactttaaaatgttccatatatgttgggcctacaagtctgcagggccatggaaaggcctggagcagaggcatagatgcgtcaaataaattttccataggagtaagtctattttgcctttctcatctctggttgttgattgaatcacttccctcaatcacaaaaccgggtaaaatgactcccccatctttaaaaaccggtgcaaatcagcttctttggtggtttggaaggtgtttttttgctcatgtagcatattgaccatggttgactagctaagtcagcgggtgggatccacatgtcataaaaatctcatatacttttgcccctctcccttccccctctctcttgctaggcggcaaacgatggcggccagcatcgtggggccctagctcgtagccgctgaagggctagcgcggggtgaagacggcatcaagggctaagtgggagggtagggatgaggagcaggtcacccttgacgtgggaggatggaggtggaaggatggggaggagatcgctttggcatcgacagcggaagagagagaaggcggctcgagtagtggggagtggagtggggggtaggagcgacagtagaggaggagcgttgaggaaaggaggagggagggtggcagaatatagtgggaggaagtagtgaaaccgacgggtggaggcggagtagtggtcgcggcaaagaactgcgccacctccacgataggggagatggtgtagagttcacaagttttgggaggaggacgcggagcgcgcgagtgcatggggtgtcgtcgacgccactgctgtccggacaccatgaggaagtagatgacgaggttgttgccccgggcagtggagactgaggaagagggggtacacccccgggcgtgatgtactagctacaaaaaggagctggagcatgcaccgccaatgcacagcgacgaacatcgaggtggtggtggtgttgcagccgcggtgacgccgtcgtcttgtccctcgccgactagtcttgctgggccccaaatccgccgcctcccatctctatctacgcgaggtaccctctggttagggagctgtcaagcttctccccc

SEQ ID NO: 5502 - DNA, 13169 bp, Oryza sativa
ccctcccccctccccccccccccgccctctttgcccccacctctcgatgttgtctacttgccatcctccttctgcgtcggcatcgatgaatttgtggagagcatattgacttctgcaccgccatgccatcgcgctgcccactgccgcgtcctcctttgcatcaccgcttgtcgctgtctctcagtcgcccgtaggtaagagagacggaggaaaggtgaagagaaaggtatgggaggaaagtagagagaaggatgacatgtggaaactactgatttttccgtagaggcttacctgtgagtctatgataacataaagcaatctaggccatgcatttgtgaaggctatactgaagcgcttctcaataaggccttattataaggtggtggcccattattcgttcaaaatattagtaatcagttcgaagccaatgacagcaccggccggaataaccagccaaaatatgctaaatttgaattgaagattcatagttctatttttatgaggaaagtttcaaagccccacagcttggccgatttcattggatgccagaaacacaactacacaagtgacaagaccaacgattactgcttgcagcggaatgagctgtagctagctgcagcaagtacaaccgagcaaggccataatttaaattggaataagatttggatatgattcgtatcctttaatcacaatactagatatctcgacccctcaactattaaaaccgatgcaatttgactctctcagtgtttttggaggacggtttcgctgacgtggcatctacgtggccgtgttgacttggtttgtggcattgacatgacacttaggtgtcattagagttaaaaacatatatgtgggacccatttgtcattcacacacaaaaaattgtggacccactgacacgtgggacccacacgtcatccactcctcgctccttcttccttctcgctccctcccttctctctcttctctctccccccttcgaccccatcaccgcctgccactgagtgcgaggaagagggcgaggagtcgtggcggtgaggggcgctcatggcagtggaggacctgctggctgctatcgctgctccggtcctcgccgttgtcggagtcggcaccgctcgcgttgacggagaatcccgaggaggcgacgagcacatgccgaggcttggacccagctttgtcagcgggataaaggggggactcgacgaaggcggtggagctctcctcctgctccttcaacaccatctcgtgcagcttccccctcggtgtgccagcaggagggggtatccgccaccgtgtaccctgccgccgcgcagttaattttatgaattcttctatagtttacggggcttaattgcaaatctattaacttattaaagtaatagaaaaaagaatctccatgttagttctcacggcctagaaattctcctattaatcaaagaacaagaaaaatagagtccatacaagtatataatttagaactaatgaaaattcgaaattagaaaaaaaataaaattaaaagttgaggttagagtcatatagaaatacaatttataaataactaaaatttgggattaaaaataaagaattttagaagaaaagtatagtgtccatatagaaatacaattaaaaagtaaaagaaattcagaattaaaaaaataaatattagaagaaaagtatagagtgtatataggaatttggaattaattaaaatctagaataaaaataataaaattaaaaatagagtttagtgtccatatagttaaaattagtacacttgtggacgtatggtacatagatcatgtgttctcatcttgatctgcataataaaaaaagtttatatgcataaattcgctaaaaagatctttgagaacttaaagtcaaaatgtcatgcagaacaaattcaagtcttcacatttttctctactattataaaagttgaagaagtttttgccggtattttggtacgtctcatccgtgtttgagttggttttttagttcgttagcttttgaaaatataattccgtgtatgagtcaaattttaagttcgtttgtttttttttgaggggaagagcaaagatatattactcaaccagaggagtccttacagagaatctgagatattatgctacaagtattttctaaccaaaaatcagagatgtgatcaccacgagctttacaagctaaaacatggatggcttgattctgggatctctgtatcttctttatggtgactcctctctcatcttccagcaaacatttaatctcgctgacaatatgcgagaagacagatcgatcttggtcttttgaaagcgccaaattaaccactgtcaagcaatctgtctctatgacgatggggagaatcgtccactggagtgccaatccaagtccttcgacacaggcaagaagttcagattctagcgcctcctggcatctgttcaaaaacctgcaagaggagaaaattacctctcctgaactgttgcgcagaaccattcctactcctcctgtttcctcctgtggatggaaggatccatcgatattcagtttcatccaccccgctggtggtttctcccacgacacggggacatccttgacagagcagcaaggggcaggagcccgcttagcaataccaacagccagtttccctttcttcaaatttgcaccaggattctgcttgatttggacaattgttgacatatagctttccaggaaccgccttgacgcccacacgggggcagccggcttcccatgagttatatcattacgaacctgccaatttcgccaaaggatcatgagaatcatagggtgctcctcagctggaactctccccaaccagtccaagaaccagtaagaaccccctctgatcgaattaatgtcagatacaagatttcctgccttggccatttccatccaaagattcctggcatgactgcatcgacatagagcatgtccagtatcctctctttctctatcacagatggtgtaggaatcactcatctccagtttccttttctttttattctccatcgttgccaaactgtctgtggctactctccaggagaagatcttaaccttgtgtggaacttcacatttccagattaaatcccaagaattctttgcacaaattgaagaggatgaagagctctcatccttggatgccagcctcactgcaaggtgataggcgcttctcaccgagaaccggccgttcttgtcggggttccaggatatgaagtcctccgtttccctatagggtagtctgatttttaaaatttcctctgcatcaacattccaaaagtattgagagaccttatctacatcccaagcaacattctcatcaattagctctgaaacccatttcagacgacaatgtcgtttgactgtaattggtcttctagtaaactccctcggcaaccaaggatctctccaaattttcattgatttcccgtttcctatcctccaaattaatccttgtttcagaagtaccaaaccatattccactcctttccatccaggagaggcattaccgccaaaaacagtatcaatgagggaaccattcggataatacttcgctttcaacacccgagcacagagactatcgggagattcaatcaaccgccatgcttgcctagctagcaaggcttggttgaaccatctaatatccctgaaacccatgccaccactctgtttcgacttcattagcacatcccatgccttccaatgagtttttcgccgtccatcctgagatccccaccagaattgacgagtgagtttgttcaaatcctcacacacagactctggcagtttgaagattcccatgacatacactggtatcacttggaggactgctttgatcattatttctttgccgccagaggacaggaatgtttccccccactgaataattcttttccatatcttctcttgaagactttggaatttccctctcttcatcctaccttcgggagtagggaaccccaagtacctttcttcaaattcgtctttctcaatgtgaagaatactcttaattgcttcctgtattcctggtggagaagcctcactaaacataatagaacatttcgctgggtttattagctgtccagtcccagctgcataagcactgagaacctcacttaccgcaatcgcctgttgttgttcagccttgaaaaataacaaggtatcatctgcaaagagcaaatgagatataccaggagcgcgtcgacatatctgaataggagagatggacccctgtgcaactctttctctcaacaacatagacaaaccatcagctatgaatagaaacaagaatggcgactgaggatctccttgacgaagacccctggagggtgcaaaggagctaaggagagttccgttaaatttgacagagtatctcaccgaggtaacacatgccataatccagttaacccaacggtgagcgaaacccaacttgttcaatgccatttccagataccgccaatccacacgatcgtaagctttcgataagtctagcttgtaggcacacattgctctattctgtcttctgttagtttgaatggtgtggaagcattcaaaagccagcaaggcattatctgtaattaggcgacctggcacgaatgcactttgctcacaggaaactagctcatcaagtatagtcctcaaccggttgaccaaacatttcgataccaccttgtacataacattgcataaacttataggtctgaaatcctttagctccatgggttaatcaatcttcgggataagaactatcgttgtgtcgtttaccccatcaggcatagtgcttgtctgaaagaacttgctaacagcatgtacaatatcctgtttaacagcaccccaattcctctgataaaaccgagcaggaaagccgtcagggcccggtgccttcaggggaccaatttgaactatttttcttagccctccaaactgcccggctgtgaaagaatcgagtattacgatcaccttccttcaaccaactaattctggagcgttggagccacaacatttcttccttgtataacaattcattcatatggtctgaagcttgccgaacaactgaactatcagctccattctctaacagagccgccagtctttttcttgccttttctgactccctgcctatattcttaaccttcctgttactccaagaacgcagtgaagccatcacccgatctagagctttgttaactttccccaggtcgcccttatcccctgcatcagaccaagcatctgccacaacctcagggaaatcagcttccctttcccacaatatctcatagtgcaagcacttgttacgtacagtgctagtatccttcatcttacagtttaacaaaagaggtgaatggtcagagcagggagaaaccaaatgaacaacatgtgcctcagagaaaatatccctccaactatcatctacaatcactctgtccaatctcaccttcacattgttccagccttccctacggttatcataagtatggggtagccctttgaaacccaggtcactcagaccacagatctgcaagacatcccgaaaagccttcatctgattctcatttctcggtgttttcgaaaagtgttcgaattgccataaggcttcattaaaatcgcctatgaccatccacggaaagtttgacgattgtcgaagggcattcaaagacgaccacatatggtgccgattctccacccgaggttcgccatacacaaaagtaacatgccaaacaggatcaatcggagacaaacgaacatacgcatcaatatatcttgcattcacatctttaatatcaacaatgacagattcgtgccagaacaaagccaaaccaccactcataccttcactactaacaccagtaaaacctctaagacccaaccttttactgaggcggcttaccttctcaactcgctgccttgtttcacacaagaagactaactgggaactagtgtccttgactaaggtacacagttcacgaactgtcgaggggttccctatcccccgacagttccaagccaagcaactcattgtccctggcgggaccctgccgtaggtctcgccagtgaaccagcagccccagcgctggtagcttccaagccagtcacctcccctgttgctccaccatccttcctgagtctctttagcgaccgtcctatggactcaatgtccttcttgctttgagctgtgctctcctctagctgtttgtactccaacaaagcttgctgaacaatgcctgtcttctttgtatctgacaaactgcctgttttcctcttgctcggactgcttgtttcatccatagagccttcatccaacgagtcctgataagcgctcagatccctgacagccggtatcatctcatttgaagggattggcaacagctccccccctctttcagccataatcaaatctctagagagccccttatcagtatttatgggtttatgctgggaactattcatgtccgacacgcgtatctggttggcctgttctgctagttgggcatccacaccttcatccccttttctctctcttgactcaaagccatcaaaagtatcaattcttaccggtggttctgtcgggtgcagcagatccctcttttcccctatcgaggatgagctcgcagagcccgcttctctgaaaataatcttccttggcacacctgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgttgtgaccagaggggttctgcggcgacgtcgacggctgaggcggagcggcgacgtcggacagcggaggcggagcggcagtgtcgacggcggaggcggcgacggctgctgcagaggttctcaacgcgagcagcgtgaaggaggagcagggcgcacgctcgctggttgagctgcgcaaggatttggtgcagcacaagctgtagggagcacagcggctgagagacgcgcagctgttggctgtaggatcaacagagaaggatttggtgctattggctattgttgtccgttccagtggtggtgactttggtggtgctgttgctggtgctgctgctacttgagaaggtgaggatttggaggtgaagcggaagcttggtttgctgttgctgttgttctgatttggggaagaaactgagtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaagaagaaaacaacagtgcttggcaactttattaatctcgcacatcctatgcaggtacctaactcaacttggatattagactccggagcatctagacatgttacaggaatgtcgagtgagtttacatcatatactccatttcagtcatcatttaaagaaacaattcaaactgccgacggaactttacgacatgtgaggggagtgggaacagtcaaatgtactccatcaattacattgtcgtcagttttatatgctccctcttttcctgttaacctagtatccgtaagctcgttggttgatcatatggattgtcgaattactattgaccgagagaattgtctaattgaggagagaagaactggaagaaagcttggaaccggtgttaggcataatgggttgtggtatctggatagaagagggacggacaaagcactatgtagtgctttgttagctagcacaagtgaagaggaggctaaattgattctaaaacattgtcaattgggacatatgtcctttgagatgagtaaggtggacaaaagcaaattaatgtgtgatgcatgcgagtatggaaaacatacacgaaccacatacataagcagaggacttcgaagcattttgccatttgtgttggttcactctgatgtatggacttctcctattgcttcggtaagtggagcaaagtactttgtcacctttattgattgccactcacgaatgacttggatatatctcatgagacacaagagtgaagtattgaaatgtttcaagaatttctatgcttgggttaggaatcaattaaacacttgtgttaaagttattaggagcgataatgggggagaatatgtgaatgatgaatttaggagttttctctcagcagaaggaatagtacatcaaacttcttgtgctgacacacctccacagaacggagtagctgagaggaaaaatcgacatattctggaggtaactcgtttactcatgtatacgatgaatgtaccaaagtttctatggagtgaggcagtcatgacagtaacatatctcatcaatcgcatgccatcacgaatacttgggatgaagactccatatgaaatggtgtttgggaagaatgaattcattgttcctccaaaagtgtttgggtgtacttgttttgtcagagatcatagaccatccgttggaaaattggatcctcgagccgtcaagtgtatttttataggttactcttctgggcaaaagggatataaatgttggagtccatctgagcggcgaacttttgttagtatggatgttacttttagagagtctgttccgttctatggagaaagaacagatttgagttccttgtttgttgatcttgacaatccaattattgatgaggatggacaagagggggagaatggctcatcaggtattgaagaagacacacaatcaagaagcatgaaatttgtggttggctcaatcccatatcctgttagtgaacccattcatgagcaaaattggagaaggccacgtgaagaagaaaatctacaagtttatactaggaggaaaacaaggtctttggaggcgcaaacaatggggcaacatgagtctcctatggatgggatggagcagcaacaatcttcaattgttgctgaagtaggtgataaaccatctgatcagtgtgatactatacagatttcatcggatacggaaggagaggagtttgaaacagggggagaagaaactaatcttcctattgttataagaatgggggtaagaagcaatgcaggtaaacctccacaaaggtatggttttgaagctcaaggtgtgaatgatgatgagaataacatagccaattatgtctcttatgcttctttgtcatccacatataaggcctttgtgacatcactaaattcagtggaaattccaaatgattggagggaagcaaagcaagacccaaggtggcatcaagctatgctagaggagctagaggctcttgaaaagaacaaaacatgggaccttgtaccattccctaaagggaagaaagtggttaactgtaaatgggtttatacagtaaagcaaaatcctaatggaaatgtggaaagatacaaggcaaggcttgtggctaagggatatagtcaaacatatggaattgattatgatgaaacttttgcaccagtagcaaagatgagcacggtaagaactcttatctcttgtgcagctaattttgattggccattgcatcagttagatgtcaagaatgcattcttacatggagatcttcaagaggaggtgtatatggaaattccacctggatttgctacctcacaaactgaaggtaaagtgttgagactgaaaaaatctttatatggccttaaacaatcaccaagagcatggtttgatcgctttagacgtgcaatgtgtggtatgggttataaacagtgcaatggagaccacacagttttctatcgccataatagaggtcttaaaactattcttgttgtgtatgttgatgacatgattatcactggagatgattgcttggagatatctaggttgaaacaaaatctaagcaaggagtttgaggtcaaggatctgggccaattaaaatattttttgggtattgaaattgcaagatctcctagaggaatagttctttcgcagcgaaagtatgtattggatctgctcagtgatacaggtatgcttggatgtcggccagcttctacaccaattgaacaaaatcataagttatgtgctgaatctggagatccagttaataaaaagagatatcaaagacttgtgggaaggttgatatatttgtgtcacacaagacctgatataacttatgctgtgagtgtggtgagccgatacatgcatgatcctagaagtggtcacatggatgttgtgtatagaattttgagatatttgaaggcaagcccaggtaaaggcatatggttcaagaagaatggacacctagatgtggagggatattgtgatgcagattggggcagttgtcttgatgataggaggtcaacatcaggctactgtgtatttattggtggcaatttggtatcttggaggagcaagaaacaatcagttgtgtctcgctcgactgctgaggcggaatacaggtcaatgtcgatgagcttgagtgaattgttatggttgaaaaatcttttggctgaattgaagctgtcgacaagcacttccatgaagttgtggtgtgacaacaaatcagccataaatattgctaacaatccagtccagcatgatcgaacgaagcatgtggaaatagatcgcttctttattaaagagagaatggatgagggaaccttaaacttaggctttgtaaactctggtgaacaagtagctgatagtttaacgaaggcattaggtgctagagagtgcacttcttcgtgtagcaagatgggcatgatagatatttatcgcccatcttgagggggagtgttgagtgtaggcgtgtgtatttcagcccaatagggcccattccaccaatgtatatgtatagtagatgagaaaggaaatgaagtgaagcttcgagaggaaaaatcacaaaactacacaccaccactagggacagctttcaccctgctcactctgcgttcaaacggtttcaggggagaacaccggagttctgaagaaaacagcattggctctccttcacctgagattaaagtcgtacaagaaaatctctaaaaaatttcgtttgtcaccagagttcgtttgtttttggaaatataaaatgaatcgtacaagaaaatctctaaaaaaacttgtacgctaacttgagattaaagtcagactcctaattgcagctcatgattttctaaaaaaaatttatcaaagcgaattcccacatcaaacttcaccctagttaaaccgtataacaataataataataagattaaaatagtattcatccgttacaacgcatgggcatattttctagtaaaagaaaaattcaagtatcacccaaggggccgagtagcacagaatagcaagtatgttagaattgaacgtaagctaaaattagcgcacttgacttttagatctgcatgtatggtggtggatgtgtgaacgtctttcgtttaatgagtaatactgtaaaaggtctccgagaatttagcgtcaagatatgcacactggacaaattcaagtcttcatatttttaaaagaacaattaaaatatcaccctagtggcagagtagcatagactacaaatatgctagaattgaacttaggctgtgtttagttcagtacgaagtttggattttggttgaaattggagatgatgtgactgaaaagttgtgtgtgtatgacaggttgatgtgatggaaaaggactgaaatttggatccaaactttggatctaaacacaaccttaagctaaaagtagttcacttggcttttaggatttcttgcaaagtgttgttctccctccatatttctatatagttagcaccgttaattttttaagttacctttgattatttatcttatttagaaaactatacaaatatgaaaaatagaagtcataattaaagtattgtagtgatgagacaaatcataaaaagataagtaataaatgttttttaaaacgatgaatggtcgtatgtaagttaaaaaatcaacaatgttaaacattatttaaaaagagagtacaatttttatagaatggtaatatttacccaacatttgtatccaatcggatatatgcatctttttaaattggtaaacaaccaaacttgaaattcgctcttatggatatttgaactcaggatcttggggtgctactcagatcactgcaaccactaagctaaatgccttttagcgaaaaaaaagtcaacgtgttaagaatccaaataaagtaatatatgtcgtaaaagatatccgagcatataaagtcaacatatcacaccggagaaattcaaatgttgtcatttttcaagaagaacaattcaagtctcacacggatagagcagactagcataatcagccgctctcatgacgtaacaacataatagaagtaacaaccagattattgcacaagaaaatcatcaaatactcaaatcaaattcaaacccgaaccgtccctacccagatggcccagtcagcgatgccgccgccactttaccgagagaagcagcaacacctgacaactcagcttggtacggtgcaccgaaggcgacgtacatggccgccacggcggcgacggccatcgccatcgccacgaacagcacggccggccgcttcccccattgacccatgaccccgagcgcgaacgggtagaggagcaccaggatccacacgttgaacaccatcccgagcacggcgagccaccccggctcggtgagcggcccccacgccgccgccttgccgaccgccaccccgacggcggcgacgttcacgaccatgatgacgatggtcgggatcagcagaggcacccaccgcacggtgtacaggtcggcgaacttgtcgccggagctggctgccgtctgcttcgacgtgaggcggaagtagatgcccttcccggtgacgagcttgagcgccatgtacagcaccgccgtcgggtacacccccgtggatccgatcatgtagaactgctcgttgcggcaccagtccagcagcgtgatgccagcccacttcacctcgaacatgccgatc

SEQ ID NO: 5503 - DNA, 1532 bp, Oryza sativa
ggggacgccgcctttgtacgcctgcgtcttcatcgcgaagtagttctccggcgacctcggctcgacgcagtgcttccggcagaagggcacccacagctcggcgaacttggcgacctccaccatagcctcgtagtggaccagcgtcccgccgtcgtcggagaggtagcaagcgtacctgtccaccgggtagtcggcggcgagaatggagaggatggtgttcacggtgtagagtatcggctcgtcgacagggtcgacggtggtgacgaagacgtcgacgccgggtaggtcgccggagtgccggtcggcgagggcggcgatgtccgggacgcgcttgatggggctctgcttcggtagctggttgagcacccacgagaagccgaaccagacgtcgccgaccatggacattgtccacagccacgcgccgtcgcggttcttgtgacgtatgcgccacgcgaagaaggcgacgatggcgatcagtcgcgccaggatcaagaacctgtaaggatgaaggatgctgcccttgaccttgtacgtctggaacagcggcggccggccgccgccgtcgctgccgcgggcccccgacacgtccgcttcgtcgacggccacccacacatcgtccttgccgccgtcgttcacccgcgtagccgcgggcgaccagcatccgttagtccagcttgtcaccgctgccgccgcggacatcgtggaagccgtggtggccgccgccaagcatgcaatgcacctagttagctagcccctccttgtccatggcaaattatttcacgccaagggggctttatgcctttatgtagcgccgcaaacaacatgagtttcatgggtctgtttgagagcttcttgcaactactgtactgcttcttctaaaatcagaatctcttttaaacattattttttaaaattctatgaatccaacaatataaattagaaaataactaccaactagttaattattagaattttaagcttcaccctaaataatgacatgtctacctaccaagtcaatttgctactattgctactatacggcctccaccagaccaccacactagcgcaagctgagcattttactttctccgtaccaaattattgctacctagaattagagaattttggtgagagagtagtgatttctatgcccacggtttctttatcaccaacactatcatactcctagttgctgcaagtttgataaaagagaggacaaaaaatacatagctcgagtatagtgtgttggctgcaggaagctactacctccgttcgatcaaaatatcttatattttgagacagaggagatactagtcgagtatagaaacagaaactacagattaattcttgttcttcgttgactagcagatccaagtcacgtcttcaaagaagaaaatgttactacgctgcacgcctgcaccagcaagttttcatgttgttttatctaaactagcatggcggcccgcgcagattgcgcggctagcattgttagattttttttctcatacaatagtttaaatattttcatattt

SEQ ID NO: 5504 - DNA, 23260 bp, Oryza sativa
attcctgcagcccacttgcttttatctcacaatttttttcatcgcttaaagggggattcctacaaaagtttctcaccaatttggacctaaatctttttttcttttttttttggtggcgggggattggggagagaaaatttctagcgtactatttatatattaccatggcatgtaatttgtgtacaattcagattgcatgaatctgacgatgatggttttttagtctgtctttttttagtgtctcacacggttttcaaaattagtgtctgatacgttttctaaatcgaaagaaaccttgtccgtttcctgtatcctacgaaagcatattagtatgattccgttttcctttttttagtttttgactgttgtccgattcaagtatcttagttttttttagttttttttgcctttctttagtttttaactaatcctaatcctaatcttagttctatttttccttttttcttattttttaattaatgtgagaatttctagaccgtgagagcgaacgtggaggcttctttttctattactttatattactttatagatataatagattctgaatttctgatgatgctatcaagcgcgtgtacgtacgcgtgagcttgatcggatctttacaaaatttaattacagtatttttttttgtgaaaagacgagctgaaagttgaaaccagtgtactagcttgctgctgtgctggtcagaggggaacaaaaaacaatttttatttttttaaaaggcgaggtcaaagagagcaccggatacgcgaagctgactggtgtacacagcccaattgtaccaacgcagcctccggctcgtacgaccagctcgcccactgatagtaactgagatattccatctcttacggtcttacctaaccttgtcagttgccagtggagttgtttaagttttcctgaagaaggttacggagtaattagcataagtaaagcgagaagtctgtacttatatatatatatatatatatataacatataactctgcgaaccgctttctgtttctacaatatttttatagttgtctacttgtctatttatagttaacttgtttgttctaggttttttatatgcttagacttctttccactcagatattatattatacaattgcttcaggaatacatttatgtttgggaagtgctggacattgcaggagttgtgttccaagaagggactgaggaatgaggataaatccaatggagatggtcggccaacggcctctatacggcaaggtctgcatacaccatgcagttcaggggaaaacaagatcagagtccgctattctcatatagaaaacttgggcgtcggccaagcaaaagttctggccaaagagcaagaacagaatatggacgggggatcgattacaatgccgaggctggctaaataactatttttgccaactgtgttttagaaatctggaaactgtgcagcacctcttcaaggagtgcctcttcatacaaaggagtgcctcttcatacagagggtttggcaggagataggccaccagatcagaccaaatcgattcttgaacacgagcaatgatgacaccctactcaattggtggcaccgaccacgctttgggtggtttggatagaaagaaacaatcgcatcttcaggaacatcgaatctacaccaccggtacttacaagcaagattatggatgaactccaattgtgggagttggcgggtgctaagggagtgcagtgtataatgtcgcgagaataggcttgttttaatttctactcccttcatcccaaaatataacaacttttagttcttaggatttgtcccaaaatataacaacttctccactaacattctcttctcaaccaatcacaaccctccaccattcacttttcccacctacctctactgctcatccaatcacaatcctccaccattcacttttacctaattttttaataaccgtgtccaactttaaaacttcttatattattatgggacggagggagtagttacttgtgggagacatttttgttctaggaatgtcattcctgctcctgtatggttattctcttccttctataatataaaaccagctttgttgggttctttaaaaaaagatattatattattatatatattagtacctcttctctatcaatatatacgaggcaaagcttttgcccactttttttaaaaaaaatgttatatttaaagagatggatataacaaatttataataaaagtcattaacttgattagaatatcggactgaaccaataaagtccaaactaatctgatgtgagtatgtaactttaagcaacaatgcataaaaaattagagacgacatataagataggcaacgcttgctttagcccgaatagagcatcggacctaaccgagaaagtcctagcaacgccaatgaaagcgaagatgacggagctcacttctcgtcggagatcgaacttaaccgatgtatcccccctcgaaattaactaagaactcgccgggataaaaagggtggtgatgcgttgaaaataattgtattgatttatgaagattgattaaaacaactttggttgtacatatttatacctccgggttgatactagtcttgatcggacacaatataagttttctaaagataaaaataaaagatataagtcaagatcagacactaaacaaaactttttgaagataacagaaaattactaaattatgtccaattaataggtagaattaaattgccacactatgatcttcacgattccttccggagattggtctcttctgcataggtttacattagttgatcgacttctttccttacatttttttttgagaattacacagtacaacacagacactcacaacgcacgtgcactcacccctatgagcatcttcgaagactgggccggcaaatcctggagagattgacgaagtcaccacaggcgcctcgctgtcgacgggtacgtcgtctaccactgaaagcacaacgccattaaatcctggaaaattcgctcccatggggagtcgaacccaggacctcgggtgctactgaggctcttgtaaccactaggctacaggccctttcgctctttcccttacctgaatgcagtaaaaaaacataccatattttggcgttaatagaaggacaacatgaagtcatccagacatataaagagaatactaatatagtctgtcaggaagctgaaaaactccggagtgatagcattgtactatgttcagactactaaaaatctggcaaatcagttcactaagggtctatcgcgtaatgtgatagacagtgcatcgagtgagatgggcttggatccacttgagttacacaatagtgataatccgtcctttatgattagagatcctgtgaattaggatggtgaaacaagctatttggtagctaggaggagagacccaaagctcatttctatgatgtacttatctccttatttgtatggtgggttggtgcattcccttatgtgacctgagtggcttttcttaaacaagatatgttagcctacagaacatcttagaaggaacacacctatatgagtccgactgctagccaaagtctatgagatttaggtgatctctagatactcatgaaaaggcctggagtacaacttatacacaccacacaaaggagatgctaatgacagtctagtatcaattaagaaattgagtaaagcctaactgcacaagaccgacaattcaaggaatagtccattgttcagttgtggtcaggtgtaactcctttttctaggtgaaagttcaacttcacagtctacgccgaaatactgagaacatttctgtgagctctgaaattaggtggggattattgttagaactaaatgggttaggcccaatttattcctagtaaattctatgggtccacagttagtgttaatggattaataccagtttgaaaagtgtaacgcctcatttttcgcgagacgttaaaaaacctaattaataaaatcctaattgcgaaaattttcattctttgtgggcgagtctaagtcatgtcgtggatctcagtttaaatctccttgatccctctcgtcgaaatcaaaaattgtctcctcgaaattcccattccaaagacaactccgacattcaatctattcctttgaatcctcgccaaatacttgtccccgattacaagaaaatattaaatccctaccttaaatccatccatgtctatcgatcgacctatctatcgccctatccatccatctatctattgctctatcgtcatctcccatcgttccgtttttgaatgatgactttctccttggatcctttcctttacctctccgtccgtgagttcgaacatcacatttgaattcaattctaaatccaaatccgaatccaatacctccaaatcaaatcttttggaaaagtctattttgcgtccctcttggtcgttgggccgtttctctcttgctcggcccatcctcttcactcggccctcccattcctcacgtgcagcacacgtgcaaaccgagagagaagcagccctctcccccgagattgctaatccgcgcagacgcgccagattagcaactcgcgcgcactccgagtccgtagcgcctcgtgttccttttttttttccgttttctgtattttcggttccacttcttgcatgggaggttaagcgcgtgggcccactagtcattagcactaataatagtgctaagcgtgtagattaatttaattatagattttattatatcaaaataatatacaaatagttaagttgaaaagtttcagaaatatgatgaaattttcaaaagttgagttgaaagtttttttaaaaaatattttgaaagttaaaatttcaaggtgacggttttgaaatttgatttgaaagctttcaaattcaagtttggaagttttcatatttgagttgaaagttttttaagttttgagctaaaagttttcaaatttcaggtcgaaagttttcaaattctggtcgaaagttttcaaattcaggtagaaagttttcaaattcaagttgaaagttttcaaatctttcaaattccggtcgaaagttttcaaattttgagttgaaagattctttcaactcaaaatttgaaaactttcaagtcaaaattaaaaactttcaattctatatttgtaaagaggtgtgcgaaagattaaaaaaatcgaaaagaaacggcaaaaaagaagaagaaaaacacgcataaaatttaaaaaaaagtgtaaacattaagaagaaaaaaaaagacactgggagaaggccagctgccgcgcgcgctagctaaattgctggcgcgtacgcgcgctagcaacccccagtggaagggaagcagatcctctgactcaactgcacacagagtatccctttcccggtggatggcagcgtgggcctttgagctttgaggcggacagtggtggcgtgcgcgcggcacgccggccggacggcaccgcctccgctctatccgtgcaaggacattgtaccagaggagatgccgagatgggcagtaggcggtgacgcctcttcatgtgcctcggcaaatgatggctgagacagccggagaacgacgctcacgcaagattgattcttttcttttcctgtttcactcattgtgttggagaggagtcgaggcgcatcagtcagaacctcgtccggaacagcgtcctttcttggacgctcttcgaaagtgcgtccaaatctgaacgttattggcaacagagttcattatttttacaaattcgaagaaagatttactaattatttaattcaagtacgtcactaataattactataaataaaaaaaatcgagaaaaagcaagtgcacctggagtagattgggccaatggaggaccgcggcaagctgatccactgccgacgaatcaaagccgtcctttgccttaagcaacttagagcaagtataatagtgggctataagaaggctgaatgctgaggtggataggagaaaagaggagagagatgagaagcgggctgtaagtttacagccggcttagacacaggaaccaagaaaatctgtgagacagacatgtggaccatatatttatagtgaagagttaaccactatatgagtgaggtgatagataggctataagtaagtagctggctgcattattatccttgctcttaaggggttgtttggatgttatgctaacattattgtcattaacctgatgtgacatcccggtccagggtctaatagaattaatagaatactcatatcaacaagttgcaactttttttggaaaccgatttccaaagaactctgaggttgttggcggctgttaaatgtcaattctataccgccaacatttacataaagttcaaataataaaacatccaacatattaatagttgcttaatctcacatattccacaagtgttggtgtatatttgtatgcaggtgataaaccccgatgttgggaggaaatctagactaaagtgaggaaaattatgtatccctacaaggatgagttgtgaacttaatcaaaacatcagtgaatcaacccaaaactccgagaaatggatagaggccaggagggcccagcccaggttcggccgaaccccctgatcgccgttgatcctagggtttggcgtggacgttccagatgttctcccaatgacggttgcggggcagttcggacatttccccttctcacaaccgtcataactgccctataaaaggacctcacttcattcactctcacacacacttccaagtttgagccgaattataagaggctctattgtacaatattgtctactagaataggaagagagtagagtagaagaggtcggaagaattccggagttgccggtaatcttgtcctatttcttttattctgtttattactctgaattcaatataatatttttcttgagtaatttagatttatcttgtgagaattatctcttagttagttcctaaataacatacaggattattgttcactataatcaactaaaatatagtgattactttggtgagttataaacacaaaagtagatagaaattccttagacgtggtgtttaggtaattattatccagtaattgctgcgtatcccacagtacgtttgaggtaggtgtagaggtggtgacagctctcgagatcatgtcacaccccaatctgataccgccgtacaacggcacctgacaggagcgtgtcgtagggaaagcggcgcgaaccgcttcctacgaaaccgcgatctcggtaccagtcccaggacatagtgctggtacccacggtgacaaatatgaatcataacaatccttaaaataaatagaggacttatttaccttaacttaggttgcagctcagacagcccgagaatacaaccgacgacacggacgaggcgaacaccaacaacaacagcagcggaaccaacggtctaacacccaacaccacaggcgacggctgggaaccagggcgaaaccccaattcttcacttcacttcaccatctcttcagggcggaggaactatatatatatatttatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagagatgtttttcaacagctcatttggtaatgtaccgacctcccaggtcagatcattacttctcggctcccagagcctttttcattttctcggactcccagagtctagctacccagcagcacaacaatccgcttccactcgggaagcctagtctatgatgcccgcagacatcccgaatcacacagattcgtttcttgaccactcaggtcatccatctgccacataggctgattctggttacgattcccacaccacaacaacttttcacaaagcacaggcaaacaaatctacgcaacgggaaccacctcacatccgcccatgaccgtgggcacggctgtttgaacagttagttaacctctgcagaggggtacactttacccacaagacacgaacttactccagacactggccggtgtcagaggttcgcgacaaagcctttcccaagccgacccagggatacctcatgccacatcgaaggatcaaatcctcacataaacataggccattttaggcgttcacaaatcaaactccaaccaccttgatcggtaagtgagcaagcttctcgtccttgccttaccaggaacccggtttgtctgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgctacataggcacaacccccgcatcgcgagtttttacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacagaaattagtgcgactactgggtagatccgtcggtttggcacgcaaaccgaggccaagcaagttaagtgtgtgattctaataatgcaagttgcaaacaaaataataatgacttttcaattataggggcgattgatcaaagggtgacttgccttgctcaaggtcttctcgaagcttcacgaatcttcgagaaaacccgcgatcgacgaaaatccgataaccgcaactatacacaaacaatcgaaaacctaaacaagagaccaaaagaaagatcctatttagacctattagtagtgccattaaatagatctcaattttacggaattactggaagtggaacggaggcgatcggagctacggatcgagggatatgaattttggaggtctaaatggattttctggacaaggaaaaggaattattaattcccttggaaaagaaaaggaaggagggatcggatttagacttcctcgggcgacttaggcgcggcccgagggattcacaaggcttggccggccattgggccgagcgcggccacggggaggcagcccattagggcgcgcggggagagagggaggcacgacggggtgggcgcggtccaccgcgcgggacccacatggcggtggttaggttcacggtgggaagggcgcacgcgggggcgggcgctagggtttcggttgcgcgcggttcgggcgcggcgcgccgggtggactgatggcggcgggcccacgtgcagccgcacggcttgtcgtggaccgcgcgcacgggagggaagacggagggaggaggctgactgggcgcgacttgacccagtcaagcgggcccggggctgaggtggctgccatgtggtcggccacgcgggcaggagcgaaaggggaggaggaggaggaggaggaggcgcccgggatcggacggccgacgacgcgcgaggcgttccggcgagcggcggcgaaccggagcgagcggccaccgccggcagctagaggaggtcagggggaatccgtttaacggcacggatttgagaggagaggtacgacggtggctggcgacggcgaccaagctcgtcggatcggggatgtggtcacgcgagggaagggacaagggggcgcggactcgggcctagccgaaacggtacgcgaccgcgatgcgcacgcggggacgcgggacccgatggtcaccggcgacgcacgcgcggcggcgttaggcagcggcggaagcggcgacacggcgcggagacaaaggagaaggccgacggccttggggcagccagggggaggtcatggggatccccgggagcgtggcggcgagaggaatcgacgcgagaggagccgacgacggtggattgcggcggcggcaatcactggagagcaaaaggggaaaacatgacgagacgacgagggttcgattcaaaggggtgggagcatctccggggttcaaggaatccgtttccggcgtcggattggacggagcggcaccgagattggctggcgacgagagacggtctttgggagcgggcggcaatggcggcgaggccgtgccgggcggcgacggcgctagggaatggtttggggaggtcctagggagctcaaggacggtggtggcgcgagggattggcgagggggcccatggcggtgcacagtcgggcgcggcggcggcgaagcagagcaacggcggggcggcacgtttagggggacgagcgagcaaccgaacggctcggggcttatccaagacgatgcaaatggcaagaatttgggcgaggagctcaccggcgagagaggagcaacgttggcgatgcggagggagtcgtggcgaggtggtcgcgacggcggggcgggggcgagcaactggcggccggcaacaaaggcgcgggtgtttcgagcgaggcggagacgaaacgagaggggagggcgcgggctttataggcgaggaggagaggtcggtttggaggagggaaaccgacattggcggtcaagggagctcggctggtgttcacgggcggcagcggcggtttcgtgggcagtgagaaagcggcgacggcgtggatgcgttgggcggcgaaggtgatggatcgagcggcggaaatcgaaccgcgggagcgtgggctggcgtggtcaaggagagcgagttggcgcggtcggtcaagcggcgcggaggcagtgacaccggcagtggtcgggaaagggaaaaagaaggggaaaaaggggcttggtcccttgccataatgaggagagggagagtgaggaggaggaggagagggagagcagctgcttctcccactcttggacgggtgcggcgtggagtggcgggggccatggatgacgtcgacgatgacggcggcggtcggtttggcatggagcgggggcaaggcggcagcgcatggcgtcggcggcgaccggccggtcggccacctcgcgaggcgagcgcgggaatgggcgaaggcggtggaggttttgggcggcgacagcgggaagcggtgtcggcgcgagagggaaacagagagggagcgagaaaacgagagagagaaagaaagagggagagagagagagatccttctctcggcgatggctcgtgcagcgcacgtgagggagatggcaaaggagagagatgggctggggaggggagatgggccgggggaggaaaatcggtccatccaaaaatacagggaggtaaagtagacttttacagagaaaactgatttggatagaattggagagatttagggtttggattcgaattcaatttgatattcgaactcgagggtttagggatgtattaagggaaactcaaggaggagtcatggaaaagattcaaaaggaatacttgggtatttgttctcgggaacatagggtggagtcaaggaaaggattcgaggcgggatttgaataattctggattcgtagaagtatttggcgaggattcaaaggaaggatttgaatttcagaatttgatttcagatactcgaatcggaagaggaatttggatgagggggaggattttgatttcgatgagagggaacaacgggattaaattgggatccttggcacaacttagactctcacacaaagaacgaaaattttcgcaattaggattttgccgagttagtttttaacgactcacgaaaagcggagcgttacagatcacttaagtcctccctgtctgggtacgtagtaaagcgacatctgggaacagcgggttgccagtgcctgaagtattgcattaggattaaagttaagctttccctagacactgtttctcactagtaaatcctctctatcctggcctatcttttgcttggtatccttggatgaaccagaggaagatttgaccacacacgttttcttggattcgatacccttataatactccgtagggaaagtgctacatcggtatatccgtacgcttgcggattttatcagtgtccgtattaaataccaatagaggttaagcgtgcttggcctggagttgtgttgggagggcagtctatgacctataaaagatatcagatgtaagtgggccggctgggagagacaggatgttacacctgagttatggctaacaaaaataagccactttagctagcaaaagaaaaggacactttttttagttgataacacgtgacagcataaaaaatgaaagggcatcttgtcataagtgcgaccatgaattaaataatgagctaacttgatcaaatttgtctaatatgagatgcgacaatcttcggaagtaaaccaaacaaccccttagattaactattatagttctaatttctgaagatgataaaagatttatacttgacctccatttgttgggtgtaaagttaaaattagtgtagtacttgggtgcaaagttaaaattagtgcatatatagttacatatactcgtaggatcgtaaatagtctttttaattaccctaaaatctagcttctgaggtaagaggtttcccactcatatattagatcttttgccctttttacaaccaatatattactattcaccaacactaatatgtccatgtgctctcatcttctgcataattaaaaaactttaaatgcaaaaattcaataaaaagttatttaagagaacttaattagagtcaaaatgtcatgtcgaacaaattcaaatcatcgtaatttcaaaacaaaaattcaagtatcacccaagtagctgagtagcctatatagactactccctccgtttcaggttaccgtttcaggttataagacgttttgactttggccacagttgaactgtttcaagtttgactaagcttgtagataaaataataacattttcaaaccaagacaaatttattatgaaaatatattcaattattgatttaatgaaactaatttgatattataaatattattatatttgtctataaacttagtcaaatttaaagtagtttgactttgaccaaagttaaagcgttttataacctgaaactgaaactgagggagtagtgaataggttaaaattagtgcacttgacttttagagatgtactagcatagttgtgtatttgcgaacgtcttctgtgttaaaaaaaaatcgaacagagtaaagccgtaaaatatatccgaacatataaagtcgacaaatcacgctggagaaattcaaatcttgtcatttttaaagaagaacaatccaagtctcactcgtatagagcagactagcaatatagtcagccgctcctatgacgtaacgacataacagaagtaacaaccaattattgcaccaagaaaataatcaaatattcaaatcaaatcaaacgcgatcgaactgtccctacccggatggcccggtcagcgacgccgccgcttttccgagagaagcagcaccacctgacaactcagcttggtacggtgcaccgaaggcgacgtacatggccgccacggcggcgacggccatcgccatcgccacgaacagcacggccggccgcttcccccattgacccatgaccccgagcgcgaacgggtagaggagcaccaggatccacacgttgaacaccatcccgagcacggcgagccaccccggctcggtgagcggcccccacgccgccgccttgccgaccgccaccccgacggcggcgacgttcacgacaatgatgacgatggtcggtatcagcagcggcacccaccgcacggtgtacaggtcggcgaacttgtcgccggagctggccgtcgtctgcttcgacgtgagccggaagtagatgcccttcccggtgacgagcttgagcgccatgtacagcaccgccgtcgggtacacccccgtggatccgatcatgtagaactgctcgttgcggcaccagtccagcagcgtgatgccagcccacttcacctcgaacatgccgatcacgtggatcatggcgatgacggcgacgaggtagaggaggtactcgccgaacggccgctggatgtaatactgctcggagatgagccacatcaccgggaagaggttgtagaagaagatgaacacggtcacgatcgggtaggtggacatattgaggtaggcgacgcgctgcagcgggtggaggcggcggccggcgaggagcgcgttgctgtgggagaagaacatctccagcgagccgcccgaccaccggaggatctggtagaggcgctcggtgaggttgatcggcgccgtgccgcggaacgcggcgggctccactgaggcgtatacggagcgccacccctgccggtgcatgcggaacccggtcaccacgtcctccgtcgcgatgttgtacacccacccgacgtctctcccccatgacgtcccgtcctcatacgcgcacgccgtcagggcggcgaggtcgccggcgaccgactcgtcgagcaccgccagcggcgtgatcgaccgttcttggttggcgccgtccagcatcgtgccgacgaacgacgtcgagctgccgaacttgttggcgatgtccatagccttgatctggctcgccgccgctccccagcgcggcggctccacgccgtagagcgcgacgcggcggaacatggtgccggtgccgaggtaggagggcccctggaggccgttgagggagagcatggtgccgtcgaagaagacgcggttatggttcgcgtaccggtccgtcgggtcaacgtcgtcgaaccgctgcgggaactggacgaacgccgtgttctcgccgccgcggccgcggccgtcgagcatgaagcacatcggcgccctgaacgcctgcgagttgttgacgtagtggtcgccgtcgaagttgatgacgaacggcgcgttcgacagcagcgcggacacgcggagcatcacgttcatggcgccggccttcttctggtggttgtatccgggcctcttctcgcgcgagatgtacaccagcatggggagccgcacgtcgacaccgctgaaatcaaccggattctcagcactcgccgccaatccaagcctcggtttacagcttggatggttcagtaaaacctatcaaaaacacacaaaaaccattcactctgatacaatttgcccggacaagattggaaacagaaattaaacatgtatagtgcgcaaatacctgaacaattccagcatgtttccctctctggtggttgtcagccggctcaaaccatgtgccgggccaatgtgtgccatcagccatccatgtcgcattttcgccggcatgtttggcgttgtacacatctgatcgctggcgaatggtgctcgagagggagtcgatcctgaccttgaactcctcgtactctcgccgcacacgccggtgatcgctcatcagctcgccggggacgccgcctttgtacgcctgcgtcttcatcgcgaagtagttctccggcgacctcggctcgacgcagtgcttccggcagaagggcacccacagctcggcgaacttggcgacctccaccatggcctcgtagtggaccagcgtcccgccgtcgtcggacaggtagcaggcgtacctgtccaccgggtagtcggcggcgaggatggagaggatggtgttcacggtgtagagtatcggctcgtcgacggggtcgacggtggtgacgaagacgtcgacgccgggtaggtcgccggagtgccggtcggcgagggcggcgaggtccgggacgcgcttgatggggctcagcttcgggagctggttgagcacccacgagaagccgaaccagacgtcgccgaccatggacattgtccacagccacacgccgtcgcggttcttgtgacgtacgcgccacgcgaagaaggcgacgatggcgatcagtcgaagaaggatcaggaacctgtaaggatgaaggatgctgcccttgaccttgtacgtccggaacagcggcggccgggcggcgccatcgccgccgcgggccccgcacacgtccttttcgtcgacggccacccacacgtcatccttgccgccaccgccgtcgttcacccgcttggccacgggcgaccggcgcccgttctgcccgtcggcgccggccgcgacgtcaccgctggtggcgtccacgcggagggcagcgttgatccggcgagtcactgccgccgctgcggacatcgtggaagccgcggtggccgccatgcacggaacacacctatttcactagctagctcctccttgtccgtggctcctccttgtccgcggcgaactggtgcacgccgagctggcttcatatagcgcggcaaacgacatatgagtttcataatgtcgtctctgcctggtcaaagtactactgctgctagcctgctagtagtacacaacaagaaggcaagaagccgccacccctgcagtgcagtgcagatgagcattttcctttctgcatcgttctactcgtccttctaaacaaactactgctatgttcgtcccataaaaaaccaacataatattaaatgtgatacatcctattctgatttattgtattagaatatatcacatccagtcctaaattaattttcttttggacggagggagtaagcaacaattatagtgtttggtgggaagtctgttcctcatttttacatgtcatataaaaatgcttttaagaaaataatagtataaattaatttaatatatattactccataaacatgtatgtttaaatgtaacacatataagtaggggaaaaacaaatttgactataaacaatatgtagttaaatttatttttcttctatttgtattagttatttcataacccttcccataatgttattttaactattaatactgatttatgcaaacagtaattctagcttgtgtggacactaagtaattataaatctaatagaatgtcttgacttatataaatctaatgtacttgtaactgcatttagagttcagttgaatgataacgtgaaatcgatactgatcgaaggtaaactgacgtcataaagaaagagccttgcggtttgttttgtcttgtgctgcgatatgttttttcttgtgtgtttctactatttgtatgttccgatatgtaatgtttgtcttgcatgcgcccatatttgtatattttgccttgcaagtgatatctgtaaaatcccgtgaaaaagagcggagtaggagacgacgtagacagatctgcactccaggacgtaggttgggcttgtggacggagctggactcatggcctactccggacggacctagacttctagacgtacatgagcgcgatgacaaaatctatacctctatatatatatacctaatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagaaagagacgacgccgccacctctcccgcccccgtcggaccgcagccgcctccatgccgccaaatctggcggaggcgaggtccggcccgccgcccctcccacccccgccgggctgcaactgcctccacaccgtcggatctggcggaggcgaggcccgaccggcgttccatgacgtccgccaccaccaccactgccgcacctccccaccatgcagagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgcgggaagaggggcgccgtcgccgccgctcgggggcgcggaggggagggcggcgatgtgagatgggagggagggaaatgggctagagtttcggcagctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctgggatgggaagtgcacttgcgcgtgcacaaaaggccgtggaccgaccggcaagggccggaaataagtctattttaggtccctcaggccaaaaaaagagaataagtttctttttagtgctcattttttcagaagcattacaattataagttattgaatgtgttcatttcgaagcaaacctaaaaggaagtattttctttcttttttccaagtaaataattgttaaatgacgtttgtattaataaaattaacaattaagctctgaaaaattcaaatataatttcaaagagcgtaactaatcatggagaatttaaaaaaaaattaaatttaaccatgtcattttatttctcacacttgctttacttgtaaatttatttaattatgcacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtctctactacttaaaaaataagagatgcttccatcgtccgtcaaaaaaaccggcgaaaaaaaaccgggcgagcgaggaaaaaaaccaaaacagggcgagcgaggaaaaaaaccgggccaaaaaaaaccataactgtccggcgaaaaaaataattcgattctgtgaaaaaaatggcgacaaaaaaccgtcgaaaaaaaccggatgaaaaaaaccggaactgttaaaaatacaaagtgtttccttcgtccgtgtaaaaaaagtccgactgtaaaaaaaaaaaaggccagcgcgaaaaaaaataggaagggtgaaaaaaagggcggcgagaaaaaaaaagcggcaaaaaaagaccgattccgacgcggcaaaaaaaacgtaaaaaaggcaaaaaaaaaaaaagaagcgccccaaaaaatcatctgattcctattcctatcgtaccataaaatttaaaaaaagggcagaaaaatgcaaaaaaaaaagtcctatttctattcaacacggaaaaaaattaaccgcctttgaaaaccgattcgataccccaccatgacaaaaaaaacaagtttccatctaaaaaaggttcagcataacataaaaaaaatctgactatagaaaaaaaaatcaacactccaaattggctgtaaatcaaccgaacaggagttggtttaaatcgtaccaagtcctattcagcacacatcaggagatcaaaaccatatatctctatctcttctctactacttaaaaagatatgcttccatcgtccgtcaaaaaaaccgggcgagcgaggaaaaaaaccgggcaaaaaaaaccataactgtccggcgaaaaaaataattcgattccgtgaaaaaaagggcgacaaaaaaccggcgaaaaaaaccgtaactgtccaataaaaaagggcaaaaaaaaaagtccgattctgtgaaaaagggcgacaaaaaaaccgccccaaaaaaacggacgagcgagaaaaaaaaccgtaaatgtccgatcccaaaaaaagggcgaaaaaataatccgattccatgtcaaaaaagcgaaaaaaaatctctatatctgtctctgtctctactacttaaaaaataataaaagatgtttccttcgtctgtaaaaaaaaaagctaaaaaaaaaggtccgactcctatccgattccctctcagaaacagaaaaaaagtccgactatagatccgattcttaatctataccgtgatatctcacatatcttggtgaaacaaaatgatgtgccggattagagatctgtttaataaaacagaacctacaggtcgagagcattccatttttatatgattttaatttttgggtttgtacttttgcttttgagtccctataatttttatatttatatttgagttcctataatcttgcaataaggtacttgaggccgtttttgttaaaaataataataaaagagagaacaaaaacagaaaggtgcataaaaagaaaaaggaaagctgaaaaaaaaaagaaaaacaacaacaacaaaagttccgtttcccctatgtggcaaaaaaaaaagcgtagatccgaacgaaaaaaaatctgattcctataaaaggcaaaaaaaagtgaaaaaaaaatactagattcgattccgttaaaaacaggaaaaaaagtcggattcctataaaggcgaaaaaaaacagaaaaaaaatctaaaaaagtttgttcgattccataagaaagtggcgaaaaaaatggttcgtaaaaaataaaacgcttgttcgtataaaataaaaaatgcacacaggaaaaaaatggaaagggcgaaatttctaatcaatatatatctcttctctatctctaatataatctaactattttttaaaaaaaatgcacgagagaatagaaacggttcaaacaaacgcgtgagaaaaaagtcagaaaaagcgaaaaaaactcgctaaaaaggttttccatcttccataaataaataaaaaaacgcgcgaggaaaattatttccatcatcggtaacttttttaaaaaaataaaacatgcaaggaaaaaactgttagaaaaaacgcgccattttaacaaatggttttaaaaaaccgcgcaagaaaaaaacaccgtctattaaaaaaatcgctctgagtcggataggatccatcgattttttgccacctactacacggcttttatttcgtctatattctcttgtttttaaaaaaagcaacaaaaataacatttgaaaaaaaaacaagcaaaaaaacacgcgagaaaataattggcaaaaaaaggcaaaaaacacacgagaaaagaaaagcaaaaaatggagaaaaatatggttttcattgtaaataaaaaagcaaaaagatcatgttagaaaaatcttttagaaagaaatgcgtcatttctgaatggtttgagaaaatcgcgcaagaaaaaaacaccgtttgtaaaaaacaagccgctcattaaaatacaaacattgtcattgacatgattatttatgaaaaacgtatattatcattagaattttttcacccgttgcaacgcacgggcatttttgctagtaattaaaaaatatgtaaagtttccgggtgtttttttcgtccgtcattaccacgcgcttcgctaaatccggatttaatccggttaacagcccgatcgggcatttttttatcatactccaaaaccacgtttgatacggtatatgtactttccatgtaatcacttctcacatgtagtagtctgcccacttggtgagggatgaaagttttcatttcggccacacgggttcgactcccatttttctctcatttgtacatctattattacttgcacagtttgcttccctcatgtcaaattatatttgccttcgattttttttctcttttttcaacagatttttatttattatgaaatcttatcttataatgaattagtttttaattcgaaaattaaaaataattaaattatgtacacaaaaatcaatataaatatatgtttacctaggccctagaataagtctactttccttccctctctcaaatcatacagatttttatttattatgaaatcttatcttctaatgaattagtttttaattcgaaaattaaaaataattagattatgtacacaaaaatcaatataaatatatgtttacctaggccctagaataagtctactttccttccctctctcaaatcatatttgcgtgtatttttttttctctcaaccactagcacggaccatgcacatccgatggatgaaaaatcaaaagttcagcacctctttcttcaacagacttttagtgattctgaaatcttataattatattatataaaaaaatcagtataaacacgtgaaccaaccgatatttttttaaaacatgaaaattgaatatgtgcatggtgtgaaacttcacaccatgcatcctttccttctatctcggtctttgttagcgcgttttttaaactttctatatacaagttgatataaaatactagatattttttcttaatttttgtaataataaaactcaattaatcatacgctaagaggttttctacaaaagaaaaaggaacggcatggtacggctggcactgttcaggttttgtaggttagagcatagctgtatactgttgcattgtgattataaatcaatgcaatgttattgcaattatcaattatgaaaaaagattataaaagtgccataaaaatgtagtttaaaataattaatgaactcccaaaatattcattatttacttatacgtaaaggtgcattgctcggacgtccgtttctccaatgctacaatcattgggaccatgtgttagggacattattcacatcctacacgcgtagagcggattaattgtccaagcacaaatatgcacttgtgataactatgaaggtgcttcgataaatcattgaggttaaatttcattcacctaaccattaccagtgcaatgatatcacagtttgtcacacaagggttgagagagagtgtgtgtttttatccatcgtgattatcattagcctaatgaataatttatctatcttgaaacattactatatacatgttaactctagactttatagcatttaactgttcctttacccataacgaagcacgtgcatttttctagcataacaataacatgattaaaatagccttcacccgttgcaacgcacgggtatttttttccagtacactaagaaaatcggatcgcgcgtactaagcggacgaacaaacgaaaaacaatgtgatgtttggaaatttatcatttttttaaagtagttaagataagataacatatagatggaatatgaagttacatgtttgtaaagatgtataatatactaaatatcttgtcattcttttaagaaaaaaatataacattttgtaatatgtaaaaaccgagtagcggtcctctcaaggacaaaactccacctagctccctgttggtgacagaaaaccatcgccaaagaaatcacc

SEQ ID NO: 5505 - DNA, 32037 bp, Oryza sativa
  unsure (1)..(32037): unsure at all n locations
ttcatagaagaaaatgttgccctgcaccagcaacagtccagatcgggatattaaaaacagcttgatcgaaaggtacggggcaacatatatagtgttgtccactcttgcacacgaacaagcaactgaagcacattcctaaactgtgcacgcgtgcgtcctttctgaattaattctgaatttctggtgatgttatcaagcgcgtacgtacgtacgtgagctctgatcggatcatgacaaaatttgccgtatttttgtatacaaaagaatgagttgaaagttgaaaccagtgtagctagacgctgtgctggtcagaggggagcaaaaaacaatttaaattaataacagaggtcaaagacagaatcggctacgcgatgctgagtggtggtggtctggtggacagcccaacttgatgatagcaacgcagcggtgaaaagaaatcagcagccaacgctgttgcctccggctcgtacgaccagctcgcccactgatagtaactgagatattccagctcttacctaaccagctaaccttgccagtggaattgtttaattaagtttttttctgaagaaggtaagtctgtactttagtgtttcagcaaatccatattgagtgcaaattgctccgaattagctgtatgcttctttcctaaactcttttttttttcataacaaagaaaatataatttttagtctctgcaccaacttataattaccctccattatatttatgaagacaagaatttgaacctttaatggatggagctatgcacctacaaccacaactatcagagtactgtcattctttttattccacactttataattggtgtggggttagagatctaaagtttttatcaattgccatcagcaaaattggacacatgaaagctatattactataattgacattatggcatctctttttaataacttgtgttgtttaattatagatataattctttttaaaaatgatctaagttgtgctttggggataagcaccgttggtgtgctcgtagtagagtcataggcgcacacttctaaccattaggatttaaaaatttaaatgcaaactaatattaaaaagaattgacagtgcaataggattttagtgaggtatgggagttggtgcgtgagtgagaatgggctcagaattatatgcttctaaaattttgacaatttaatccttttgaaaaacttatttcatgaattgacagtgaccaatctattataaaaataaaccgcgaccatagtgtcaagcttgaaagcgttgagctgtaactgcaagatctacctaaacacaaatcttgatgcaagaacctacgaacgaaaaatcgatactgaagctcaaaaatcaatcgtaagtggaatagcgaaaccgttaatttatttagtaccttacccatctattaatcaatagtctccacctcccaacatctctacgtagcttgcaaacatcgtaaaaattctcgattgatatatattaatctctaacagttgagaaactattagagatttggactcgaagcactaacccatcgcctgtaacactggttacaaaccattagaaatttgggactacacccgttacaaataagtttttttttcttaaaccttaattggaaaaggtccactttagatatctcaactgtgagacgagttctattcatatctcttaaccacagaattagaaatagagagtccctaactggtgcagattgaatcgctcagtagtatagacaacaacttcggttgacgtggcacctattggacgcattgatccagtcttcactcgacgtggcgtctacaaggtgcttatgtcgcactccaattagaaaaaagaattaaaaaaaatggttccttcccgacccctctcctctcctctcctccatttctcccaagtcctgacgaggagtcagcagtggtggctctggcgagctcaagcttgctagcccttccgtgggaggtggcagcagtggtgagtggccgacggggaggggaatccattggtgtagcggaggaggagagaatggaggcgagggaatttgggagctcgagctcgtcaactcatgtctaggaaggcggcaatggtggtggttggccgaagaggaggggtgactatatgtggtagtagagaaggattggatggacgaggaagagggatgggttggaccgcctcgttgtcgagctcatgctgtgctacctcatcgctgaggtcgagctgcagcgccaaattcaggagatcgagcgtcgtccttacaaaggttgacactccaacgccttccctcaaatccctttcccctttacttcaaattgagatggctcagcatcacctctccttctttgacagtcatggccatggtcacgtaggaggtgttgcggaagctaccgtgggcgattctcaccaacgaccgccgtggtgggcaactaccactacccagttgtaacgctccgcttttcgtgaggcgttaaaaactaattcggcaaaatcctaattgcgaaaatttcgttctttgagtgctgagtctaagtcgtgccgtggatctcagtttaaatccgtccttgatccctctcgtcgccatcaaaatcatcctcatcgaaattcctcttccaattcaagtctccgaaatcaaattccgaaattcaatcgcctcctttgaatcctcgccaaacacttgtcccgattccaaaaataccgagtccaccttgaatccattccttgactcctccctgtttccccgagtccaagtaatcatattcgaaatttcattccaaatccaaatcccttccaaatcatctctctgcagaagtctattttgcctccttctaattttggatgggcctgatccccctcccctcggcccatctcctctctcagccgttcctcccctcccctctctccgcacgtgtgttgcgcgtgcgccgcgctcgagagagagatcgcccactctcttctcatcctcgctccctctctctctctctctccgtttctctctctctcccgtagaagctcccccaccggcgctgacttcccgccgccgccattcgaaattcggccacgcccagccgctccgtgcgcgcgcgccatgccgctcggtcgccgcccgtgccctgttgccgcgtcgtccccacccccccctgtgcgctcgcgtccaaaacacggagccagagctcgccctcctccttctctccctccccaaagcagcatggtcgaacccctcctttccaccctccccttttccttttttccctcgggctcgacccctctctctccacccttgtcactctgcgcgctgaggcagagcaccgctgacgccgcacgccagctcgccgcccccaccttgaccgcgccagcctgcgctcccgtggttcgatttcagccgcccgatccaccgccttcgccgctccttgcatcctcggcgtccgccgctcttgcatcgcccgtgaccgccggccgagcgctcgaccgctctatgtcggttccccctcccaaaccgacattcctccactataaaacccaagccgccccaaatcccttcctctctcgttttcactcgcctcgtacccaccgcgccattgccgccgaaccaccgtcaccgccttgtcgccgctcgacctgatctcatcgtcgccgtccgccgccgagcaccggaggaaccggtgcgtgggtgggcacataacgaggagctccgggcgccaccactcccctcttgttccccggccgcgccctctcggtgtcgtgccgccccgccgtcgcgactgtctcgccgcgacgccatccgtttgccgacgccgttcccgctcgtcggtgagctcctggtccaaatcctctcgtctgcatcctctagcgactcctaaacagcactgagacatggtagtttgtgcgttcgtcctccaaatcgcgcccctgccgatgctctgcttccgccgccgccgcagacagtcgtgcgtcgctgtcggctccccgctcgtcgaatcccatcgccatcaccctccccgtgtccctagaagcctccctgggacatcgccttggccactccactcctctctcccccttccgccgccgcggagctccgccgcgagcccaagtccggcaaccatcggtctccgtgccgtcgcgtgtgcgtcgcaatgccgaatcgtttcggctaagctcgaccccgcgcgttcttggcccttccctcgcgcatccacgtcggacatccggcgagcttcgccgccaccgccggccgccgtcgtgtctcctctctctaatccgtgccggtgagccgattccccatctcctcctctcgccaccggtgtccgcgcctcactccgattcgccgccgttcgccggtgcccctcggccgccgtgagccgtccgatctgggcgagccaggcctccctctctctcgcgcttgcatggcagtccacatgggcttgaccaagtccacgcctgccctgtcagccacctagtcagcctcctcctctctctcccgtgcttatgagcttggcccatcggcccatcccctcctcggcctcttaaaagcaggcaaagtttatatgtactccctcccctaaaccctgagaccacagtcataagctaaagtccatgtttgctccccccccaacttgctcctctccctcaccctttgattggccccacatgtctatgagagattaaagaatattcttgggagtattcttttccacaaattcaataaatcatttctttaatccagaaaactcaataaatcatttttcccttgttccataaatcaattctttattccaaattccataaatccttcctcttaatccagggattccaataattcattcccttggtcccaaatgccattgaaatgtcaataatattcttgggaatattattctataaattccataaaccatttctcgtattccagaaaaattccgataaatcatttccttgtccagaaaaccaattgacctgccaaaattcatatctcttgatccgtaactccgaatgatctcgttccacttccagtaattccataaaattgagatctatctaatggcactattatttagtctaaataggatctttattttgggtcttgtgtaggtttttaattgtttgcgtatagttgcggttaccggattttcgttgatcgtggttttctcgaagattcgtgaagcttcgtgaagaccttgagcaaggcaagtcacctttgatcatattgcacctataatttaaatctaagtatttctttttcacaaatattgcatgaataggatttacacaagtaattcggccgcggcttgcgagatagcctgccggcccccaatcctaattgctgcaattaccctccttgaattattgaacacttaaacctcctttgtcgactgttgtgcttcgatgcacgggccttcgggcacacgcatcggaacacctcccctcaaatttaaaatatccaacgatgggtaaaacttggggttttacaaaagacttggaaaaaaggacacttgggtcggtgcttgcgaactaaaatgaatttccaaaatcgcggaccgggggatgtaccgggaatacggtttcccgttcttgcacttaaggaccgtttcccttggaatttcatccgaacataagacaagtgcgaccacatgggtgaaatgggacacccctggctgagtaattagctaatcgggggaaccatgatgccaagagacatgtggattcaatggggtggtgccggggagaaccctcgggcttcctggcacagtatggtctgggacctaacctgatgtcggtctggggcccctctcgttggcatatggtgaacctgtgtcagctttcgaaatgccttataagccccaagtcaccagacgtgtctgatccacacgggctaagtgaccaaggttagtaacgtcgtgtgggtaaagtgtaccccctctgcagaggttaacaaactgttcgaacagccgtgcccacggtcatgggcggatgtgaggtgattccttagcgtagttttcgttttaccctgctttaagaaaaggaattaaggtttgggaaacctgatatttggaaaggcaagtggctatcagggagacagcgggacagggagtccctgaaagtgattggttgtttggagacaacctaactctgaaagtttggaaaattggttgggtttgggaaaccagctttgaggccaactctgggagttgtgcgaatcttgataaataaatttggtcacttctcacccctgaccgagctgagacttgtctcgctctggttgtggaaagcacacacttagattgtcaaaatgcttgcaaataaaaccgatcgtaaaataacagccttatctttgaagcctgcatcaaccacctaaattcccgtgacttgctgagtacgaaagtactcacccttgctctatataaatatatatatagttcctccgccttgaagtgaagatgaagtgaagtgaagaatatggtttcgtcctggttctcagccgttgcctgtggtattgggtgttagttcgttggttccgctgctgctgctgttgttggtgtttcctcgtccgtgtcgtcagttgcattcttgggctgttctgagctgcaacctaagttaagataaataagtcctctatttattttaaggatttgcaatgatacatatttgtcaccgtgggtaccagcactatgtcctgggactggtactgagatcgcgtgtcaggtgccgttgtacggcggtgccagatcggggtgggacaccaatgctctaggtcaccgccaactccctctagccctctaacggatttctcctctagctccccgacaacatctactccatctatgtactatgtttatgccctcatctccgcgtgctcgcagcttgtccaacaccccttccacctcgaattcctccagttcgctctccccggtgccccatgtcgtcctcccatagtgtctgcgtcagttgttgttaagcgatgcatcagcttaacaatcttattgtaggtcggagttttcccggagctacggaaactacacttcgaaaccatccgtcctatgtagattaacccatcttcctaacttctccccgccgccgttgtagagctctatagagaggtgctcgtgggcgacgggggtgtggaaagggaggtggaggatagaggggatcagctcgctgtgttggttgagctcgagctcagcccgggcagaagggcagatggagattgtatcagtgagatgtggggcttactgcgggtttttttccttgaagaagcttatgtgtgggtccaaccaatttccaatttttttgtctgattggcattgccatgaaatctcaatgtagaccgatgaagataagtccgcgagccacgtaggtgtcacatcttattataaaactgttcttaatattatcaagggatttgatttgtacttattttaaaatatagtaaggagtaagttcataaacctgggcctgaaattgaaagctgtttcatcaacaagccaaggaataagtctacattacctccctcaacttttactcctgattgaatcacctccctcagctgcaatactgggtataacacctcctccatcttcgaaaaccggagcaaatcgagtccctcgctgtttagatagtggttttgtcgtacgtggcacacatgggacccatatatgtcagtgaggaaaaaactaaagaaataacaaccgaggatggattctaatttctcgggtggacgtccacccgtttcttgcgtgccacctaaatgaaaaaaattgaaaaaaaataacatgataggttaatatgtaatatatcacttcacaaacatgcaagttcaaattcgacttctacaagttgtaacaaaaataacaaattaaactctaattaggaaaaggaaaattaaaagttaaattttttatttttgttacaatttttagaaattaaatttgaacttgcatgtttgtgaagtgatatattacatattaacctatcatgtcaatttttttgaaaatttttcttaactatttagataatatgcaataaacgggtggacgtccacccgagtatttaaaacagtttcccaataacaaccccacacatgtatcagtcatcttaatctctttgatggccagccgcaccgctgaagaactaaccaccatcgctgccggtcatcgtctccgcatgtgatgctcccaaacctccacgtagttttctcatttaaactggtagacccaatatttttaaccatcaaattattaatttttaccattagatttatctccaacaaaacaaatttgtacaaatatatatgtatgttccctcatcttggcatgtttataggaaatgtactgcgcacctatgtacgtgtttcctccccatccgactctcctttctatccctctcctattttctatagctagttatcaaattataaattttcaccattagattaatattgacaaaaaaaaatgtatgttcctctcattctgacatgtttactacttaaaaaaaaattacgtacgcacctatttacactctccctccccatctgacttaaaaagaattatatatgtacgcacctatgtacacaacactctccctccccatctgactctcccttctgtctagaccattatatgccaagccaactattaataaacaacactaataaaatccaatactttggagaaaaaggaacaattgcatccacgctaaaaaaacaaaattaactaataaaaatatccgaccaatttttctatgtaccaaaaaaaccaccaagatatatcaaaattagcaaacaatgatataaatatatttatgtgtattatttcacacaggttctttcaataatctatgtacaatgataattctaggtcatttatctatcttttttaattgtttgaacaattatgtattgcactactatatatataaatgattttctcaagatccaaacattcctttctacatacaaccaaaatgtgcagccatttgtggtgaagccgaggctacctcaacctcatttgctgctttttcagaaatagcttttgctaggcttttacgcctagaactatttaatggagcattaacccacaagctaacattgaatcaatttactctcttagttataaagatgatttgatgtcctaattatatatttcttattttcttaatttttatgtttctcttcatacaaatcatttttttctttgataaatgtcgaggcgaaaggcaatgataaatccatgaagccactaagctcatgtcctttatagtaactttatgggtttctccacatctgagatgtacacgtcactcaaaatagtttaaaaagctatatttgttcctatcaaatttacattttaagaccaacgttgactatatttttctcttaaaattactataagagccccatgtatcatagataaactcataaacagtgtccaagatatgtatatttcttccatatttacatgcaagaatataagaaattgcatgcatataaaccaattaaagcaaggactcgatgcaacaaataaagtttcacgaggtttgttaagaaaaaaatagacaatgtccattcaattaaaaataggtgaacatcttgcttttaatctgaactttgttaaacttgtcttttaaacaaactaattcaaacccgctcgaatgcatgggctacctttctagttatatattaatctatcttgtgaaaaaatttgaatttttttcataactatttggttgaaatgaaagaaatggatggaggtccacccgagaggttagaacccatctccgtcagaaacacacaaaaaccattcactctaatacaatttttccgaacaagattgtaaacagaaattaaacatgtgtagtgcgcaaatacctgatgttgccctctccggtggttctcagccggttcaaaccatgcgccggcccaatgtgtgccatcagccatccatgtcgcattttcaccggcatgcttggcgttgtacgcgtcagatcgcttgcgaatggtgctaaacagcgagtcgatcctgaccttgaactcctcgtactctcgtcgcacacggcggcgatcgctcatcagctcgccggccacgccgcctctttacgcctgcgtcttcatcgcgaagtagctctccggcgccctcggctcgacgcagtgcttccggtagaagggcacccacagctcggcgaacttggcgacctccaaaccatggcctcgtagtggaccagcgtcccgccgtcgtcggagaggtagcaggcgtacctgtccaccgggtagtcggcggcgaggatggagaggatggtgttcacggtgtagaggatcggctcgtcaacggggtcgacggtggtgacgaagacgtcgacgccggggagctcgtcggagtgccggtcagcgagggcggcgaggtccgggaagcgcttgatggggctcagtttggggagctggttgagcacccaggagaagccgaaccagacgtcgccggccatggacattgtccacagccacgcgccgtcgcggttcttgtgacgtatgcgccacgcgaattagaaggctacgatggcgatcagtcgcgccaggatcaagatcctgtaaggatgaaggacgatgcccttgaccttgtacgtccggaacagcggcggccggccgccgctggcccctgacacgtccgcttcgtcgacggccacccaaacgtcgccgccgacgtcgtcgttcacccgtttggccgcgggcgaccggcgctcgttctgcccgtcggctctggccgcggtatcgccgttggtggcgtccacgcggagagcagcgttattccggcgagtcacggccgccgccgaggaaatcgtggatgccgcggtggccgccatgcacgcaacacaccttcgttagctcctccttgtccgtggcgaactgttgcacgccgagccggcttttatatagcgcggctaacgacatgagtcatgtcgtctcggtcaaagtactactactctgctactccctttgtctcataaataaaatttttaaccatattttaggacaataaatctctatccagatttactatcgtagaatatatcacatcacttaaaaatctattatattatgagatggatagagtccactcttattataaaattataacccactaattactaaaacttaacatgcaaagatgccatatcatcatccactgaccattattacatttaagcatcatgcaaccatgctatgttatctataatttaataatttattaaattttagaaatttgaaattaagcatgttaaatcatcctacattattcacataatatttcaatatatatctccatcattttttttataatatcctactccctccgtcccaaaaacatcaaactctaaggatgaatgtgggcacatatgtgtccagattcatccctagagtttgattcttttggggacagaggagtatatagctatatagttcatcctcacttaattcttgttatttttcttttctcccattaagtcatatcacattaattgtgattttagtccttagatgattaatctatggttcaaattctctctcatcttttcttctcttattaacccatgtcatctcaatttttttagctcttacatgtatagtttaaattatcttccttcttttgttctctcataaagacatatcatcttattttttatatttgaataatcattttacatactatttgaatttaaatcacatgtaaatttatgttcgtgtaagcttacgttatttaaactatcataaacattatttttatctattgttatcatagtaaattcgtgcaacaacacgcggggtttcacctagtacaaggagacgtcaccactgccgtgcaagctgagcattttcctttctgcatcgtactactccttccctccctcccattttaagcgtcagcaatgaattttcgtgtatgcccgtcttatttaaaatttattttgttttgttatataacaacaacaaaaaaactaatcataaaatatttcaaataagacaaataattaaaattaaacaaagaaactcatacgtgcgtttaaaataaaacggagggagtactagatacttctcgtcctctttttctgaaaatactattaccactgtaagaaactgatagtgtttggtggggattatgttcctcatcttacgtatcattttttttaaaaaaaatctataccatagtagtggttgtggcaatgtaaatctaccaccaccacctctgtcaagttctttactccctaattcaaaagctcacaattcttaatcccgatctgtctttttattctgtggcaacgcacgggcaaaacagttagtcacaatataaatcaatttgatatatattgttccataaatatgtatgtttaaatttaacctatacaagtaaggggaaaacaaatttgactataaacaatacataagtcaaatttattttttctatttattccataacccttcccataaagtattttaactactcatattgatatgtgcaaatattaagtactcctagctttgtggatactaagcaattataaatctaatagattatcttgagttatataaatctaaagaaattataactgcatttagggttgagtttgtcggtgacatggggccgggggtatcgtgactagaggcttggatagccgcgatcactcacatggcccgaccccctcgggggggtcgggcccgacagtgacatggccacccctccctctgtctccccgaggggtcgggccgctcccgtttcggccccgagggctggggcaccccgaccccctgtggtgttggcgccacgtgtgtgggttaggtgagcacagcggcgcttacctaaccgcatttatggcgggttagacgagcgcgccacgccgcattcaatgcggcgcagcgcatgcttatccggtctgtgaccagtcgcggtgtgtgaccggtcacagaccggtcagatcgcgggttaggtggcaacaggcggcctgtcacacgcctcgccccgtcccgtcggaatgatgagagcttcctggctctcgtctctagccggagctggcgtgctgactcctggagttggtatgtcagtcccggtcagatccattccaggcttcagcgcaagcgtggcaagaaaatcgctggccattgaatgaaggatgaaacgggcgtccaccgggagagctgacgagcggagcaggaggcgtgtgtactgcttgtcagatgtcatttccggctgtagattagccctcattgtaaaaagcatgtttcttttcttaggcagggagaggcccatgtggtgacccctaaccagataaaaaaaggggaggcccaggcctaagaaggggggactggagggggagagcctgaactctctctggcgctcgagctctcttgctctggagctctctgtattccttcacacacagatccaccagaacacaggagtagggtattatgcttctcagcggcccgaacctgtctacgtcacccgtgtcttgtgcgcttcttctcgttgacattcctcagatcgagggcgaagaacctcacttagcgcccccggccgaaccggcaaaggggggcctgcacggtctctcggtgaggagccccacgctccgtcatctggcgcgccaggtagggggcgcgcgtgtctttctaagccctcgtcctctttcgtgtgcgccaagcttctcccgctcaacccaatggccgaacgggcagtggcgcacagcctctctccgaacgctagcggtgaagacggggagcagaacccgcgccgtcgggctcgcaccccaccgtccccctctcgccgaaatcttgggcggggggaggcgctcagggaggtcggaggatccgcgacttcgccactcgcgggcgatgggggaggacggcgagacgggacgcgtcgccgcctcgtctacggcgatggcggcacgccctagggcgcgctccaggctgcgggcgcgctcctgcgtcacccacccgtcgtccccgatccagagactccagcccgacgttggctggatgacgtggccgacttggtcatgacggcgcagcagcgactaggcgccggcgggcggtcctccgccaccgaggcctctagcgctgccgccgccagctccaagtcgtcgaggcggagggcgcggcgaacggcggctgttacccgccgttcgtccgccattccctcgtcaacgcctccaacccaagaagatgtgcgtggggggccggatgcccgcctcgatatcgagcgccggcgcgacgatcgtcgcgccgcccacgcaacggagggcgcttcctcgtccggagtgccacttcggtccgggcacgggggccggccccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctatacgaccgggatcgaggccgccgggggtgacgacagggtcatggcgaatttctttcccatggccctgaagggtcaggcgcggggatggctaatgaacttgccacccgcgtcggtccactcttgggaggatttgtgccagcagttcaccacgaacttccagggcacatatccgcgcccaggcgaagaagcggacttgcatgcggtacagcgaagggacgatgagtcccttcgctcgtacattcagcggttctgtcaagtccgcaacaccataccgtgcattcccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccccgggtccgccgctcagtcagggcggcgggacaggaggaggaagaaggggtcggcccgttccgacgtcgagggtcatgtcctcgccgtcgagggcgcttcgcgggccccccgaaaggggaggcctgcgagcgacaaaaagaaggaggccggcgctcccagcagggagcgcccaaccggcaagtggtgtaccgtgcacaacacctccctccacgacctcgcggactgccgcgcggtcaaaagtttggctgagcggacgaggaagtgggaggaggagaagaggcaggagcgccgtgagggcaaaaccccggcggctcccgccggcaaccggcggggtgaggccaagcagaaggccaccgccgagaacatcgacgatggcgacgatgacctggggttccaggagcctgaggccaccgtcgccaccgtcgatgggggagcgtgtgctcacgcttctcgccggagcctcaaggccatgaagcgagagcttctggccgcggcccctacccatgaggcgacgcggcggacgcggtggtcggaggttgccctcaccttcgaccagaccgaccacccgccgtgcgttgcccggggaggacagatcgcgatggtggtttcccccactgtttgcaatgtgaagttggggcgtgtcctcatagacgggggtgcagccctcaacatcctttcccccgcagcctttgacgctatcaaggccccggggatggtgctccagccgtcccagccgatcatcggtgtgacgccggggcacacctgaccgctgggtcatatcgacctcccggtcaccttcggtggttccgccaacttccgcacggagcgggtggacttcgatgtggcggacctcagtctgccctacaacgcggtcctggggaggcccgcgttggtgaagttcatggcggcggtccactacgcttatctccagatgaagatgctgggccccggtggccccatcaccgtccatggcgacctcaaagtcgcgcttgcttgtatggagcagcgcgcggaccaccttgccgcggcgtccaagcccgcgggcggcgacgagaggctcagcacctccgtcccggccgccccaaggcggcggatggtcacgtgcgacgaggtcccgatcaaggaggttgccctgggcgacggcccgtccaagatcacacgaatcggtggtcttctggacgacaaataggaagacgcgctcgtctccttcctgcgggcaaatgccgacgtcttcgcctggagaccggcggacatgcccggggtcctcagggaggtgattgagcaccgtctcaccgtgcggccgggcgcaaggccggtccggcagaaagtgcagcggcaggccccggaacgtcaagccttcatccgcgaggaggtggcgcgacttctggaggccggattcatccgcgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttatttttatacgacaatgcctttcgggttaaagaatgcaggtcctacttttcaacgcactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcgggccttcactcagttgaaagcgtacctcagttctcccccagtcctggtcgccccggagccagatgagccgttgctactctacctggcggcaaccccgcaggtggtcagcgcggcgttggttgtggagcgcgacgaggacaaccctcaccccgcgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatagccccggggccactgcgggaaggccgcgcctgtcgccctccgaccccgaggtcgtcggcacagaagccgagtgcgccccgcgtggcctctcggacgaagagcgccctggagatgcggcccctggcgaagaggatcggccccgccgaaaggtgcagcggcccgtttacttcgttagcgaggccctctgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagctcgtctccgcccccgaggccagctcgggcccctcgcagctgcctcacaccgcctactgggtgatgcagttcgacggctccctgtctcttcagggcgccggtgcgggggtcacgttgacctcgccgagcggagacttcctcagatacttggtccgcctcgactttcgggcgaccaacaatatggcggagtacgagggaatccttgcgggactcagagtggcagctggactggggatccgccgcctcctggtgttaggcgactcccagttagtcgttaaccaggtctgtaaggagtaccggtgctctgacccgcagatggacgcttacgtgcgccaggtgcggcgtatggagcgccatttcgacgggatagagcttcggcacgtgcccagacgggataacgcggtcgccgacgaactctcaaggctcgcttcctcgcgagcccagaccccaccgggcgcctttgaagaaaggcttgcctagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgtgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatatccatgaaggcgagtgcggagcccactccgcctcacgcaccttggttggcaaggcctttcgccagggtttctattggccgacggctctcaacgatgcggtcgacctggtccggcggtgcagggcgtgccagttccacgccaggcaaacccatcagccggcccaggccctgcagaccatacctctttcgtggccgtttgctgtctgggggctcgatatcctgggtccgttcaggcgggccccgggcggtttcgagtatctgtatgtcgctgtcgacaagttcactaagtggcccgaggcttatccggtcatcaagatcgataagcactccgcgcttaaattcatcaggggcaccactgctcgatttgggatgcctaaccgtatcattacggataatggcacccaattcactagtgagctcttcggtgactactgcgaagacatgggcattaagctctacttcgcctcccccgcccaccccagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttccacgtctacggcgcggaggcggtcctcccatctgagctcaccctgaggtctcctcgggtcaccatgtattgcgaggctgatcaagatcagcttcgccgagacgacctcgactacttggaagaacgaaggcggcatgcggccctccgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcgagcacattcgtcgcttctacccctagtgggggtcgggtgtcatgtctcgggctcgggccaaccccgcaccccccccccccgggcgtgcagggttggccgggggctaccacatgcatatacttaccttttttctcttccatatttcaataaaagcattttcgatttcctgaggattgtgtctgtgccatcgtttccttttgaagaatcttggcttgaattagcacgctcgtgctcgaccctgccctcggtggcccgggccggctaaaatcgccaaacggggcccagaaccgagccgtgccccggggcgtggtgaactccgggggggaatcggcaaaggcctacaatcgggtcatccataaccctcggtcaccacgctcccggcctggccagtctcgacacacggatctccccaggcactagccccgacccgcgccgcttgaggttgggacctgggcacgagccctcgttcaagccaagacacagaaggaccgcggcacagaccatcctcatctcatacacacaacaaacagaactgacgcagaaattgcctctttacttgattacagactaaatcagtctatacaagaaaggggcccgaaggcctcggaagaagaaggaaaagttattaagattggcgggggcctgggggctcactccgacgcgcccgggtcgccggcctcgtcgtcgctgtcgtccgcaccgtcgtcaccgccctcctcgtcggagtcaagcgcgaacgcgagccgaggggccgtaccctcgaagctgtggacgatgtggtcggcggcgtcccggacccgcgcacgcgcgccgtcctcggttccgggagggaactcttccagcgctgcccacggagagaagtcagggtccctggcctggtagcttgccagtacgagctccaccgctccccgagcgaggtccctcgaggatgacttgatcgtctcctcgagctcctcggggagccgctcgagggccccggtcatttctgagaggtgctgggcgaggcccccctggttggcggcgtacttcgcgtgccgcccgccccagaggcccgcctgccgcccggcgcggtctagacgggagacggcgtcccgaagcatgccgggccctacctcgctcgccaagcggagggcctcgacctccctggcggacgagtccagcgcgccctgcagctcggcgatggtgtgttcggcggctgcgaggcgggcggctaggtcgccgtggcccgcggccgccccgccgctgtgcgccctcgcgtccagctccttcgcccgcgcctcgagctcagcggcccgctgatccagtgcggccctctcggcgcgggcgccttccagattgcggcgcgcctgctcctcccgcgctgcctcacgaagagacaggctgtccgccagccgctgcgccgcggcctcggcctcctcgagagctcgcccccgctcggtgagcgcgtcctcgcggaggcggagtgtggactcttcttcggcgcaggcggcctcgtgcgccgccagtgttgcctcccgggtggcgacagcggcctcgcggtccgccaggtctcgctccttcgcgtccaggacgcgggcgcgctcctccagcgccgtggcgcgagcctcaagggcctcttcgcgctgccgggacgccgcctcgttctccgccgcccgccgttcccgggcagcggcggcgtcaagaactccccggtcggcgtcgagcttctcctccagctccgccgcccggctcccgtattggaggcggaggtcgttccgcgcctcgtcgagcacggcggtggcgatgagggcagtctcccgctcctcctccacctccctggcgatctccgccagctccctacgacgggcctcgagctgtgaggtgtgccggcggtgcgccttgcggcccgcctctaccatggcctccaccgagcgccgcccctcctcgacgcgcgcccacgccgcgtcgagctccgcccgctccgcctgcagggcctccatctgggcacttaacccgtccagcaccgtgctgttcgcggcggccaaggcctgcaggaagggctccgcgctcagtggggcagcggaagacagaggagagagccgcctcggtgtgggcgccgcgcggctcggcccgccgatcgacgtgccggactcgggggcgtccctcgaggctggctcgtcccaagtgtcatcgtgggtggcctcggaagttgtcgtcccctcgggcggagtcgggtcggaggtttggcaggccgcctggcgtgcgcgcgccgcctctgcctcccggacggactccccggcccggcggagtctggcctcctcccgagcggcctcctcagcctagcgaacccggacggcctcctgggcagcctcctcggcttcccggaggcggtccgcggcttctcgccggtcggcttcccgcctccaggcctccgcggtcgccgtctcctcggcctcagaccggccggacttggaatggcggggggggcgcgacgggatctcgctgaggcagaagaaaaaccagaagacaaaaagaaacgggtgagtgaaaactcgccttaggagatgggagaatgaatacggccgcggtgggcgcggggacgaacctgcggggaggtcggctaaacgaccacctcgggggcgagatgaggctcccccggcatggctcggtcccccccccatcttgcggggccgtttcttctttcgctccccctcgggctgcggcgtcggcgcagcaccctccgggagcctgccgctggcacgcaccgccccgccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccgcgccatcgtggcctcggggggcccgctcccccgacgccccgacctcctgcatgatggtcaggatgttggcacgctccggatcgcagcagagggggaggaccccttgggggatgagggatgcctccacgaagcttagattcagcacccgttggaccaccatcctgaagtcctcagggtcccagtcccatttgcgcccctggtgggtcttcatgatgtcctcgggcccagtgtactcccaggcgcctcgggcgcgccgctggagcggcgcgatccggcgacgaaggtagtcgccgaacaccatggcccccgtgagcccctgggatcgcaggcccgccaggcggtcaagaacggcgtcgtggccgtctcccagatctaccgtcgcccgccagctggaggcctgcgccgggggctggctcggaagtcggaggcgcgcttcgtcggcgaggggggtgtagaaccagtcgctcttccagtcgtcccactttttgcggaggacgcagggaatgtagcagttcagcacctgcccccgcggctggaagtagcagccaccgactaccgtcggcggcgacaccggctgaacggtgaagaaccaccggaacagccggagagatgggcgcaccccaataaacatctcgcacaggtgtgcgaagatggccaacgtcattatcgcgttgggggtgaggtgcgccatctggagatcataaaactccaggatatccatgaaaaaaacagagaatggcgggaccagccccgccattgcgaaagagaggaagaagacggaccgccccgggtagtgcggcgccgggcgtccctcgcccagcgcgaccacctcccggccggtggcagattccggcatgaatcggcgcggcagcccggcctgcctctcgctcacgatgcgggaaggcggcagcacgctaccctcgagcggtgcggagccccgtgccatgacgccggcagaggaagggcttgagagcgagcgagtatggcaagggtagggcgcaggaaacggagagtcagagaacaagtggcgaaggcaaggggaagagtggcgagaggaaggaaacaaatcccttccttggcgtctttgtacccttgccaacgctatgcccagctcctcgcttcccgcgcccactacctcgccccctcgtttctcgcgcccacgcctccaccaaccccactcgcccgtttgcggcgcacgcggcagatgtgcggccgtggcgtttgagatggggcagatcgtgcgcgcattaaccgcgctcgccaaccgcgaaaaacgccatcatcgtgtccccaggcgaaacaaaccggctcgtcccgattcgcgcgctactcgagtaatgtagcggtcttgaagaggccgctcattattgtcgatcggtttttcccttaccgatgcgcgcgatttgcgaccgttgggtttctgcctgcctgtggggaccggccccacctgtcaccgggcctaaggagtggcatcacgcccgagcgcctccctcgaggggggcggtcgccctggcataacgccgggggctactgtcggtgacatggggccgggggtatcgtgactagaggcttggatagccgcgatcactcacgtggcccgaccccctcgggggggtcgggcccgacggtgacatggccacccctccctctgtctccccgaggggtcgggccgcttccgttttggccccgagggctggggcaccccgaccccctgtggtgttggcgccacgtgtgtgggttaggtgagcacagcggcgctcacctaaccgcatttatggcgggttagacgagcgcgccacgccgcattcaatgcggcgcagcgcatgcttatccggtctgtgaccaatcgcggtgtgtgaccggtcacagaccggtcagatcgcgggttaggtggcaacaggcggcctgtcacacgcctcgccccgtcccgtcggaatgatgagagcttcctggctctcgtctctagccggagctggcgtgctgactcctggagttggtaagtcagtcccggtcagatccattccaggcttcagcgcaagcgtggcaagaaaatcgctggccattgaatgaaggatgaaacgggcgtccaccgggagagctgacgagcggagcaggaggcgtgtgtactgcttgtcagaggtcatttccggctgtagattagccctcattgtaaaaagcatgtttcttttcttaggcagggagaggcccatgtggtgacccctaaccagataaaaaaaggggaggcccaggcctaagaaggggggactggagggggagagcctgaactctctctggcgctcgagctctctggctctggagctctctgtattccttcacacacagatccaccagaacacaggagtagggtattacgcttctcagcggcccgaacctgtctacgtcgcccgtgtcttgtgcgcttcttctcgttgacattcctcatatcgagggcgaagaacctcacttagcgtccccggccgaaccggcaaaggggggcctgcacggtctcccggtgaggagccccacgctccgtcagagttgtactgacaacctgggattagagatgcttgacgccttaaagaaagggctctgcgatctgtcttgtcttgtgttgctatttatatattgccatctgtaatgtctctcttgctttcgctcgtgttgcttattttgccttgcgagagaaatatgaaaatcacgtgggtgggaacgcctaaaaattgcgaaagtaaaaaaaaacagagtggaatacgtcgtggaaaagactcctagatgtaggttatgtttgtaggtggacctgaactacaattgaccgacaaacaaaaaatgatgtgacgattggaaagttatcaatttttatatacagatatagattaaatttgaagttgcattattgatctatcttatcaaatattttaaaattttttgtaacttttattacacgatatgtaaaaaatgaggagcctcctctcaaggacaaaactccgcggctctgtgttggtcatagaaaaccatcgccactagtcgttagtcgaggacagaaactacaaattctcggttctccggcccttagcagccaagtcacatcttcatagcagaaaatgttgcgctgcaccagcgacagtccagatcgggatataggatattcaaaacagctggatcgaaaggtacgtggcaacatatatagtgttgtccccgcttgcacacgaacaagcgacggaagtgttataataacggccccgatagcacaatagataacagaatacggaacaaacgacatagaagattcaatactgaagacgacaccaagacacaatatttgttaacgagattcaaccgaaacttatatctcttgagacgtgctattatgggtgctcctctacaatccagcatattataatatactataatatattatggtacggccgaaacttatattctgttacgagtgctccacgaccctcaaccggttaggccgttgaccagttgtacccaaacctatgctattgtcatcttgcggttataaccggtgtgtctctctatttaagagagagcctagaatcgagtctgactctaagtctatcctacatttatcccaactcctagtaggattagtatatccgacacttattctaacaaactccaccttgacaaatacacctcacctagaagtaatagaatcaccatgtcgatccaccggtccttcagacttggcttgtcttcttctgcagattcattgtgaaccgcccgacgagcctacaccagactcaccgccttcaagtgtaactcctttctctggacttcacctgcaacagtgctccaccttctcacatatcatcaaagtcgtcttgccaagcgaaattggactcctccttcaccgccacataccagactcctcaaagaccatgttcacttttatcttttgtcttaaattttgattttatctacttcatggccagaaaacacatgccatcgccaaatagacaaatcaaactcatcagaccattgaagagaaccctttcttccttatcgtcttatgaaccaagctaaaaaaccaacatccatgcttttcacatatatagactgaatgcatgatactttgagaaaattcactgctgccttgaatcacttgaagaaactaccaccatagagattgctcatcctcttcaacgacgtagttttcatatatctccatcatgccgactccacatcctagaatatcatgtattgctagacaatcccgttgacaccttcaacgatttcgacccactattgcctgtgattttccatgcactgttggacatctctgcttgagccacggccttctctggtcaatccttggtgaacgcctaaacctggtgcccaattattgttgttgttaattcacggtccgcttttcggtttaactagacatcctgagtccaaattgactctgtttctccgtcatctaccacacggcctccatatgagctcgtctactccgagttggaaaaaattcctcgatcacaccgtaaagcgacaaagaaaagataacactgttaggttttactctctggccatcgagccagatggaggtgtacggcacgactcacctaagtccggcactctacctagcagaaaaggcgcgtctacggactcgtgcacacgtcacgcgcgttgatcggatcgctcgcaatgatttccaacgaaaacgcccctgactcccatagttctatctatatacctaattaaaaaataaataaggtttccgactgttttgtcgtccgtttcggatcggggctttttattccaaaaccccagttgatatagtatatgtacgttacaagtaatcacctaacacatgtataaatctgcctacttagttaaggaagaacttcttcactccagccaccagggttcgattccaacttactctaagatgtttcgtacgtcgtcactgaatgtatccgattccgcatattagaaaaaaaaatctatcgcgcttgggtcatgtccggcaccacgcgcgcgcgttcttgcggcccgcgtaaaccacgagtcctattccacgtgaaacatccaagccgcaagattgattcaattctcgtgcacgtaacatccaaatccaaacctataggatttataaaacgctatgatcaattcaaataaaactcccaagaaatcctcattagaaaagtcgggcaagaaaaccaaaatctctctcccattcctctgccccacgctggttcttggctagaaaagttaaaggaagcatacacagagcaagaaaaagaaaaattatactagcaaagcatacatcacccgacactctgtgctgaccacgactgggatagtcccaaagtagaggggagatcgaccagggcgggacagcgctgtcgtcgtcgttgtcatccccggccaccggtgttgtcccaggctgtcggcgttgctagatccaccaagcggcaacggcaggcgggcaggggaagagggaagagtggaggcggcagccgaaggaaagggcccggtcgtcagcggggagcgctggctgccggagcttgagatgatctggagcgccggcggtggagcggagcggcgctggatcgcgattgtgatagggatgaacggttaaccggatgggtggataaatatcatctgtcatcttctattttagcccctgaacttcgtaaatattacgacaatttctttatttagttgatttctttcatataagccctaaatttcatatttattttcatactagccctcaatgatctctttcccctactaattaagggcatgttcactttgatgccaaaaaaacccaaaatttttatcaaaatttagcagcaaactaaatatagccatattttgacaactttagcaaaatttggtaagattaaagatgtcatcaaagtgaataggacccaaatcagtttttctattttctaattaataaattacatatattagacgagtccctgaatttctttttttaatatagtttcagacacccgagtcagactccgactcccgagtccaagtcccgtaacactgcatgcataccagccctgctcaagttgagagactagaaagaggttggccgccggcaagtcgggaggaagaggcagagccaaagaggtgagcacggaggcgttgccatgtgaagtcgcgagagaatacatgcgacattgcgacgtgccggggttgactggatgggcatgggcattttttctataagaaatctatttaaaaaactcgcatcaatcggacttttaactgtagctcaagattttctaatatatatatatatatatatatatatatatatatatatatatatatatatatatatatatatatccaagtaaactcacacagtaaatttcatattaactaaaccatataacaataatacgattaaaatagactttacccgttataatgcacgggcattttttctagtaacttataagaggactaagcctcatgcgagaaatcacacacatcatggttcccgttcctcaaaaccctaaacctatcgatcctaattaagcgctaaagggagattgaaggacaacatccaccccggtgactcaattttctcgcactggcgttcatctaccgcatcaccgacacctacatctacaacgacaaactttataattggtgtggggtgagagatataaattttttaacaatagccatcagaaaaattggacacatgaaagctacatcactagatttgtcattatggcatttctttttaataacttgtgttgtttaattatagagatacttcctgcgttttatattataagacatgtgtatgcttagattcattaacatataaataaatgtgagcaatgctagaaagacttataacaacggaggtatagtagttctttttaaaataatgttagttgtgcttttgaagggtaagcaccgatgggaggctggtagtagagctataggtgcatagggatggcaacggagtgggtcggggccaggttaagctggaacggtcttggcccctgccccggccccggccctgctcttggatctcctcacccggcccggccccggccccacaaaagaaaacaggaaaaccaagccccgcccccgtcaccgctgggccccgcaacctgagcttggccagcaaagtgtgtgtatgcattagaattagtgcatcacaaacaacatattcaaaaatacaaattttcatattacaaatgcgaaacgacacaagcaaaaatccacaatcaggttcttacaggagctagatgaagacaaatcctcatcaggataaagctgcttcgctgctggcctgctccttttccttcctttctgtccgttactatgcgaaaaacacacactggcctaggagatctgcttaactccagtacaggtccacaacttgatgagatgtaggcgtgccagtcagtttgatcatgcaactgacaagatatgcaaatagtagatcaaacagccgatcggttgataagccgatggagtagttccagccgatagccgataattgccgatgtcgattccagccgatagcgataaggttttgagcaatcggctatacacccgatgtatataatgatataaaagcgatcggctgatgataatcaatataattaaacaatataatccagtagaaaccaatcagataataatgatatgatagaataagtactgatccgaaggttaaagcatacatcggctgtaggtccaatgtcataaaatccaagagattagattaaacgatgaaatctttgttgcgatcagctaaatccaatatgtatacaatccttttaagccgatgcaacgtccagataactcatcggctgaaaccccgatgaaaccctttattagcaatcaagatgcagactatagattatggttctaagcacgacttagtagatcaaacttaattgatgcagcattaaatatgaaaagaaacataatatctagacaatcaagccgttgactgagtttttagggtggtagatgtctaagctaatctaatctagcaacacgatttagccgataccggcataaaccctaaaacgagaaaaagccgatagagctaaattgatatgctaagactagattaacataggcatatgataaataggtaagcaaaatatatcatctaaaccagagcaatccaagaggtcgaatgtactgatgcagtcttgaacgacgccgacgtaaacgatataattgcatgggccgacgaaacattggacttaccccttcgccggagatcgaataccgatgcagccctacgtcaagcgccaagtcccgccggacgataaaataaagtagaaaaggtaaaaggtggcgatgcgccgaattgtattaatcgtggattgatagattacaataacccccggtgtacatatttatacccatagggagatactagtccttgtcggacaagaaagaaactaaagataaaaggaaaagataaagtacttataggacactaaacacactttcctaaagataaaaggaaactaacaaactattcctaattaatagataacttgccatgccgcattctctttgaactcggcctcttctggataagcttcctttagtagatcaatttccttaaccgaatatagcaagaattcgacaactgacgacttgataactctcatcggctaatctcaagacttcgaagccgatgattactctgggcttaccaaatttcacagttaacactcgtccctcctgttcgttggcttggggcaaagggacagcacggcgagaccaagtgatcgactggtcggcacggctcccgaaggattgagattaggtgcagtcggtatagcgactgcaattttggcagtcgtgtgatccagaacgtgcgaaatgaatcaaacggcccacgttaaggcagccttgcacttgaccgtctcagcgagccaagggccatggcgatagctcagcttgaaaaaaaatgatgaaccacatatactctcatcaaacgcgcgagagcatgcccgcgttagtttaggtctgcctgagcatgctgctcaacaccctctgaccctcatgtgcgctgcttgcttccgttgtcggcgccggcagcgtcgtcttccgctccgaccaacatcatcgtcaacacctgctgcagggactagcgctaagttcatctaaggcgagaaggtgaacaacgttgacaacgacgagttgacggcattaccggcgctcctagctcgccgtcactgccgatggcctccgccctcgtctcgtccacggccgtccgagaatctacccgccgattgccatgttttctatttcttcgctgagatcgccaacttaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5506 - DNA, 1966 bp, Oryza sativa
  unsure (1)..(1966): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgataacctcgcattggcagtacccgctccatgaacttaaatccttatgcactctaggcgtccatgtttctagcagtgagaggagttctgacgctcccgggaaagagaagtctcacacatattaaattatggttcaagttaagttctctctcacacactcatggcagtcctaccaatggcgacaccgatatagggcacgcctctcggccctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctctcacaaatcatatcatcaacgtcatggcaatgtggcactcatgtctccacatgccgcatctcaattaccttcccaaaggtaattgcccaagcatatagcatttgataaatatgagtatgcatgattctagaatggcatttctaagcaattgtcataattgactagggactcatacgtaatcatggttacaaggattttaagggtaaacaataatcaaggcatggcataatcacaagtaagatgttcatcattgcatgcaattttatttataaacaaaataatttcgcaattgggatcaatatattcaaagaatagtgatgacttgccttgctcaaagtcttgcggttcttggtcctcgcttggatccgcaactccctcggactctaaaattacgtgcgaagaaacgatttgaattcggttaaaattcaaataaagatccaaataaatccaaatggaagtcgaatgcgaaagttgattcttttatattaactttactattcgcgaactagggcaaatctaatttcgatttatacatcctaaactatttttcgggtataaatattttgttatcataagtttttaatttaatctacccgagcattatatccatataataggttagaaattttctatcgcgagctaaatatcggacggaatcaaaaaattatcttataatattatacgatttaatttaccctatgactaaccgattaaatataatatacgtctaaaattcctagtgattaaatccgaacttctaccgtgaatcgattacttatagagattatccaaaactaatctataatagtctataacaattcatctaattgtttagtcgttaattacatctaaactactaccacgaattgattttttttagaaattaccaagaataatctataatttatattaaattttgcaattctatgaccataattaatctataattaaattctaattattttagattttcttaaactattaacctccttaatttcttcctaattttctatttatttttccttttctttttctccattctctcttctctttttctttctttttctttcttttcgctctttctctttttctttcttttctctctttctctctttttctctctgccggcctctcttttcctctctctctctctcggctctctcccacccaagcagcggcggcggtggacgcgagggggaaggagggcggctcaccggcggcggcagcggcgacgacggcggcggcgatggtggtgcacggcggcgcgggagtggcagcacggcggcacgggaacggcggcgcggcggcacgggagcggcggcgcagtggagagggaagaggggaggaagggtgagatggggtgggggaaaatggagagagg

SEQ ID NO: 5507 - DNA, 21221 bp, Oryza sativa
cggcgcacccggcaggggagggggcggggctagggggaccacgatcgaacacctatgccgcaatgaacagtaacttttcctatttatcccgatttttgcccattttctatttaaatatagccctataaattctaatttttgcataaatgaagtttgctccatatttgtgttatcctaattaaaaattcaccctactttaatatcactcatattttgtttatataatttatttgaatttttaattagggttaattctcattccatcgtactaaaatttaattattgctaatatggtcgcgataaaattttatttatttccaatcccacctaatctttattttaatttatattttaattatttatttagccaacttgatttttagggtttattcctagttagttattcattattcgcgattaataaattccgagattaaaatctaatgaaataggcgaataaaatcggcatgatgcaatatttttggtgttttgatttcgttggtcgaattttcagggtgttacactggtgattcattgaatgcatcaacatatcaattgatcctacggtctattttggaagaatcattcaggtgagcatcaactaatctttggtaagctaattaatttcgaattttgttttctaagactaagtttagatacatctacatgttttataaaagtaattgtgaaaagagaattgggcaacgaaatgacgaagacgcgattaaaattaattctaaaagttaaggacagttaaggacgcgattaaaataaagccgtgcctagcaggcaagaatcctcgtgcagtgtaccgagataaatcattatcgaataaaagagtactaaatctcaaaaaaagaataaaagagtactccatttgagaatttatatcttgtcatttctaccatgaatagagaacaatgcatcaatttgctccaatggaatatatattctgaagaacagaatcttgttacttacattatttgactttatgtcactgacatatagatacatactgagatgcagtcacatgacttaacaccagagaatccgcatccatatttcgatgggtactctctacaactccccggtactataaaagaaagaatctctgtttttttatcgcaaaacattaaaaaaaaaggaaccgttgaaacgtgatcttgagtgatctattttcaattgcaccaacgaattaaactgaataaattgaccaagggttagtgaacatctccagtcattttttaagagctcactgtcgaagcacttgcatcaatcttcacaaccaaaaatagctactagcaccaaagaaataagataggtagaatctgataaaacctgctcccgaataaacatttttttcattaacctacgaattaaactcactaaaattgacgaaattaagcaagccaataggtcctcgacttttaaagctcattgttgaaggcagaagcacttgcataaatctgcacaactaaaagtatgttcaaatcccagacttttatgtgtgcttgtatttacggacgattattttttctgacagacgatgtacccgttgataccggggtgtttgtggattgtgataattttatcaatttcaatatattggcctggactttggagatgcttataagtgtacaatatgcatatgtgtacttatgatgagagtgcttgcgtatatatgagagcctatgtttgcagtgtttctataaaaaaaagggttacagagagaactggtactgcatttagcacctactctgtatcaactgctatcttgattataaaagcatggccataatgatccatgctcttaaagttatatcaactggctggcaacttagtactactaattttcagtaaagtgttgttcctttcaagaacggcaagggcgatcagagcgtcgtcttgccgatctgcttgccctcatgggcaggttccagctcgatgtccaaaccctcatcgcagagctcatcttctgtctaaatgcaattgcaacgcatgtgttctactgttcttgtttcttcttggttcagattgtacttaaatttgttggtgtcagataacatgctggccctctagttcatcccacgacgcagagtagggactattcctattgtgttccaaaaaaaaaaaaattacatacgtgctattcgttctctacattttttcagttctgtgacagagtgaaacttcctgtgagcgagtaaagcttattgtacaatggtagagtactaaattacttctctttctacctagagacaaacatcaactttctttttataaacacattagaaatggagacgctcacacacacacacacgtgcacagtcatctctacgaacagaccttatccctatgagcacatcagaaagattaaaccaacatatctttatattaataaagttattacaaacgcataattgttgataggtacgtcgactaccactgagacattaactgatcttggtaagaccttgttatggtccaaatagtataattttgatttttaagaataactttaaatttttacttactgtcttagcaatcataaaaaagaactgaacaacaaatatgacaaaatgagacctttaaaattaattccaaataaaagttaaagttcaaaaccacctctgaagtatataatataaagccgcatgctaagccggcaagatcctcgttctgtgtaccgaggatgcaacaagatggatttaaaggacaggccccatgggactttcccatatgtgtctcttgggaaactatcttctcatttctccttcatggaacatgaacgtggaacaggtgcgtcaaccagccagcttttgaatgtaacatattcagacatgaacattaaaacagagaagaatctgcgaaaaattcatccaattcatccatgaaaattaaaacagagaagaatctgcgaaaaatatggtattggtcctattggataagctgtttgtatttgaaaccatgaaccatactgaataaaactgatcagaacaggtcaacagatcctatacttttttaaaagctccttgttgaagcattttgcataaatatgcacaaccatgagatgttactgaagaaataagacaagtagtactgttcttcacaatactctgaaaacaaccttcttggttactttttttagacaatgaccgtaatgatctttggtctaatatttatatcacaattggccagcaactgttagagaaaatgacctcaatgatctttggtctaaaaattatattgtgtcactggtgtcttgtagcctcatcaccttcccatacctaacactatcccttttaaaatggtctcaactcttctaaaactagcaatgtggtactcctaacactaggcatggagtattaccgaattaatattcacaagcatgtcttttatgagatggggctttgtgattctccatatgggctcccatatataattccaacatcctctccattccttgacttcgtcatgtttgaatctcctccttgaagtttctatttcaggcccaaacaatggaaaagcaacaggaatgcagaccaagcacgcgattctgaacaccacagcagtagtagtgaaaccgagagatccctgtcgctggtatagtttgctgtgctgccttcaactaagcaaggccacagaggcctagtttacttccaaacttttttttcaaaaaacttttctatcacatcaacactttcctatacacataaatttctaactttttcgtcacattattttaatttcaacaaaattttcaattttgacgtgaactaaacatacccagagtgatcagctgctgggcaaaaccgtaaatcgaaacgattctgaatttctggttcacgggtcggctggaatcatcgtggtgtcgtattaatatagtagtatttaactgcactgcactgtatcagtttagtgtgaactttacagagagctatactagactacgatacagagagaatgacagattggcccgatcgatttgttctccggcatgggcgaccctacacaaaatgcttcgttacagatagccaggtcgatgtgccgtctcctttgttgcttttcaccttttctttttactcaggctcacccagacacagacagtctcacatcacaagtcagtatgcatatgcctccaatctctgcagttcccagttggataggaggattcctagataatctcgcagagttcagtcgcacggctacagaatcggacattcagatcacagttgcaagcaacagatcacatgaacaagctccaactaatacagtttcagttcaaccagtccaatgcatacaggaacaaatcaagaaagttccagctcaccagccagtctttagtgtcttgctaccttcttcaagttccaacacgtacaaacagaaagggcaatccagatctccctgaagatgtgtgctttgtgatgaattttttataatcttttttgaagaataagctttgtgatgatttattaatacctgaaactcaattaggttctaaagcaagcattgcaagtagaggctctagagtagcatgacatgaagaggtagttacaccgtgtttagttccaaactttttttttcaaactttcaacttttctatcacttcaaaattttcctacacacataaactttcaacttttctgtcacatcgttctaatttcaatcaaactttcaattttgacgtgaactaaacacaaccttagtaccttgagcattcaaactccaaaaaggaagctgcttgagagagcaaagaagataccaaaccctcttctttccctatccccttccctcctatgatcctatcctatcctagcttccattccccctcaaccttgcacatcaccatcctccccttaatgccactcctcgcctcgctgctgccgccgcctcatcgcattctagagcattgctcatggcggaccaccaccaccagccgccgaccccaccacggcgccatcggcgtccccatgagctgtccatggcggcggaggaacgacaccatgggacgcagacggcgatggcgtcggatgacgatcgccaccatgatcgtggcggctggatcaggccggaggagaagcaccggagctccggcgtggcgtgggcgctggtgatcctgtgcacgctgctggcggtcggcgtgatcgtcgccggcgcgacggtgttcgccgtgtacctcatctacaagccccggatgccgtacctggtggtgtccgacgcgcagctggtgcggctggactacgaccagggcggcaccatcgactacctggaggcgctcgtcaccgtcatggcgaggaacaccaactccagggcggacgcctccttcgcccgcgtcgacctcgcgctccgcttccacggcgccgacgtcgcgcgcctccgcgccgcgccgttcgtggtggcgagcgcctccgcggcgccgctccggtacgacgtcgtgtcgaaggggcgcgcgctggacgccggcgggatgcgcgccatggacgcgtcgctcaagtccggcgtcgtgccgctcgacctcctcggccgcgcgcgcacgcggtggaaggtcgggatcttcgcgtcgctcaagttctggacgcgcatctcctgccgcctccacttcttctaccccggcaatggcaccgtcatggcctccgatcgcaacacctgcacctccaggtcgccatagccgatcgccattgattccaattcctccatttgattcgttcgttgcatctcgacgccatccgagacacgtacattactattacatcgcaccattacagatcatgtttcacttgtcatacttgtacagccaaataatgctggtacagtagaatctctgaatctacaagaagagtttattcaaatttagcgcgaaaacaaacacatttatatttgtaattctttattttttctcgatcagtcccctgtttgtactctgtaccaccaaattacgaagtcgatcctaattcctaaacagtgtgtatgaactacttcaagtgtcttttcgcttcgtgtcattgtcaggaatcagaatcgataacatcatcaactaatctcttcagtgttactactgcaaatccgatgaacattctctgacaaaatcagacgctgtctgtctactgaaaactgataatacttcaccattgggctgggcctgaattaccagattggactttctggcccaatatgtaaatccgatgaacattctctgacaaaaggaaaaagtacatcgaaggtccctccctgccgccgcgccaccgtgcggcccacgatgggccggcccgcacaaggagaaaagtgagaaagagagaggaagaagggacagaagaggggagagagatggtgatggcgtagtcaccctgccgtatgggttccacgctaactcagctaccacgtcggataaaatcagggtcaaaatcgtccaagtatccaaagtgacctggttttgtaagttgagggatggtatacaattttataatccgatgacaagatgagattggaccttatggcccaatatagaaggcccacctattcttgggccgaagtctaagcccaacaaccggtcagcgagtcgcgacggggagggagtggctgggaatcgccggagaagaggaggatgacgccgtgacacgggagcacagcaaggtcatcgtcgtcggcttccgtacgagactaggaggagaagtggggattggattgccgcggaattatctccgtcgctgtcgccaccggccgtggggaagcagcgcgcggcgcggcgcgggggggagagtctcctccgccaccgccagcgtgggcagtgggactacctccttgccccgctacgcgacgcggcgacgtcgccgtcggcgtcgtcacccctccgcacggtgcactgaacgtggcgcctccacttggcgcgcgacgcgacgcgacgcggcccgccttcttcttctctactgctacttaaccaccagccgcgcgcgaagtgcggcgagcgcgcaatcgaggtcgaacacttggccggcatgaagcccaggcctaccggattcggggccgcggcggcggcggcggcggaagttttggtggggggcggatgcggtggatgggcgtggaggccgaggccgaggccggcgacggtggcctccaccgcggcgatgtcggtgagggggcctggtactacccaggcggccgcggcggcaagcgccgtgcactcggagcgccaccgcggcggggtgcacgggctgcagctccctccgctgcggctgcagttcaccgccgacctggaggcgcggatcgagaaggtgatctacgcctgccgcttcatgaccttcctcgccatcgccggctcgctcatcggctccgtcccctgcttcctcaaggtcgatttttatctcctctcttcaggttcgatctactcctagcaatttgttgactgtccaactctgcagggctgcgtctatgtgatggatgccttcatcgagtactacctgcacggtggcggcaaggtcaccctgatgctagttgaagccattggtaactaactaactaatctccctaaacttgatgctgttctacacacttcagccatgagcaattaaccactttgtatcttcagcaacacagattagcagttgataacacgggagcacaagcaccaaaccacaaattgcatcgttgctacatgcatcctagtggagttatatgtagtaatttctgataactgaccagtgtgcatttcttgatttacctcagatatgtttctggttggaacggtcatgtttgtcttcgggacagggctatacgagctgttcatcagtaacatggacattgcaaagtcatcatcctatggctctaacctctttggcttgttcaggctcccggttggttcacgcacttagcatccctctaaatggtgcggtaactggggaatttccagtatcctgatacctctgtttctatctgcaggaacggcctgagtggctcgaaatccagtcagtgaatgatctcaagactaagctggggcatgtcatcgtcatggttctactggttggcatctttgagaagagcaagagggtgaccatcacatcatgtactgacctcttctgctttgcagcatcgattttcctctcttcagcttgcctctacctgctctccaggctcagtagcaagtagaaaaataggaggtagcgacacctgaatggctggagcacaaacaggtcttgtacatatgacataggcctgttgtgtttcctatgccgtgcaacacctcatgttatgtttacataatgtaaaattagaggggagtttgcacatctcacgtactctttgtatggaatggaaactactttgtatagtggagccataagacattattgtcaccatcactgtgtaccacctggtactgcaactcactgcttcgatgataaatataaatagttactgctatggcatgttatgaattgattagcaatgctgccttttctgtctgtgattcttttgaagtttttagagcaggattactttgttgatttcttttatacccccaaaagtataaccaagtgctagttaattagtttagaccaggaggagttgcacctatttcttattcttatgatgtcttttatgaacacttctgaatgatatgtatgttatgctattatatgccaaacatactacttgccttcaaaatcattggtgtgatacaggaatgctctgacctccctctttgatattagtagttcctatttgatcacaaggccctggtgaagcttgccaacatagtgtttccatattatcgcttattttcttacacacagagtatatttgatgaatggagtgttgtttggtgtgactactggcttgtgaatgaattgaaacctgcagaatctaattacgtgttatgtatccatgtccttctttctaaaaaaaaatataagtgaagctcatgatgtactctttgccgtatgttgaagcttatctgcgtagctatcgcccttatgagtaagaatactgaacacgatcattaatttgtgaggttataattctgagcaaaaacttgcttgatgttgcagttttatgtataactactaaagctgatgtttcagttctgtgacctacgtccggccaactgtccttcccacacataagatttggatgccagattatctttgaggtatgtttctgaccttcagtatttgcaactgttagcatcatgccatgatctgttgatttctgaattggatgcgccaatgtatggttgttgccttgagatttgtttctgagttctcacctagtatttgtaattcttaagaccattcaatgatttccgagttgaatgcatgggtgctttcctttgaggtatgtttctgctatcaagtattttttaaactgttgcaacattcagtgattcccaattgggtgcaccaatgcatgtttgatgcctatactaacagcaattgacctattcctaaaagtatttcgtagagaggcaaaactgctctggcaagaacgatgaaaattcctatgctttatgaactttggttaagtatgacaccttttctcttaggtgatcaaattaaaggagaggaataataagaagagcagcttgtattgtgccacaaacgatgacagaacctgaaataaattattcaggagttccaagccaaccaacgggaagcaaaggttcccaatcgaaaaaagacttcaaagtggcctttccaaacataaataaaagttccaggaatttgagaaaataaggatcccacaggggaggaataatttttggtggcgcagcaccttgaacgtatatacaatataattactttgaacatttgctgccgtatgatctcttttctatatgcagccgtgagcaacaaaattagaagctccaacttgctgttgtttcatatacataatagattggcagtctctgataggtcagtcatggttgcttgaacttgatgggaacacacaaagtgttgcacttgatgttttaagtatgcaacttgcatgcttaattaagacttgaaagatatatttagcccattataactttgttgctgccaaagtgtgggttgtcgagtattatctgttagatttattacaagtggatcaacttgtctattaaacttacattatttagcacacattttgctgggataactgatcatggtaatgagcagatgttttcatgactggatcctcagtccttggtaacatttggtaaaaaaagaaatgatagttcgctttcctggcaaaataagttgaggatgatcatggtggtaagaaggatgattttacataaaagcattatcctgatacatgtcaggttggcacagatttctcttagacctacatattcccatggtatcaattttttattactaatctcactctatacagtgtctattaggcagaagaagcttagatgtttctaagaatcaaactgaactgggaaaaggtgttccctttggctaggattaataaagtactaagattttgagacatccaaatcctaaacaattggctggggattgctgttatcaccacccgggtcctcccatcacttaactcctccaaaagtacctttcttgaactaaattaatgaaacaatctgcatatataaagaagggagctgctcaggtggtgaaccatcttacctgtgacttagtgagtaacctctgagttcttctcttccaatctccagctctattttgcttgttagcttcatggccatttcgtcgaaaaatgttgctgtgttcaagttgcttctgagtgtcatctttttcatgcagcactctgtgccagttcatgcaaggaagctggtagtgagggcacctatgatctgcatgcatcctccatgcacacggaggaatgccctggaggtgccagctgaacaagttgattcaaccactccaggccatagccctagcattggccataacactcctcccaactgagatgatctgatgctgctactgtgtcccagcctgaaatttgtaactcgggtctgtgaaaactcgggtctatgaaactcatatggtgtttcctggagcttctatgcatttgttcagaaaaggcgtaaagcatgcgactgaagaagctcgcgaagattttgttttccttttttcttttgttccccaagacttgtgcatgcctgcctgcatgctttcttttgttacctgtgtgaaaaacttttcctcaccttgtcttagaggagatctacagatctgtagcctgtaacagtgtgtctgttgaaaattttaactctccatatgttatgaacttgagaatggatgttgtaaggcgaggttaatcggctattttcttcaaaattttactagtacaatattgtaaactttaaagaggtacaccatgagtggtcctttggttttctacatatcctttgttgagcatgtaatttcgtccatatatacatcaagtttgtgtaaattgatcaggatttttaaagtcaaaattaatttaattaccttcaaatgagactgaacaggaccatgtttttcttcagaatggtgtaggacagcggtaacattttttcttaccctttgttgaaagataaattaacgcttggggtgtacaattgtataatgctgatactattacttgacaagtttatggcacccctggagctctaatctaacatgtcatctcattgttgtgtctgttttcttctggcaaagtgtggtatttttcttacaaagtttgatatgtgtagaacagttttgttatactgggtactaaaaagaaaataattttcctttgttcttcacttgtttgctacataatactactaagcaacactggccccttaatttttttgatcatttagtatgaggcaaaagaatgcagtggcagtagaactagcactgtgatgttagtaaaatattaagccaacaaatggtgcacaaatcactttctggtccagttcataaacaaatcacagtgtcctaggtagtactccatgctaatgcatctccttttgaaaaaaaaaagaagcatcattgttgcaaagaatgaccaacaacaggtagtgactgagaaagatatttccgaattaaggcatgtgtgggaactgagaactgataggttatttttaacacatcttctttattttattttttttttttcttgattgatagagaatctgcatcagccatcttcagcaaacataatgcagtttgttggtatggaaatagtgtgagatatcctatgcaagttataaaccagtttctttctcttgccattggagagaaatttcatcttgagctgtcacttcaatttatggctcccctcagacactgattctcaatctattacattatcaaaacagagggaaaacaagcgtttaccttttgctttcatgccctataaatttccatgtgaataaaagaaaagaaataattccgaattattgattgtagtgcgggtccatattataactgtctagattagaaaaagaatccacatcaaatacagttcaaatgataattgaaatttggaatagaatgaaggaacttcagaatataaaatgaaataaaaaacaaccgatataaaagaaacttcacaataaatactaaatagtacttcttccatttttaaatatataacgttgttgaaatctggacatttgatcattagtctcaaaaaaataagtatatttattttattttactatgacctttatcatttaatgcactttaagcatgtcctatattttttatatttgcatatatttttttaaatagtacgaacaatcaaacgtatgtccaaaactcaacagcgtcacgtattaaaaacggagctagtaataaaataatctatctactttagaaattcccaaaaactgatggttcgtgcaattgccaagtgtcagactccagtgacgccgttcagaagaacaaagagtaatctttcagtaacccatagttaattgaaacactttatccggccgaggtatgagcattttcacagcgttgtcgatgtctctctggctgctggtgaatcaatgatgaatcatggtcaaaccgacgacaatacaagagctgggcatctgcaggtacagattagtgcatctcctttacaacaaagaaaacctcagtgtttttccttaacttgaccagcagcagctagtgcctgacaaagctgtttcctaacttgggtatgtgactaagcagtgataagatatctgaaaaaaataataagtagggtgattatattaattattcttaacaccttcactactaaccttttgttttttggtggtgatcaggtcactgcaattaagcaagtgatcaattgatcaaatcatcactagctaccctgcattctccaagataatcaatacagcttcagtgtggcaacaaattaaagctgctttgttctcttttgcagatcaatatctgtgcgcatgcttagttcatcacgaataaatataaaaaccatcacgcataaatataaaatcattcatctgttggtattgggctacgtggttgaatcgagtgcttattattttctgctaagttgtatttctgtgattgtggatacttagtgcaattgtgcagctatctgatcaaacttttctctctttttttaaacttggagtctttgagaattcagatatttgcctcccatctcaattgataagtacgaggtgtatacagcttgattgcctcaccggctgtcaggtggtttaattatctgtgggctttccactttgtgttggaaaagtggtgatatattatccatcatttgtatatatagatggatgaatacttgcaggttagcatgactagtttaatgacaccatcagtgttggacagtggatctcatgttcttgctatcctctatgtgcatcatgccatcatgcttcagaattttatctcatttgttgtgagaaaagataattaagtttcaggtcaggcatctcgctcaacgaaatttaatgcaaattcagatggaactgtcttaaatcttaactaatgtatcccaaaaccatttatgaaaatgaaataaacctcctatttggctgagccgctaatcagtttggaatttcagaatgcttactaagtagctcatcagttccatgcctgttttgccttctcttcaacgaattgcagagccgggacagtaaatagcttgcaaattgcaccaaacatgcaaattttgaagcatattaaacatattaatttacataaattgtacccttcttcatgaaatacagcgatgattccttgttgattgagctctgaatgatagataattcactcaattccctcatggctacgcaacagaaggcatcaaaagtaacgctgattgcatcatctatcaccaagtagcagtagtactctgctttgctgacaccatgtacagatgtactcgctccctcacctacatcatcttcagagtttaatgtagttgacagaaaaaaaaaggcttaagtcatccaggcatcacagaaacgccattcacattttttttttgaaaggaaattaagcaccagggtgataaatttccaacctgaacgtcattttttgttgttctttcagatatttcaaccgtttacatatcatcttagttatttgctgtatctgttctgtcaaacttatctctagtttggaattcaggatgctaattatcccagttcatgatttcaagtagatggtgataccatgggtgttctaagaaaaaatgagtttgttctgggacatttgacgtttgaaagttgcagtggttactgccaaaatgagttacttccaatcttgaatgctgacgctactccctccagccaaaacagaagtgccgtcatatagcttgaatatatcaacagtatcatatgaataatcatattagccatagaaaaccatacaaatatgattaatttacagttcgagattgtgtcttgaagaccatatgtagatgtgaagaacagcactcccattatctaaaaaaaaaatgtgaagaacagcactcgttttgctagtatttgcaatttcagggttcaacaagtaagcaatatataccaacattttacagagaactttctacctcttcttggatgaaaaacgcaaaatatcaaatgatcattgaagaaaaactagtaacgtggagcatttggtcaagtagcaagatgatcattgacaaatctctgttccgaaacactagcctccgatcaagaacacatgacgagtgtgcatatatctatcttaatttctcaacccgtggctgctacctactccattgatacatttgatcactcgcataagatgaattgaattctttgcatgacatcaaatcatcaattcgatggctccagtgggcagatcagctttttgagctttgaccatggtgctcattgccggcgaggtcgtaagcctccttcgccgagcgaatgcaagaatccaagaacgaatttattgcagctagaggctcgcggcaatctccctttttaaggggctcatcagctgcggattcttgcacaacacatcgaatttgcattcgcattagcattcgcatcatcgcttgttgcctcagagagaagagagaaagaaagctcgagctctcggctcccatggcggcggcggcgtcatacgcgcacctcgtcctcgctgccaccctcgcgttcctggtgctgagctcgccgccgcagtcagcggcgagccgcgtcgacgtcttgaaggaagtagtagcaggcgagccaccagctgcggccatcgaaccagttgtcaacgatccgtcgtcgtcgccgccgccggcggtggcggcggtggtccacacgtcggagccatggccgccggtgcctccgtcggccccgtcaaacaagttcaactagctcaccagccgctaccaccaggatgtccggtcgctgtgattcggcggacgtcgccggagacgatggccggacagtcaccgtcatttcttgattcagataaaatcataaaaagcttgcatttgagcaagccgtataggtgtttgtgcgaggagtgcttctatgctctactggagagaaaaatcttcagattttagggggcgtctaggcttctagctggttgtgattaaactctgagttcgtcgagaaatctgtaaatcagtttcattttcagttgataatggaagcattttcttgctctctgattctgccttttcttcagttcttaccaaaatttgatactttgattcatctctgtgaagtacttgcattgttgataattgatgtggaagatttttgaaacctcatgtgctcttggagaggagatgaacaagtacatccataattttcagatacagccatctagtttaggtgcaaacattaattacagatacattcatggcgcacgtcaaacgtagcaaaggaaataagaacaaaaaaaataaaaatacagatcttgataaaattaaccggacagattgatggacaacggcatggtataattgggtatcaagagaaaatatcacggttgatgaagtatatatggctatggcgtgcaagtggaggaaggggcatccaatcctgcttccagacacccataaaaatacaatcaacaatatgtagggtgccatcctttggcatattggtgaaataagccaaacggcatatttgcaaacgaaaaataattcgtgaataaaacttttatatgtgtgttcttagcaatctaaaagcaaatgctggaaaataaacttcgatgaaaaaaccccaaaattagctttaaatttaacgttgaaaattcaaattttggctgataagcatatgaataatcgtgacatgtacccacaacccctttgtcccctagcagtccacccctcctccctctcgtttttctttttattttcttttgtaatctcctagccttgggttattgtacagttttttcccctactttaatacaaatacatcccacggggttaaaaaaaatgaaaatatcacggtaagtgatgctttggtaagacaacagcattcagatatgcatatactatgaactcttaatgaaaatataggttagtttaacattcaagaatgtttaccctgacccagccaacggttgggaaacaactacaaacaaaagactgcctaaaatgtcaaaacctaaaaggtacaaaactatatagcataaatatattataaaccgttagggttcgaccagctagaacaccatagccataaataagaagctacgccatgtcatgtgtcaatgtttgatgtctcgactacggtatttggacagtatggggatcgtcggtgctaggatatacgcgagactgaggaaaaagagatggagacagggatttttatacaggttcgggcccctgagctatcaggtaatagccctacatcctgttggctggagccgatgttgctttttattcaccataatcacaccagtacaatatgtggggtagcctatctaactgttgtcgacatggcggtctgaaggtctgactcatagtcgacaacagggtagccttcctcctcgagctcgcgcccgacggaatcagagacagtgctagatccctacggccggcctctaaaggtaccggatagggtcgatccaggcgtatctctgatgtcgatatccggcggcttgtcttggcgtatgtaggcttgtatgttgtggcttctggtgggtgttgattgtctcttcatggtgagtgtcgatcgtgttgatcgtcttatatcatgggtgtcttccatggtggttctccctggtgggtgtcgatcccccatggtgggtgtgtccccctgtcctcctaggggggcttgtatttatacccataggtgtccccttgtccaagtagaactagggaaaccaatatggatacaatccgagtagtccttgtcgtttccatgtagaactctggttgtctttccttatccggaactccctccatatccgaaggttgtttccgtataggacatggtatgtggtgggtcctgccgagatttagtcaactactattaggtatgtggtatccataaccatgacagtagcccctgacttcgatgcaaatgaacgaattcatattctcaaccacgcgcagacattggagtaactgttatcgagctcatgtgatcgttctcggtaagtttagagataatgttggacttcctttgtcagcctcgtgcgggcaccgaaagggtttgtctaagtcaatctctaatgtcgaccgagaaagtacagagcgtacgactaagtctcccgtcttgctgtaatcgagaatttggattgaagtcaagaaactttatctcggcgggtacaccatctcttcattccgtattccttgtcaagatccagcaaccgttctcgagcgatcgagaaggcgtagagtctgcgaaggagctttgtcaacatttgtcgtactcgccttagtcgatcttggtgtagaaccatagagacatggagtcttcgtcaatgtcgaatagaattttcctgaaatcaatactcagaaaagaatatcaaatagaaatagcccccgagcgaatgcccaaagggtgacatgttataatatgtatggtaaattgaaaatgaattaaatttatcgaccaatgttttgtgtatgagcgtcttctctcttaccgacttcgatcagttagtttgtagagtcatacactctccctagcccccagccttatcgtcggagaatcgttctcagaggataatgctcttggacccttgacctgccttggttgaataagcactgatcctagcccccagccgtgaagttggaaagctcagtttctgattacacggcttggttaatacgcacggcgagaactcttacacgaccagatcttacatggtcttttgtctctacaggatccgacaaggccttatcggctctgggcgtccccagccaaagttcccttaggttcctcggaggtcttgtcaagacggcgtaaagggacagtaggataggtttcaacgctaggtgtcgtcgtggtaagggatctctgggtaaaacacttggcgatattgtgtacctgctatcaactttgttgaaatagaggtagtaggagagtcgctacaccgctggtcgaggaccaggtagtagtcgtaactcgaccacttaaagtggaaatagtgggagaaacactacatcgctggtcgaggaccaggcagtagtcgtaactcgaccacttaaagtggaagtagtgggagagacgctacatcgctggtcgaggaccaggcagtagtcgtaactcgaccacttaaagtggaagtaatgggagagatgctacatcgctggtcgaggaccagacagtagttgtaactcgaccacttgaagtggaaatagtgggagaaatgctacatcgctggtcgaggaccaggcagtagtcgtgactcgaccactcaaagtagaagtagtgagagaaatgctacatcgctggtcgaggaccagacagtagtcgtaactcgaccacttaaagcaaatgtacgagagatcactacgatcaactggttgagaaccggtgagtaggtgtccctcgatcatttggagtcgtggtacgaggaccgctacgctgccggtcgaagaccagttgtagctgttcctcaaccatctgaagtcatggtgcgaggaccgctacgctgccgtagtcgtacctcgaccatctgaagttaaggtgcgagagattgctacgtattggtgcgagaaccagtgagcgagcagaattatctctcgaacactaatggaagttgcggtgcgagagattgctacgtactggtgcaagaaccagtgagcgagcagaattatctctcgaacaccaatggaagttgcggtgctagagttggtttattgcaatttgtatctcatgtggccagtatgactcacgtacccaacttatagcatatccggatgtccgttcgcaatcatgtcgagtgatcaagccaacgacgttcacgagagattatccgttaacaaccttttctcgagtagtccagccatggccggtgctatgagataggtcgtcggtctttattggtaggttgggtgcgataattccgcatttgtcgagaatgttctcgataatggagtgtactcgaccataacctactcgagtgctcaattgttcctgaaaaatattttctagaaggcaagacatatagcagagaatatcgagtatgtactcaaaaactgcgtggatcttctagtattatcaggatataacgagcagatgtaaatagcaagcattatgtaaaccgtaaacaagcatgatttatacagaagaaaatagagcgagcccccagcgttagaccgtagttggcctaacatcggaagcactcgcacaacagatattgtataaaaaatatgctctaggtaaacataataaattatagatctgacaatgatgtatgatctgaataggtatgataaattgcagataaaatattgcgtacctttgtagatacatgccggatgtatctatgaaattagtagaacaatttgaaaaaccaatctaccaattaccttattgcgtactcattcgacatcatatgatctgacatcttttggtacgccgcgtatcttgaggcttggatgatctcgatagaccgagttgtcgatgacgatgatggttccgatctggtcggaagatgtacttcagtcgggttagatcttctcacagccgaagtcgtcgagtagcttgttgttggagaatccatctcttgaacccatctcgtcgaaatactgaagcaccaaaatccccctacctggcgtgccactgtcgacgtttgatgtctcgactacggtatttggacagtatgaggatcgtcggtgctaggatatacgcgagactgaggaaaaagagatggagacagggatttttatacaggttcgggcccctgagctatcaggtaatagccctacatcctgttggccggagccgatgttgctttttattcaccataatcacaccagtacaatatgtggggtagcctatctaactgttgtcgacatggcggtctgaaggtctgactcatagtcgacaacagggtagccttcctcctcgagctcgcgcccgacggaatcagagacagtgctagatccctacggccggcctctaaaggtaccggatagggtcgatccaggcgtatctctgatgtcgatatccggcggcttgtcttggcgtatgtaggcttgtatgttgtggcttctggtgggtgttgattgtctcttcatggtgagtgtcgatcgtgttgatcgtcttatatcatgggtgtctcccatggtggttctccctagtg

SEQ ID NO: 5508 - DNA, 15013 bp, Oryza sativa
ggcccgtcacaggtatcccctcacctgtgacgggccgaaaggaaaacccgttagaggtataccagtgacgagttttttcttccaacccgtcactggtatcccctcacctgtgacgggccgatacattagaagccgtcagaggtgatgggccgccacctgtgacggctttcatttctggcccgtcacaggtgagcggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgggagggcaaggggggcgattttttgctaaaattcaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatataccagctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatggatgcaagtcgaagcacagcaagttgtcatgcgtgttggaactgatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtgggggatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtgcagtggaggacaatcaataggatttaccaggaattctcaaatgacccaagaaacatgcgtttcgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggcaacgatatcgatgtgttccttgaaccgataatcgatgacttcgaaaggctatggaatgagggcacacgaacatgggacgcatatgcacaagagtatttcaacctccatgcgatgctgttttgtaccatcaacgattatccggcccttggcaacctttctggccaaactgtgaaagggaaatgggcgtgttcggagtgtatggaggaaacaagaagcaaatggttgaagcattcacacaagacggtctacatgggtcacaggagatttctcccaaggtatcacccgtataggaatatgagaaagaatttcaatggacatagagatacagccggacccccgacagagctaacagggacagaggtgcacaacttagtgatgggaataaccaacgagtttggaaaaaagaggaaagttggaaagcgaaaagagaagagcacatcgaaggaaaaaacagaggagcatgtggaaaaacaaaagacaaaagagaggagcatgtggaaaaagaagtcaatattctggagagtaccatactggaaggatcttgaagttcgccactgcatagatttgatgcatgtcgagaagaatgtatgcgagagtttaatgggattactgcttaacccaggtactacaaaggatggtctcaacgcccgacgagatctggaagatatgggtgttcggtcggagctacatcccataagcacggaatccggcagggtttaccttcctccagcctgctacactctttcgaaagaagagaagattgatttgctaacatgtttgagtggtataaaggttccatctggttactcatcaagaatcagtaggctcgtttcactgcaagatcttaagttggttggaatgaagtcgcatgattgccacgttcttatcacacagctgttgcccgttgcaataaggaatattttgcctcctaaggtgcgacacacgatccagcggttgtgttccttcttccatgcaatcggccagaagatcattaatcccgagggactagatgaactacaggcagaacttgtgagaaccctatgtcatcttgagatgtactttcctccaactttctttgacataatggaacatcttccggtgcaccttgtgaggcaaacaaagtgctgtggtccagcattcatgacgcagatgtatccttgcgaaaggtacctggggattcttaagggttatgtacggaaccgttcacaccccgaggggagtatcatcgagagttacaccaccgaagaggccatcgaattttgtgtggactacatgtcagaaacatcttcaattggattaccacgatctcatcacgaagggaggcttgacggtgttggtactgttggaagaaagactattaggttggatcggaaggtgtacgataaaggtcatttcacggtactacagcatatgactgaggtggtgccgtacgttgacgaacaccttgcagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcctgaatggagtgccaccacctggcaaggatatgacataaatggatacacctttcacacggtaaagcaagacagcaaatgcacagtgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactatcaacttggctaacaacgcgtacaaggatgaaccgttcgttctcgccaaacaagttgttcaagtgttctacatagttgacccgtgtaacaagaaactacatgttgttcgtgaagggaaaaggagaattgttggattggacaatattgcagacgaggatgattacaaccagcacgtccacggcataggtcaagaaatacctctagaagaggaggaggaagaagatgaagttcaatatgcacgtgtcaaccatgaggaaggattatttttgtaatttatgtacgtagtttatgtctacatgtctgttatctgtatgactctaatatgttcgcaatgatcaatagtatattgcttatgaaatagtcaaataaaataattaagtgaagcacccactagaagtgaaataaaataattaagcaagtataagcattggaaataaaataattaaagtagtataataatgaagtgcaattactactgttagtgaaataaaataattaagtataaaaaaatatgtagtgtatgtgaaaatatgttaaggaaaataaaagaactaagtgaaataaaataaaataaaattgctctaggcaaactcacctgtgacggccaaagtgttgggcccgtcacaggtggtcttacctgtgacggctccacggatggcgcccgtcacaggagaggccacctgtgacggccacatagttggagcccgtcacaggtgagtttgactagggttgacctagggttggacatcttctagatcgatccagatccggcgcccactatcactcaatcactcactctctcgaccgccgcctggcatctctagacatatggggcgccctcctctccacagaggccttgacctttccaccgctgtcttcgcagccgccaaatcagacgccctgtccgccctgtccgacaccctctccaccgatgcctagacctccccaccaccgcctcgacctctccactgccgacctttatgccgctcaccctttccgccgaccttccggacgccggccagcaccaccgccgccgcactcactctctcgaccgccgccatccatctccaccgccatctccaccgtcgccgtctcgacctatccgccgccatctccgccgccctctctgccgccatctccaccctctccatcgccgcctcgccctctccgccgccgcctccaccgccgccctcgccgccggtcgtcctctccgccgtccgtccatcgacttccccgacctccccgatcctgaccttcccgacgccgggatccccgaccaccgccgactgcctcgacctcttcgccactgcctctccgccgccgccaccaggatccaggacgactacggcctgcgccgccgtctccaagtacgccgcttctccaagtatgccgccaccctcccccattcctccttttttccgatggatgaattgcattgtttagatgaatgaaatgtgatttgttgtttcgattattggtgctgctgtatagatgaattaaatgtgatttgttgtctgtggatgttttggatgaatgtaggggctagattttatatacatgattttggtgcagtgaatcttagcatcaatagaggatcttagcatgaattttgctgcagtagatgttcttttctttatggataagttattgatttatatacccttgttgtctatgaatagttgaattgttgtttatatacatgatttatatacccctgctgctgctgccacataaattattgtgggctgttttattatctacacttgccccttgctgtctatgtttgcccatgctgctgcctatggttgcaactgttagttaaaacttgaatgtgtagctagtttgcaacttggatgtggatttaagagccatttggacatataaccattcatggagtgtgtactgctatatatgttgttttgttcccttttgctagacctattgaattttgtggatcatgtttacatttagctgaaaaaggatggattgagggttattaagctagctagaaatagtttattaagcattttgtttgaaatctttgataattaaggacctttattaggtgtagggtttgaaatctagttacaagggaagaattgatagattggccgcagatttaatgtagttccgaggttatcaaaccatcacagaatacaaaatgcatggggaattttggtggataggccagtgtagtccatggacggaaccgacctagacaccaaaattctccatgcattttgttttctgtcataatttgatgattaaggaggctttgcagattatctaaacttgttgatttatataccctttttgtctatgaataggtcaattgtatgaattgttgtttatatacatgatttatatacccttgctgctgctgccacaatgattgtgggctgttttattatctagacttgcttgaattgaatggatgatatctagacatgttgaatggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttgtgcacttgctctttttttatgcataagaacagattttctgcacttgttcatttttttatctacaataatatatgcatgatttatataccactgctgtcgttgcccctgtacttcttgttaaatggtcaaggatgaattgcttaataacattctatctatacctgttcttttctttatggataagaacagattatctacacttgttgatttatatacccttgctgtctatgtgaatttccctctgctgttgctgtttatgtgaatctccccctgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttatggataagaacagatgaactacacttgttctattttctttcggttgcttttttctcctagtagctgatttcctctttttatcccttcatgcaaatgattgtaattgatgcatatttctcagcaaaactgaggccatatctttcatagtataccccgtattacattggatctaattctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggctagcggcacgtgagaacttcgggatcctccataaagatatcgggaaggtcacagaagccgagaaagagcgagcttggacggcaatggagaaatggttcacatttccagccgaagaaaaggataggctcaagtggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgttctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgtagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacataacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgatctcggggaattggtagcgatgtgccctggaagcatggactccctcagtacagctcccaatacaggaaacggaaagtctccaaggaagagagggacactcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgtagtggaccacatcgaggtaattgttgttatccgatccatttctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcatccaagtcgaccgacggagcttacacctcccaagtgtaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacaaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggtccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccccccccccgctatcagaggcgaattgtgcgcctttattcttgcagaaataatgaacaagaaaggacgttttcatgccaaatagattcatgaaattggctagataatttattgtgatgtaaaaaagatgtttttataatttctggcgatgtaaaaaattatgtttttatagagtgcaatgtaattaactttcatatgtgcaatatttatggtactttactaaattgtcatcacatttgatcaactacgatttatgttgtactattcatctgttttctcctttttttttccttattgacaggttgtgcaggtcgatgacattatggctttaatccatttggtaagtatatatgcggttctatgagcaacgaccgaaattgtggctttcaaggggtgtgaatttgctgtgcaaaattatggcatttgaactgcatatatgtgttgttggggatctgtgatgttatattgggggggtaatgtatctgtgatggatctgtcactggaatatatctgtgatgtttctatttttcagagggcatggctagcaaatcctgaggctagccaatatttagcatttattttttttttggaattaactcatcagtgacgggtcggaacaaaaatccgtcaaaggtaacataacctgtgacggactagcaaataaaggcccgtcagaggtgacctacctgtgacgggcctttacttttggggccgtcacaggtagatcacctgtgacagcttctaattacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtatgtggtatccataaccatgacatcatgaactaacggttatcaataataaagctatgaatgcctaattctcaattttacggcatctacctaaagagtttgagagcaatgtattaataggtctataaatgaatcatttaggggatttcaataacccatacttccagtgagcgaatgacgacatgtcgtcaaatcatctcaagcagcttaccgatacattgctaccaaataccaattgttgaatcttcagcaaatttgagtcccaataaaagtaggttgctacattccatatcggtgataaactgataagatttacataaaaaatatccatcgtgaataattatttcctcgcgtcctgtaattacaccctttaagttacacttgcaactaactttttttctcaatctgttcaatttgcatataaacatgtataaatatatttcaataccaacaagtatcaccgcaatcgttttgcaaagaaaaaaaaaaccaaccatcaataagagtttttctttgtgctgtgtatgcccacttgtaaatatagaggctgatgtttattcattatccaaaaaaaatcaatactaagggcctgttcactttgatgaaaaaaaactttaccaaattttggcaggatttcttatatagttaccaaaatttgacagcaaactaaatgtagccactttttttggcaactttaccaaaatttggtaaggttgaaaatggcatcaaagtgaacaggcctaagactctttttttctcttataaaaaaggacgattttgctatatatttgtcgacaaattttctcccaaaaatttagcagatgtaattacagtacaatcatagtgtaattacactgtaacttgcatgtaatacactgtaactatagtgtaacgtgtatgtaactttcaaaaatctctctgtaatatgttatttcagtaaaatggaggttgtaggaacaaatccttacacatatgtgtgtgctgtgatttttttttcttcctcaccaaaacaaatcttgtaatagatttaacgattaaaaattacgtgaaacttaaatacaagttacactgtagttatatgcaagttacagtgtaattacatataagttatagtgtacactacgattatactataattatatctgtcaaatttttaggagaaaatttatcgacaaatgtataggtggtcccaggatctacctaccatcccaagctagcaggccggacatgagcccacccaacgtgggcttgtgcctcactggctatggcccacttacgcagaacatgggcccaccctgcgaggcccaatcccttctctctctctttgcgcgatttcttcttcttcctctcgaacgaatccccttccccttccgctcgactccaactccggcgctgctccattctcggcggcgcgagctgcgaggcgtgggcggaatggaggggcatcgccgcggcgaagcggacgacgaggaggaggagctggggctgcgtctcggcctcgctagcgccggcgcttccgccgcggcggcggcggcaggcgagccgccgtcggtggggatggagttcccgacgtcggaggcggccagggagttctactgcgcctacgccgaccgcgccgggttcgccgtgcgcaccgacaagtcccgccgctcccgccgcgacgactccgtcatcatgcgccgcttcgtctgcacccgcgaggggttccaccccaccaggcacgacgacctcacggagtcggaggccgccgccgggaagaggcggcggaagcgcctcatcatccgggaggggtgcatggccatgtgcgaggtcaccaagaaggagccccccttgcgctgggtcgtcaccaagttcgtcgcccaccacgtccaccccgtctcgctcccgctctgcccccgccctcctcccgccggtgagtccgatggtctcgccggagagcacgccgcagcattggatgaacctacccaagccgccaccgaaccctcggacgaacccaccggagctcctgctgcagtgggcaatggggcgcccaatggagggccatccttctgcaataggctcgtcagagcgaatccagctggggtgcgtgccgaggtgcaagatttgctcgattacctcaggaagatgcaggccgagagcccgggattcttctacgcgatgcaggtagatagcggcaattgcgtgaccaatgtgttctgggctgatgcaaaggcaaggatggcatacaagagctttggagatgcagtgacatttgataccacatacaggaagaccaagtacatgatgccgttcgcggtgttccggggaatcaaccatcatttgcaggggatcatattcgggtgctgtctgctgatggatgagacaaagagttcatacacctggttgtttgatacatggcttgctgcaatgggtggccgccaacctgatctgctggtgacagaccagtgtaaggcgatggaagcaggaattgcgagggtgttgcccaacacccgccatcgtttctgccagcggaacattttgagcctatgtaagcagaagttgtctgctgtgtatatacagcacatcaacctgaaagctgatctgagggaatgtgtctttgaggctgagacaattgaggagtttcaggctcggtgggactatgtcatccataagtataatctcgaggagaacacttggcttcagtcgttgtatgacactcggcagcaatgggcttgggtgtatcagaagggatccttctttccagagttactcaagtcgcaaagatctgagaggctgaacaagttttttaagacgcatttcaacatgaagactccactgcttgttcttatctctaggtttgatcaagtgatggcgttgagtttcgagaaggaagctcaagcaaactttgtgacagcatattcaaagcctaccctgaaaactccttctgtaattgaaaggcaggctgcggccatctatacaagggcagtgtttgacatatttcaggaggaatttatcgaatcgctaggctatcatgctgataaaattgaggatggagttatcctcaagtacaatgtggccagtgaggaagaaaatggccggggctatatagtctctttcaaccagctggacaggaaagcagagtgtacatgttgcaagtttgagtacgctggtatattatgcaggcatgcgctaagaatcttcttcatggtcggggttcggaatctaccggaggaatacatcatgaagaggtggacaatggatgctgtgagtagtgttgtaccagacgagcgatcgttggagactggagttagctttcctgagcgcctagttgcttggtacaacgatctctctctcgacggtttgacatacggaatgagaggagccatgtcaccagaagtttacaaggttgcaaaggctgcacttcagaaagcatttgatgatgtcttggctgcgaaatatcagcaaatgagtgagcatcaggacatgcctttgccaaagtcgcaagctaaaaggacacatacaagagcatagttcagcatgatctggtacatgaaagggaaacaccagatgaccggccgtgtggaagtttgtagcatgagtagcttgattctcactaacctagcaagattagcatggtttctgcatggcagataggagagtattgtgcatcatctccagcagagtattcagagataagctggcatttgttagatgtgtacaactatcatcataggatatgctcattttgtgcttgtgcaaatggaagattgaaccccacccatcaatcttgttgactgttcttccgggcttcagttgcaccgaggcactcaattcaagaatttttttcgtttttagatttttttttatatttacagaaataatctatcgaccgaaaaaattgcagaaatagcccctgctgccctaatggtgggcggcaagctgacgtggcagacggtgggtcgaccgcgccgtctgccgccgtcggccaaaattgcgattaggcccttgccgcccatacagagggcggcaaggggctaattgcaattttggccgcccataaagagcttgcggccgtactttttcatctgg

SEQ ID NO: 5509 - DNA, 30509 bp, Oryza sativa
agatgaaaaaagtacggccaaaagattttctatgttatgttattggtaaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaacaaggagaattatgtaacatgaagaaatagtagtacaatttgaacatgatacgactatttgcattgcggttacatagatgatattagattcgaactaggagggaggtagtgcaatagttgaacacaacgacgatgtagtaatgggacaaggaagcatgacaatagaaatttcaatatgccaagttgtccgataatagctaacccctatgtgaggatccctttcctctctcaaaccgcgctttagtaaccctgtattgctctggtagttcaagctgcacaacacggctaggtggagttagaacccttctggtgtctatccattctctgtattgacatctccttggtggttccggggaggaaagaatagatgtaaagcaagcaaagttagtaaatgttgtgagaaaataaggattcatgtaatcaaaatattcttaccatgaaatcgtcgtcaagaatatttggacaaacaaagaaccttcgacccaatgttgtaggatttatggaaagaagaacctgacaacgatcaccacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtattacaaagaataaagcgattgcccatacggaatgaataagcatatgcaaataataaaatacctcatggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcattaaggcgacttatataggcgcaaaaaatcgagtgatacccctgacatgtgaacgtggtggggtatggtgggtatgcctgattggcgccgaaagatacatgcatgatcggcgccgaaagttacattggtcgtatgcgccaaatggcgggcaaatactcgtatcacacgcgaataaaggaggctgcatcggtgcggcagaaagtagtcgtgcatgcgccaaaaggtatcgtgcatgcgccgaaaggtatcgtgcacatataacaacaacgtagtcattacacaagcatacagtactggaaagtgaagcaagtaaacaaagagaagactgctctactggccctgccccgcgccgcgaccacgcttggtcctccgggcctgtgctcgcacgtggtcctgggagtaggtgaaacgatccggtggcacagcacgggtagcacgagtgtcctgcggaggagtggcctgcgcctggtcctgcgtctgcaccggcggtgcgcctcccagctgtgaggggccaatgacgtcctctgtcgagcctgaagcgaagtcgaagtcagtgatgtcgaagagcaaggtggaaggcagcaagcggtccgacgaggtcccagcatggtccagtggtggaccctgactcgacgtgccggctgcctgtgacgaagtcccggtgtactgccagaactgcgctgagtgcgaggtcgacacagctgcctgagacgctgaccctgcagcctgggaaaagtgggcggcctgcgtcatagcgaactgggcgaaacctacacatcgacacgggacccttgtaagctaagacataaaatgtatgtaaattgattgtcgaagtaatgttgtttttttaagtacctgtggggggcacaacagaaggcctagccgaggaaggcggggtgctgaacggtgcacgaaaccctgaagcaatcagcaagtgaaacggctcacttatatgtgcgaggcatgtacagaaatagtaataaaaatacttacctccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgcctaaacgttggatcgtcgttgaaccgtcaatgacgacccggttgatgtcgtcgacctgcatggttaatttgttcgtaaatattcgtaaaatttgacgaagagaaagacatgaaaacataaaggaatggtgcaatgcagggtactcacagcacgagcgaagtcctggtcgcggtgcctggcatagaggtctctagtgctcgcaacatggggctgctgctccaagggagcgaaggtgaccctagtacgggtgcgtggctggtaccagcataggtaggcctggtacgactcctcagtgtgtggctctccctcgtggtccacgacctcctcggttgcgagcaaccagtcctcaacaaaagtcgccaacttggcgggccagtcgctagctgagtgctgacccttgcgcgagtacctgcgaattaatgtgtaatattagtgtgaaacgacagatgttacaaattattgtgaacaggcagattttaatgcaacaacggaaagcgtagtgcaagatcttaccggtgaacagcagctgggacggtggtcggaaacggtactggaaagggctgacggaagccgaactgccgcatcacgcggaaaggggcgtgaggcttaacgcagatgtcgaagaccatcggaaccgtagtcatccagtacgcctggtccctggtgcagagtgtggacagacccaacggcgcacgagcctgggtagccgctgcactgtagggctcccacacgacgtcagtcggcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgacggcgtgcccgtgaccgccacagaacatcacccagccaaaaagccagagcaagtacgcctccaaacatcggctgtaggagtactcgtcggcctcctcctgtagctgctcaacctgcaagccgtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcacgctgtactagtgcgaaacgtgccgtcagatcgtcctgccagtccacagccgtggtcactggcccaacagcgtctcaagcgagcggtagccccaacaagtacgatacgtcctgtagggtaggggctacctcaccgcacggcaagtgaaaagtgtgcatctctggcctccatcgatcgaccaaagctgctaggagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcaccgcagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatgagattaattatgtacaacaagagtacaggctatttaaatatagcaaacgttactaatggtacataacgatgacgtgcaatttaacatatatgtagagttcaataatataacataacattacgtgtcgaagtccgacatacatcagcatacctaaagacgttaggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtaaggcgagctccatctgctgctgattctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattacttgcttactgaagtactgtgacacatatactgcatctggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtaccttgcactacagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcataattccatatctagcaccacctgtgtcatacgccttggcccatttctcttttggttcatgcagaatccactgagaaaatttccgaatctccaatccagtttttctaaccaatgttggactatccgttgggagaggtccaagagcttgaggagggtcagcaacggcggtcgatggagccgctgcacgctgatcactgcatttggctgtcaattcatctaatctcttccaaagctcattgaatttttttctcctggttctgattgcacagcctcttgaacttgttcatgagctctttgttcttgaattgcttgaagaaattagctcccatatgacgcatgcaccacctactctgtacatcttcccaaacaccggggtatcctcgttccatactcccaaactgcaactcttctatcgctcgcagaatgccagcgtgcctatcatgtatcaggcacacatttggcctcataccaacaacttttgttttaaccaatttcaggaaccagtaccagctgtcggtattctcactctcaacaaaagcaaatgccaaaggcaatacctgattgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgctaggatgttcaattgagggaaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcgcatacatctcagatgcaacaaatgcacaagtaatgtttctgtggtatttctgaacaccaggtagaaaacatgtatgcttggtaacaactgacactgtccaataatccttccatttccccttatacgcgtgcactctctagggacaaccatctttttccttaacacaccgaacttcatattgcgaccggttggacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaaatcctcactagcccattctgctggattaatatccgtctcatcatctgacgaatcaccttcctctacacgctcattgtcagaatcctccctctccatttcatccacaatggcaccgacagtctccccctcgtcggccactccacctggttgaatgccaactggagctactacgcccccgtcctctcgtgcgttgacctcctccacagaagtctcgtttacttcagcacttggtccctcgccatcatccatgttcatttgcacacctggatccttcgggtgaacaaacggaaccaaagctagaggccacccgcgttgcaatgcattttccaaataccatctccacactcgagagttttgaactggcattagttcccaataaaaaccctcagttgcccaacttactataacattgattgttatgtcacttgtctgtggatcaactctcaagcccttcattaaccatccttttatagaaggtacactcctctcagccgatctatcaattcccctttctgatacaataaaatctgacagatctaccccagttggcccgtaacggacgtttcctggtccatggtaaacttgaaatatttgtttgttcgacatatctgtcaacgaaataactagatcatattactctttcatgcaataaacatctacaacgtaatatcttcttgtataagccaatgcaacggtaatgtattgattccaaactagcagatctacgtagttaccgatatctacaatacgcacttctagattagtacaactaaaaccctaaaaatataatgcatttattcaaacaaatttttaaagaatacacactatttaactcaataatcacatataggatctatgaatattacctgaaattggcgtctgaatccggcagggcttcgccccttcttctcttctcctcccctctcttcttttttttcactggaattgaggagagaagaatgagggctgggggctgggcagcagcccttttataggcagcgaggcctgccgcccggccagagggcggcaaggggccgcctgcaaaatagccggccccgactggcttttttgtattcgggccccttgccgccccaccagagggcggaagggttttcctgcaaaaaaccctccctccgtcaccgcccgttcctcccccgtttgccacgtcagcttgccgccccagaggtgggcggcagggtctatttttgtaatttttttggccgatagattatttctgtaaatatttttttaaaaaaatctaaaaccgaaaaaaattcctcaattcaaccaaggcatcttcgacatctatctagtttcaccgcaagaattaattacagccattagcattttcttacatggttgatgaaccacacagatcggggtggtgattcttgtaatactggtgtcgaccagcaatcaggtaatatgatgatctcacaaaacagaacacaaaggcgcacgctcattacacgcacaaaacagagcacagaaacatacacatgggttcattactgaaacactaaaaacttgatgctttgcaagctggacatcaattagaacataacgatacaaatacagcgcaaaaacaaatacagtgagcattacagaaggtttcttttattactagcatgcaccttgtaatttaggaagattacaacaatatacagcttcctcaactgatcaaaacagatcagaattttagccgtctcatatttgtgcgtgagttgtacacataggaacataccagaaacctaaactaggtaaaaaaaaaaaaaacatagcaccaagccttctgaccataatttcccttgcaaaccaaaaacttggtttcatgttgccagtatgattaggcaatcccaattatcagcaaaacctcaaggcatattcaagttccttctcatcagcacagctgtaacccaactgatatgcgcgtgctgttcagaatcagagcacaagtcagtaattcaatgtaatgaaacaaacgacttatgcattctaaacacagcctacaatcaccgattggtacagtggcaccacacactactattggaatccaataatataaaagtacaaacaaaacggaagatgtgcatacaaaaggctatttgctctgtaggttaaatatgatacaaaggctgtgtttagttccacgccaaaattggaagtttgaagaaattggaacgatgtgatggaaaagttggaagtttgtgtgtgtaggaaagttcgatgtgacggaaaaattggaagtttgaagaaaaaagttgaaatctaaacagggccatgctgttgtgcaaggacgatttttttatattattattgaacaatgcctagtagttccaccacctttcccaacatggcctaaagttcaaatcgtgataccaaaagcctaatttcttcataatttcagatatggtggaagaagaaattttcacagtagaaaagttcaaagatattaccaaatcgtccagaacccataaatggctctgcttcatcggtcataccagcttgttgtagatcctacaaattgtgaagtagaaagggttatgaacaagtacataacctgacccccaataacacacataaaattttagcaatgttggaggaagtggttgcagatatggagaacaatatgccagtcaagataaaacaagttgacagccaaattatttgaaggatacaaaaagaaggctatgtgtaatagacttacagtatcatcatcagcatcccactcatcatcaggacacaaccacctttcaaagcagtgcccagatattgtacaaagcagcagcccactagactggtccaagacaaattcacgacaagcgtcatcgcaaactgaaaaatagaagaaaccaaccatttcacatgtatacaaatctacatttacatgcgcacatgtgactagacactgagaaaaacaaacataccatgaacacggcctgtcttctcacaaatataagcatcaccaatctgggtgtaagagcatgtattcccagaacaagaatgccccttgaccgcatcatcagtgaggcctctgctgcttttccagctagacacctgatcggctattgttttatcaagaataaccttgtcatcgttgaccttcaaaattcacaatagtcacatttaagtcttgtcaatataatacgattccatagctatgtgggaaactataatggagataagaattagtgattacttcagagggaaggggagcttgactcctttttgaagcctgcatctggatataatactccttgaattctgtaggtgtatttctcacaaactcaaccatatcctctctatcttgctggaatttacgaataatgaaaataacatcaacaaactgatgcagacaactagcagcaagcgaaaatgattgagttgcaacatgtaactgaacttctgttcagtgagtgcaacaaggtcacaaggaaaacaaatatcaacttttagtttgtacattgaactgtttgggtttattcttgaattggtactgaaattgcgtagccattcttagtttcaccataaaactgcagcactacaacatctgaactgtagcttgaaaaggtaggtttcggatggattacctggatgtagagtttcttccaagcgcactccctgagtttggtattgcatgacaggccccaccgcatacaataccttgaaattattggacatggatcaaacatgtgagtgaattctttttattacaacaaatgcaaaattggagcaaatgaagtttcaggtaaagcttacaggcggcgccagagggtctcgtcggacgcaaccacgttcatgaagcggcagacgagggcgcaggagatgagatcctccgatgagaggaacttgaatatctgcaagaacaactccggcgggatattgcagaacatgccgctatcgatctgaggcgccaccgacgccacgtccttctctttcccctttgctctcctcaccctcttgttctgctcctccccgctgccgctatccccatcagattcagactcctgcttcctcttattgttcttcgcatcatctcctaactgcttctccttctcatccccttcctcccgctgcaaccaattacccccaaatcacaaccagattcgcacaagccaatcacgcgagagatcgatcgagaacaacttacaccggtagggtcgtcgccgctagatccagagaggatctccgattcgaggaagctggcgaggccgtcgacgtcgtcctcctcctcttcctcgccgccgccgccgccgccgtcttcgccctcttctcgacctcgcagctcatcctcgagaacaaggtcatcgtccagacccgcggcgtcctcctgaccgtcggccatgctcctccgccaccgcctcgacctcgacgtcgtcgtcgccgacgagatcgccgctcctccccttaccctaatgggagagatattggtgcggttggttggaggatacgtgtcgctccagaccacgacgtcatgggccgaatctcaccgacggcccagctacctcatcctgtcggccactttacgcgatcacttcgattaattaggcccaacgcgattaggccccctatacaacccactttctttattactccattcatcatttcagaatcaaacaaattcgtattcaaatcgacgaaatttcgcaaaattaagataaaaatgtatagattcgacccgcgatgtaatacaagtattttattgtatggagtatttagcatggagtttgaatgaacagggtagtaaattgaagcgaggaaaggtgaaaaggaagccaaatttgcgatttgatgttcatagtggggagcaacttctgaatcttgcaaatgacccgagaagggaccatggccacgacttcacaggagatcgacgtcagagttagcgtgacaccacgatcaccgatttactccgattgctcctcctcgttgtcgctgtcaagatcgccatcgattggtgcgtcatccggcggcgacccggctgcggcggcggagacggagtccaacggcggcgagccctcgaagagctgccgccggagcacgtcgtggaggccgtcgaagagcctcttcttgacggaatccatggcccattcgaggcggttgaggagctcggtggagttgttgttgtacatgaagaggccattgtagaggtcgaagctgtcgctgcaggtgttgtcgacgaggcggagcagcgtctcgtaccccttggtgttgatcggagttgtttggagctccagcatggcgagtgttcgtccgacggtgtgggtgaggaactgcgtctcggcggcgtgcgcgtcgtgctcggcgcagctcatctccaccatgcggcagccctcgcgcgcgaagatgtcgaggaaggcctcggcgcgggcgcggcgcgccgggcagtcgccgacgcggaccttgtcgaacacgaaggggaggccgccccacccgtcgcccgcggactccgggccgaacatagggtgggtgcagatgatgtcgaactcctccgggagcgtgccgaggaggaggttcctggggaactccttgacggagagcacgtcggcgaagagggtgtcgcggcggaggcggtggacggggagcgagcggaggacggcctcggcggagaggatggaggtgacgaggagcaccacatccgggtggcactcgacgagatcgtgcgcgtcggtgaagtacgtcgcgccgagctcggccgccacggcggagtagtctgagcgcgagtgcgccaggacggtgtgcccctgccgcaccagcgtcctggtcaggaactgcccatagttcccaaaccccacgacggcgatcttgagacccctccgcctccgccgctcctcgtcctcctccatctcaccaacctcctcaacgccgcgaggcacatggtcgaacggttgccgtgcatcacctcccgtggcgcgggcggcacgaagccggattgaagccgccgccactcccacgcgccggagcacctggaggttggcgggagcggcgattcggcggcgggagggcgctagattcaatcggaggcgcacggaggaggaggaggaagagcacgacatcgccatctcggcgtcgaggtgagcggcgcgccaacgcggcggtgtctcgcgccgccagcctacaaatggggagagagtgaaccagtcaactcaactggtagtgttctagccttctaggtctcgcggaaatgaagcgggcctcttaaatgggccgacccataccgccgaatcggcccatcaaacgaagcccatgaaacccatctcctcggctgggaggagaatcagaatccgctttgcgagcagcgaggagggtggaatcgagttcgagcggcggcgaatcgggagcggcgagattgggggaggcggccggagatggaggaggaggtgacggggagtcgaggggggttggggggagggaagaagatggcggcgggggaggtggagctgaaggagaaggcggggacggcgtggagccactcgtacctgaaccagaagccatggcacccgctctcctacccgaaccagcggcggaagtggatcgccgagcagatccacgccaaccgcgcgcgccgccaggaggaggtgcagcgtgagttcgcgcaggagcaggagttcttccgccagaccgccctcttctccaagaaggacaaggagaaggtataatggaaccggaaccctatgtatatgctaattaccttcttagctaactatgttgctgtatatgtgtctcctaaatcatctgctttgatcatagcttaatctgcttgtgcttttgatccgatatggccattgacaagtagtgttagcaacttagcattgcttatagacattacctaaatgtttgacatgggtttctgtaggatttctttctattcattgtcatatttgctccatggatgatgataatacgtgccagtgactgtgcagccccacttttgtgccctcaaagtcaaatatatgtttgttacatgtatcagcatgggacataagtcagtaagttacagtagaaatgaggaaagatttatctgcacttggaccatggacctcaaacctatttaatactgagaaatctagttatgatgattgctagttgcatacaagaggtttatatgtttgttgcatatatcctttataggagcttttatgttaagctgtgatgaacaagtatgcttttatctaagtcttcatgcttcttttgtcacccatgaaaaattcacggttgtcgatatccaatctgtttctcaagttcagatggagataatgaaagctgtgagtttcatgtatgtccgcccacctggctacaacgcagagagtgcaaaagcagctgaaattgaagatgagaagaggaggtctggtgaaggtgatgcaacccaaagtgctgctgctgcaagcacctcttcaatgtaatgtagcatttttttccctgccgtgattcatgaattatttcacatttatcaagcttctaccaaccctattacttctgctcatatcacttctctatattttctttaactttttttttaaaaaaaaaatacaggcctgataaggaacttgacaagacccacgcaggtccagataagaaaaacaggccaaaagatgtttttggccggccattgccaacagaacaagaatttgaagtgctgaaaaatgctccaaggtactttacttccttcaccttgttttgtgttaaaatcttgaaacaatcactacatgacagtatgacatacagagtttctttttccaaacccaaacaattacccttttcactttattttcattttcacctttttccaatctcaaatgatcaaacatgacattcattttcattacatttttgtgagttatgggagtctaagtcacagggaacgtggaacttagctaagttcctcgctccggatcgaggaactggaactaggcggaacttcgttccgaaaatgggtgggttgtcgttccagtacacggtaggaacaatggaggaacttagcaggatgatatgagggaggaacgagctacgatgagcaaaatatgggaaaggcaatccaaaatttccgaacagaattcatcgctccatgggacgaccgctgcttttgctctttgcagctcgctgccatcgcgcctaggtgcatatatgagcgtgcgctgcactgctgccgccatcgtgaaggggaggatggagaaattgaggcgcgctgcgtgtcgcacccgcttttctcctccatcgctgtccgcggcagcgcagtgccaagccatcgcgctgatcttgccgtcgcttcgagccatctgccatcgcgctatcgactttgtatgaaaaaagaagagcacaatccagggagtcaaactaggaacaccgaacatgttccttaaattgggtacaccgttccggattatcgttccggaaaaactaggaacatgttccatctatcgttccatagttttagaagaggtatacccctcttgttccatcttttttaaagatgacgtcccacgttcctcgatccatcgatctgggaacttttgtgacttagatgggagtaggcttagagcatcattgtgctgccttgagataactcttaagtagcattttatgatttaatatgtttttgttgtactctcaggttggagacaggtgctcctgcgagggttaaaccatttggagttgaagttcgtaacgttagatgtttaaggtgtggaaactatggtcatcagagtggtgaccgagaatgcccactgaagggatgtgatcatgcctaacgaaggagagccgactgaaaagggatgatcctcttacagctataatggcacagactgattcaagtgaggttaggttttttttgtcaaaatgttttccctgttgcaatttacattcaaataagcttcctgtaacaagacttgcaagtagtagatctctgtcaaccatttgtattgcttgtctcccttttaataactgcatataatttgattgctgatagcaacttatctacagttgcttttttttcctgaagcttgggtaattaatatctgaagatagctcttgaaattgtcatcaagtggaatactatggatagagtactgaatattgaatcagcagttttaaagatatatatttctttatttgagcgtgtcaacaattaagatgcacatttttgccattgccaccttttctcactgtacttcggttaaacttcaaaatgttttaacacaaggaattctttgccagcctttgaagtgggaacttaggcaaaagccaggcatgagccctccacgtggtggatacaacccagatgatcctaatcagcagattgtagccgaggacatctttgatgaatatggaggtagatcatgtagaatatggatagcatgcagctgtgcattgacaaactttcatcatatttctgagtttaatttatggctagtatattggctgattatactggtttcttatatttcaggatttcttggtggatgtgatattccagctcttctttccaacttttctgctagcaaatcaaagaaacgctccaagagtaaaagcaagcataggcaggctgagcctgctgctcatgaggaatcttcacactctgaagctgagaagagcaacaggacatcaaggagcaagagaaagaaagaatattgttctgattcgtcattttctggtgctgaggtggaagctagaaaaagcaagcaaaaatcaaagcacaagaagaaacacctgccagagtctttgtctgattcaaaagttgaagttggtagagatacaagaagacatcaaaagagagagcataggaagaagaaaagaaatatcactgagtcagagtcttcatctgattcagaagttgatatagatacaaggaaacatccgaagagggagcacaggaagaagaaaagagatgtcactgagtcatattcttcatctgattcagaagttgaagttgatagagatacaaggaggcatccgaagagagagcataggaaggagaaaagaaatatgactgaaaatgggcattcaagccgatcgagggagaagcaccactacagtgacactagtacttcggacaatgagaagcactcaatgggacataaggatgagcaatactacagcgattcaagttcttctaggagcaatcggcattcaagaaggtcaagggaaaagaggtactacagtgactcaagttctcctgagcacaataggcattcagggagatcaaaggagaagagggcctatactgacttgagcacgcatgacagggataggcattcaaagagatcgagggataagcgggagtacactgaatcaaggccttatgagagcaataagcattcaaggacattgaaggtgaactggcactactctgattcaagtgcttctgattattcaaactccgaacggcactatagtcatcgccatcgtagaagaaaatgagcagtgttgtataatctgcatgatgtctccacagaagatcgctctgccgtttatatgatgtcattagctacatatgcttggtcattttcttaaggccaccagggtccacgggttgctggtgtttggtgactgcagctgctaatcgacttgtgatgcgatagtaatgtatgtgactgaattttgtcttctgtagaagaattgttgtgccttttgttgtaggcttgtacccgagggacttttattaatttaaaaaatatcttgtttggcatcatggtatcttttgaattcactgaataaaggccctcatttgtaatggaggtccttacgaatttgttgctcttttatgcctggataaatataatgctcaactgagcatgatttgtaatggaggtccttacgaatttgttactcttttatgcctagtatctgtaccaattaccaaatagacatatccaagacattgagtttcaggtttttgccctttttttgctaacatcgttgatgttttccaagagctaaaagagcctttcagcaaaataaattcaactctgtgtttcattttccaaaattgcagtcgactgaaaaacaaaaaagaaactctgcaatttgacaactgtcaaatgaaacgctaagcgaacatggacaccacttcacctcaaagctgaacaaggcttattcctgttaggaaaaaaaagaacttattcttccaccaacgtccattgaaaaagttatcaacttgctcaaatcaagtcaacaagtaagctcaaatcaccttgctttcccctgcaaacagtgtttaaaatgctcaaccgaatagttctccaaccgctgacctgttgctctcttgtagcttagtctctattaatctggctatcaccactgacctgctgctctcttgcattagtttactctctctttaatctggctatcagcattagagtactgactcctactactactctactactagttagcagccatgatccatcccaacgaataacaccgttctgtcctccagttgatcaatttactaatcacctcatcagttagcccacaaaattaattaattgactgactaatcaccatcatttagctcacttaattactagtaattgggatttaggatttcccccaaagcccacaactccagagcaaggtaggcagcaaagtgagccaagcccaacccccgaagcatccaacgcgagaggcggcgagatgctgtcgtcttccacctccacccactgcctccaccagccgccgccgccgccggcgagccaccaattccggtcggccgccgcgttccgccgccctccgtctccggcggcggcgcccctccgcgcgcggccgcagcgcgggggcggcaccaccatccgcgccatcgacgcagcccagccgttcgactacgagtcccgcgcggcggggctcctggaggagcggcagcggctcaagatcgccatcgtcgggttcggcaacttcggccagttcctcgcccgcaccttcgcgcggcagggccacacgctgctcgcccactcccgctccgactactcctccctcgccgcatccgtcggcgcgtcctacttccaggacccgcacgacctctgcgagtgccacccggatgtggtgctcctcgccacctccatcctctccgccgaggccgtcctccgctcgctccccgtccaccgcctccgccgcaacaccctcttcgtcgacgtgctctccgtcaaggagttccccaggaacctcctcctcggctcgctcccgccggacttcgacgtcatctgcacccaccccatgttcggcccggagtcggcgcgcgacggctgggacggcctccccttcgtgttcgacaaggtccgcgtcggcgactgccccgcgcgccgcgcccgcgccgaggccttcctcaacatcttcgagcgggaggggtgccgcatggtggagatgacctgcgccgagcacgacgcgcacgccgccgagacgcagttcctcacccacaccgtcggccggatgctcgccatgctggagctccggtccacgccgatcaacaccaaggggtacgagacgctgctccgcctcgtcgacaacacctgcagcgacagcttcgacctctacaatggcctcttcatgtacaacaagaactccaccgagctgctcaatcgcctcgaatgggccatggattccgtcaagaagaagctcttcgatggcctccacgacgtgctccggaagcagctcttcgagggctcgccgcacgctcccaacaacacccccgtcaggaagtagccgcatcatcgtcttcctcctccgcgctccaagccaccatggctccatatggtactgtatcatgaaatgctctgttactcaacttaagttcttgatgctcatacttgcattgcaatgtgcaaatctgcatctgtattattctttacagggttctttgaaccctttgttccttgccttgttagttgtgcttcattccaagtaatttcctcttgggaagaaaaagatatcttggaattatgattatatgaggatgaagaaataaactttggcattgtcatgaagattaactcgtcatcatacaaaaaaaaaaagaacattgaggaataagcttggcattgtgatttgtgatacaagaaagtttttcaggagcaaattaacttggcttgtgtgttagtaactcaggatcttgaagtagagtaagagtcaaacccaaatcaccttggcttttgaactttgggagtccttgtcgtcccaagtatggcagagagtgttagttgtgagagcgaccttgtttctttgcgacgaggttaggtgtggccatcttctcttcaaccgtgctgttcatccggttggtatgcagctttcttgacagcggtattagaggcacttagcaaagggattccaaatctgtgtgctctaattatttgtcatggaaaaccacatgttttacattagcatgctttgaattgagcctcccatggtgacatctgtaagtcgcatgaagattttgcaaatcaatcagtggatctgtgttggtgagtacttgccactcggggtttactgttctactggggccctgcactgcttcagacattctatggataaactcctggtagctccaattgtttcttaacaaaaatatttgtgcctttcagtctgatgacaggaaaaaaaacaattcagaattgtctcatgcgagttcccaatgaatttccaaggacttcattttcgttgttgaattcgcctgattagcgaagcacatctgaattccagtttcttcagctcttatgttttactgaccaaaggggcagaggcctgcaatataaaaagaaattgttagtgcttaatcgacctgtgagcatgtgatagaaggaagaggtcaggttaacacaccaacactgatgaccacctaaccattatttagatcatgagtcgttttcgtcagtcccaaatttttctctgctttgtggtggtggtgacagctctgcgtcaggcccaggttttattatatatgctccactatggaaggatgggttcatggcatattgatgttgtgccacgtctctgaagtctgaacggctgtttctttgcttgttgtggagaacttttgctgcgttgctgcttctgctgcatttccgttttttttttttatctggggtccggatcaacctattgacactgacttaactgcggctcctgcattgacacaattacacacgtaatgtacctgcagagtggtaggtaaggattagggaattgcaaatcactcgttggatgattggatatttggatttggagccctgatgatcagagctatcctgtgatgaaccattttttcagagtctcaccaattggtttgctggtattcagagattcagaaaatgtcatatttataactcttgtttgaaggcagcagtttcactggaatcatggtggttcatccatgatgttcaatcgaatcaaactgagatcgaggtatgctagctagctactccatttgttgccaactgtgtttcatggttgggccttgagatatgctgcctgagatttggagccttgttgattagagcttaccaagttcagagtcccaacaggtttgctggtattcagagacgttcagaaatattttgtctaccacgagtttgttcagagttcaggcagtaatttcactggaatcatggtggtatggtggttgaatcatatgttctaaggccttcttccgaatctaggatttttggaataattttacgggaattaaactgattcatatgaaaatcctgtaaaattcacgcgtttagctcatgatggagcttgctcagggctgggccttgacattcgctgacatttgagttgggccaagtgttcctcaatcccggaggcccagcccgccgctccttccctgcgagcttcaggccgtctgaattatgtgggccgtcattttctcttcttgactttcggagggccttgacattcgcaagctgccggaaaggctttccccggaactgacttcggttagtccgggtgggtaaaaggatacacgcataacatgcgtttaggtcccgattaagtcggcccgtttgacaaagagatgagaggaggattgagagtttagaggcaattcggatcctctgcagtgatgaagagtcagcagagggagttacaaatagggtttcccaaaccgccagggccggggttaccgtgccccggtgataagcacggttaccgcgcggtaaccgcggtaaccgtgaaaaatcgtacgaaatcgtgtaaaatttttaaaaattcaaattattttttaaatttatttgaatttaaggaggttaccgtggtttttctattaccgtaccccgcggtaaggccataaccacggtaaccgcgcggttacggacggtaagtcgaaccctgcttacaatgcagtgcattatggtatgctgttttttttgttggatcgtccaaaacaaagtgctacagcagcttaatgtgaacactaatcatttaaataataaaagaattactgtttatacagtacttgcatacaatatttgatcactgtttgagtgtttgatgtactgctttactgtggcagactcacaaacttctctactacactgtagacgacatggatccgttgagaggagagagttagtgaaaggattgatcatgcgagttttattttactcctaatcttttgtttggtggtagaaataagaatcataaggattatagatgagaattgaattttaagtgatgatgtacgacacatatttatcttgctgtacttagaagagagttccatttcaattacttactcttaccaagattttgaagaggtggaagttcgcttactctccttctcaattccttctaaaactctcacattctctgattaaataatagacttaacagttcccactttttaaactcttattcctcctaataattttccccagccactacggagtgataatatgtgtttcttatactccaccggtgtgtgcgtgtgatgtgatgtaaatatggagtgagtttatgtgtgtccccttaaaagaatattggactttcctatgtttgacgtggtatgcttatacaccatatttttcttgctgaacttcaaagctaaagaggcgtgtcaaataccacaccctaatattacatgaataatagtactacgtaatacattaatacaccccctatatattcttttagataaattggtacgattgacttcaccccgcaaatcttgactactgtttatctttactaataatttcataaaataacttataaggctgtgtttagtttacatcaaaattaaaagtttgattgaaattggaacgatgtgacggaaaagttggaagtttatgtgtgtaggaaagtttcgatgtgatggaaaagttggaagtttgaagaattattttggaactaaacacggcgtaagtaaagtaaattgcatactccacgaatgtgaccatacggcctcttcatcccagcccaggaatgtaactgtaaacatagtattagcgatcaaccattaaacagaatcactcacatcagacatgacacaaaaatgttcaatacacagctgtacagatttctctccacgaccaataataataaacactgaatccctacctccccggcgtgtgtttggtcgtcggtgtccatcgcaatcgctacagttcatggcatatgatacggatctgaacactgttcattcaaaaaatgatttaaactccatcacccaaaaagaaaataaaaagatttgaacagttagctggcagcgaagaaacggaatctgcagtgcaggtgcaggacataatgctagcatctgattatcacatcatattacagcgtggtcaccgctctctacctttatatcttggctgatcaatcaatcaatcgttctcttctcgtcgcggtcactgccgctgccgctctcgattcattaaggctgtgtttagttataaattttttcttcaaacttttaaatttttcaccacatcaaaacttttatatacacatgaactttcaacttttccatcacatcgttccaacttcaaccaaacttttaattttggtgtgaactaaacacaccctaaccgtctgatgagtggtacgagtcacaaggcgaaagggacgatacatcagggagataaacacggcgaaatgtaggtgctctcaaccagccacgcacgcggcacgcctcatctcagcattcacgcgctctatcctctaggttcacaatcccgacagtgattaaaatcggctcaggggtggtatcatcggatttcacgaaatccattgataaaactgatgaaatccaaataaatttttatcaaaaattgaaaattcagtttgatctttttaactttattgaaaaacagagtggtttacccaatcaaaaagaacatattttatataatgtagggtaattttaccatgtttggaaaggtatcacatgtttcagtgtaaaatttaatactatcttaatgtataaaaaaaattaatgtaaaatttaacctgctgtcctctcacccgcccgccaccaagttacgatctgtgttgatttgggtgttttttttcttttttttttttttttgaaatgaaagaagaagggccaccaccaccagggaagttgtgttctggataagaaggaaatgttcaactatctcactcacatgttcctccatggcaataactgtgaatgaaaatgatcaaaaaaaatattcaaaatgtttatgcaatcgttttttctctcttggaaacggaatcagagacccgaaaaataaaaatgataccgtacaactcgaacataaaaaaataaatcacaaacgaaactaccatagagtctgagaacaccttgcgttaatgagttataatcatgtgttacatcgtttcttttttgaaataatggataaaatccgatatctataagtattttaggttactcatatggttttataattagcctatgccaattactttcttcgtctcaaaagataaacagatttgaaatgaatatgacactctttagacagaaaactataaagtgttccattcacctaaaatattttatattttgggacgaaaagattatagggtagtctctttactaactgaaaaaagcagtgaattgccaggggagtactgtagatacgataagcagtggcgcacccaccctgtgtatggtgagatttttcttttcctcaatcgagaatcttacaaaatctggtcgagaaaaaaccagtcacgatatgtcgatatccaggtgacaaccttctcctgaaaaatgacatattgatacttacggcctcataatttgcaaacgaaaaataatttataaataaaacttttatatacgtgttgttagcgatctgaaagtaaagggtgaaaaataaacttcgatgaaaaacccataaaattaactctaaatttaagattaaaatttcaaacttaaactaataaaaattttctaaaaaaatagctaataaacataagtataagaaaaaaaataagaccattactccagccatatgattagtgctccgtattacttagaatcaagccgtacacaagattaatacataatccctctatcctaatataaaaatatctcagtatagatgtagacatatcgatataacgtattctataactatgaattacatagtgggagtacaagcaacgctgatgacttttctcccggtttcatattttcttttagaaaaaaaatgaaaaaaatgcatgacttcttcccggccttttagcgtgcgtggcgctcaacacattttctactaatatataacttgccacgcaagcgaaaactcagacgcatcaatcaacaaaataaataaataaataaacaaacggatcaaaagcagcagcagtagtcagtagacgccttccaagacaagctcaagcaaaagcaagagacaccaaccggcggcgaggaggcaggaatcgcggcggcggggtcgccggagatggggagggaacggggtggcggcgaggggatgacgatgctgcagcggtggtcgtcgtcggtgtggagcgtgagcgggagcgggcggctgctgtgggcggacaaggcgtggcgcgcgcacgccgccatggcgttcacccagctcgcctacggcggctaccacgtcctcaccaagtccgtcctcaacgtcggcatgaaccagatcgtcttctgcgtctaccgcgacctcgtcgccctcgccctcctcgcccccgccgccttcttccgcgagcgccgcacccgccgccccctcacccctcacctcctcgcctccttcgctctcctcggcttcaccgggtattcatcgattcctcctcttcttcttcttctccttctgctcatcttatcgatcgatctcttcttctccaggatcttcgggaaccagctcctgttcctgctgggcctcagcttcaccaacgcctcctacgccgcagccttccagccagccataccggtgttcacattcctcctagccgcaatcgtcgggtaaaattggttcatgatttggaaaattatctactcctgatgttgcattggcttcaaatttcaactgaattgagtgaaattacgcgtgttgcagtgttgaggtgatcaatatcttcaccaaggacggcatcgtcaaggttcttggcacggctgtgtgcgtctccggagccgtgctgatggtgttctatagaggtccatccttgattggcatgggaggaggaggaggaggaggctccaatggtgtgggtgagaatgtcctggccggcacatggagcagcaattcttacacgccccaatggttgacatcggccatgctccaatacggtctagaaacatggaatcttggtgtcatctgcctcattgggaactgcttcctgatgggcgcttatctggtcatacaggtgatgcaaactttggaacatcttatccttggtgaagattaatatctatatgttgataaaatgtctttatttttgttggaaaaagaatgtctattgacagggttgctttcttatgtgcaggctccagtgctgataaaatatcccgcgagcttatccttaacagcttactcttattcatttgccactgtattcatggtgctgacaggggtagttacaaccaatgggctccatgaatgggcattgacaacgaccgagatcattgctattctatatgctgtaagcatgtttatattcccttgggcttatattacatagacttgtgtatgaccaatgcaatgctaatgtttatgatcctcctctagcatgttctaactgaatttattggtttgcttcaccagggaattgttgcatcttgcttgaattacgcaatcatgacttggtcaaacaaaatccttggtccttctctggttgccctctacaatccactccaaccagcatgttctaccatcctgtcaactatatttcttggtaccccaatatatcttggaaggtataacggaaaattctggcatgtaataatgcgaaatgtgttctttgaactttgccatttgacggtttctgaaatttgggattcattcaactgtagtcgctctgcattgcgttcattagttgcttctgatactcgttccagacaatagtcgctcttcattgtgtttattaattgtttctgatactctccagacaaataatcttcatattggtgttaataccggtgaaaatatgataaaaactgttttttttacagataacattgccaatatcgctttgttcatttcactcccatactattttagaaaaactcctttttggtcctctaaactatagaatttcaagaaacttcaaagtatacataatgtcataatcacgtgttgtatgtttccattctacttttcagcattattggaggagtctttatcattgctggtctataccttgttacctgggcccgttacaatgaggcgcaaagggtactggcaattggatatttagaccctcttcttgtggaggatgaggatccaccaactcccaagacacaggaaagttctttcactggctccattgatccttaaatgagctgtcctgaacagtagctgcagaattacttcacgtataaatacagttctcgcctatactcctacgtcaagatttccatcacttttagaatttgtagttggtttatgttccatctccatcatcaggaatatcagaatactgagctctatgctgaaaataagtttgaacaatagccattgttttgagctcatatcaaggagccattttttcatcaatggaggtgccattggctaacaatggtcagtgatcctccagcttcaacagttgtttttacagcccactggtggtcaccagtaggaacagcttcagtgattaaaggtagaccttaaatagcttgttacttactgattctacttatcgcataatagatcgtatgtatattgttaccatctgatgttccatttgtaatattgaaaagttatgcacctaaagctacccaaagatttaattcatatttgtaccacacttaattaacaaaagaactggaaacgtgtttttttttgttattttggtgcagagatttttccaaaatgactgatcttaggcttggttttgtgtttctcttcagcaggttgttctctaggcctgggaactcaatctgaaacagagttgagttattgattacttgcggcaagacagctgttcttctctgatgatgggacccaatgtattctttgctttgttcaagtttatgtcttgagagcacaatagtttctgtccaaggaaaagagagaattccaggattgtgctttcgttgtgtctgtctagtaatgattccgttgcttcatttgttttatatatgtgatgtaaattgtcagtacacactgttacttttttgtattacctagtgtaaagtatataaaggaaaacactgtatgcaaaatccttactgtctagtgcatattcttgttctgcaacaacctggtctcacggcgtagtttatataaaacactctgattgcacaatgaatttctggcatctcgatttcagtaaactatactgttcaaaaccttcaagggatgcagcactacatcatatcatctggttctgatcaaatccaaataatctggacaaaatttaccagagtttcatgattttcatctaatgccaaattgccagagcagaagttcgagtagtcaaaattttccacataaaaacttcatcagagcttcatgactttcatctaaggactgcctgattccatgtcatacaaagaaaagtgaaaggcctctcccatgcttgaagcaccataatatgcctcccccatgcttcaagcaccataatatcacatcattgcaatgcctccccagtgggcactgcactaactaaagtccatgagctttagaaaggcatctcactgctataaattagtgcaaaacatcactttatggtgttaagcctcaatggtagtttagtttaggtaccaatcaaatagacaaaacttgttttttttttgacaagttagaagcctggaatgccttgtatctgcacaccgctgcattggtaaatccatgctcagatgactaaatgacaaccacaatgaactacctacgaatagtggaaatcacatgaaacaaatgatgcaacttctcactgtgaagggcttggcatagagccatctgcatgtttaacagatcatatcggagattaaggagttcactagtcctaacattaggaaaactgtgaaatttgacagagaaaactgaaccgtgtgaggtgtgcatctaaaattcagaactgaaagaagtgttctttttaacactgtaccacgatttcatcaacccgcaactaactcccttatacagggcaacaggcccatttttcatcagttccatgttgcaattacctctaattgtgaagaggcagttgtttttcaggcgcataactatgaaataaaaaaaacatatgttttctaaacaggtagaatctcctaattactgtgcttccaatgctaaaagcagatcagtcatgggttcagcgcagaataacatgccccacatgatacctatgatcaccaagttaaaaaagatgccgcttgacaccgcaaagataataatcagctaatcacaattgcaaatttccaattcatccttgctacgaaacggaagtgagtgagcaaacggatttagccatcacctttttctttactcagatttagcaattgtttgagcagtgacagacataaacattatcatccattgacaccattgacagcatcatagagtagtgacacataaactaaacatcatagctaaaacatgccgacgaagacgcgacggaacacggtcacatatgtatatgtgcgcgaatcaacgcatctatcacacggcacatcatgacacagtagtaataattcaaaacagcaagcagcagcaagtaagcacaccggagcgagcggcggcgggcggtagtagtagcagattcgggtgatgatggattcgattgcggttacttcttgaggctgccgcggacgccgggcttgggcttggaggaggaggcggcggcctcaccggcggcggc

SEQ ID NO: 5510 - DNA, 39826 bp, Oryza sativa
  unsure (1)..(39826): unsure at all n locations
cgcccctgttcgtcgtcgccgcgtcgatcttcgccgcgatctccttcgccgtgtgcttcttcggcttcgccttccccgtcatctccgcgcccccccgccgccgccgccgcggttgccccctcctgtctctctccgctctcgccgccgccgccgccgccgccgattctcgctaaccctatttgtgtttgatgggtcgggaggctgactgactcggccgccaattattaggctcgttggagcagcacacggctttcctccagctgctatccaccgtccgatctgagattcgcggcccagatgcgtctctggcacggattccccccggatgcggtgctatccaccgtccgatctgagattcgcggtccagatgcgtgtctgacacggctttcccctggatgctgtgctatccaccgcccgatcggagattcgcggtctagatgcggtctgtgggtgtgtctggttctaactcccaggactctctccttgtcctcttttggcacacggaatcacgctgttttgaggattactccagtttgcatcggccttaattctctctctaattacctcggtttcatgtgtcagtgagaatctatgaaacatacagattttatttatctacccgaggtggttggtttgtgtaaattaatccactcaaatctaatcgatcgtgatctaggttttttttttttagtctgttgcagttcaatgaatctagaatatcttcgtctgaactagacgcagatcaagcgctcaacagtaagcaagtcacttcaaagtataattcgacttagaacaagaagacgacttaagtaaagtttcgacctttttatgctagttcactccaaatcgcccacaactaagaggcgatataagcacgctgttatagtctaacagaaatttactccaaccagattcggggtagaagcatagcaaaacagagcagctaataacagttctacaacgagaagcagtagcagtagcttcagtgaaacatcatttcagctcattacatcggcagttcgccgctgtccgcgatgacaactttgctcttcggtgacccactctgctggccctcagcttcaatcttgtaaaccacatccattccagacagcaccttaccgaacacgacgtgcttcccgtccaacctaatcaaataaatagtttcaacagattgaagtgtcttcagtacaaattagaaatagtgctgctatgattacaaaggctagtgaggaaacgacgattaccagctggtggttacagtggtgatgaaaaactgggacccgtttgtgtctctcccagcattggccatggacaggaggcctgcataaacatgagatcaaatcaaacaaggatgatttgatggtctaccacacaaataatgcgtctatagtgtagtaaaaaaatggttcaggaaataacgaaaattacctggtccggtgtgcttgatcttgaagttttcatcggcgaacttcgtcccatagatagattcaccaccccttccatcaccaagtgtgaagtcacctccttggatcataaagctgggtataattctgtggaatgcacttcccttgaagtggagtgctttgccactctttccagttcctttctctcctgtataacaacaaagttgaaagcgctacatcaaacccaaacttagattacgtataataaccacaagtaggcatcagggaatgctaccacacagattgtagtgctattcgctgtccagaatgggatctctctcattatatgaagtaaatacttttatgggttttcataatattctacacttgcgtatgaataatgacaacagctgagctgatgtatttttgcatcaatttttaactagtcaactgtaacagtatatttgattggccaaacttgataatgacacaaaagttgtgcattcaaaaataatttcaggttaaagtggcaaagaaagtgttattcaatgctggaaattctacatgctgccactaccaagcttgccatgggattaaccatctggaaactctagcagaagatgaatgaacacatctaatgtaataaaaacagtataaatcatcagggagcatacctgtgcaaagtgctcggaagttctctgtaggaaaaaaaaaagatatagtgaatcattagcatttgtgatatgacaatgaatttcctgttacctaactaaatgataagcaaatggtacctgccgttttaggaacagtcttcccgaaaagtcccatgacaacccgtcctatggcaatacaagaaaaaataataaatgtcagtaaggcaatcattaacaggaaagacattataaatagtacatacacaaatatcacatcaacgtttctccttaaacataaacaacaatagaagaagctaaattctcatcataatagagttagcttcaggtcaatctcaaatgctgataactctaactgtaataatcactgcatatgacatcagcccatcacaagtcacttatacacaacggtgggacacaattaatgcaaattaaattgttactgctccgtatttgctaatgctagacacatcaaactatgcatatcttttcttctttctgcctgaagacttatatattatgctgatatggtagtagagctaaacatagggggccaacacaaacctgcgggcttgccatcaatctcgacgtcgaagtagaccttgtgggtgacctcagtcaaatccgccttcgatttcttcgcctaaacagcaacaaaaaaaaaaaggtgagtacgcatagatgcacatagaggcaccactcaaaattctaacaaatcagcacaccagggccaattggatccacagatcaaacagatcaagaaatcagcgcacgagcacaaacaatcgaatcagatcggagagcacacgcatcacatcacacgcagatacggggaagcaggaggaggagcgaggcgtggtggagagtggagacggacgaggtggatgagcacctgggcgagcgccagggtggcggcgacgagcacgatccagaggcagaccgaggccgggcgcgacatgggcggcctcctcaccgccgggatcctcctccacccgctccccgccatctcggatctcctccgcctctctctcgctcgccgccgggcaggaatgaaggatcgaggatgggatggatggatagatctgttgctccacactgcggtctccgcactctgcccaagagtccacgaagaaatagtagccaagagggtgaaagcgatgcgctgcctgacaggtgggccctacatgtcagtgtcgggttctgtctcaagcaaagatcttcgtgtttaactccacattaatcacactcattgaggtgctttttttttttgtaactttcgattgcgggttgttttgtgtaaatgagggagtggtgatgcagataaatcgatcaagagagcataaaaattttagattctatcgagttgttcttttcaacttaggcttagtttgaaagttagtttgggtgttatttactgtgagcatagtttagctttctaaactgttaaaggtttatttttttccaaatactttttgtttagaagtttatttaaaaaacaaataatttttaaataattaatacttaattagtctagtcttattttacgtgccattaaaaatccaaacttcacaatcaaactaaaccttattctaattatagaaacggattatttgctcaacgctttaaattttttttataaaaagaattttcttgtacaaggcttaaaaatgcgtgttttaaactatttattaagtttatttttataaattatttaatttatagtcataatcaaattgataattcatggaataatccgctcaataatctaaatcaaagaggaatatgacattgtgttcgcatgtatataagcttgcattgcatatccaatctgaattgccatgggaaaatattgagagaacactctcattttacaacaattacacaaagcaggtcacattataatcagcagaaacaggctccaaacaatgcatggcactaatgacgtgcacacatactccaatgataggaattcacggtaagtaagtacagctcgttattaagcttctgttaatggaagatcacttcagttcgccgctgtctgatatgaggactttggaccgtggagtaccactctgactgccttcagcttcaatcttgtagacgacgtccattccagaaagcaccttgccaaacacaacatgcttcccatccaacctgcagtagcaaacaacacaaaaagagtaggtcatgatcaaaattacaatttgatcggaagatttctagcaaacaaaaagaaaatttgcacgaaaactaattctcagctctcaggagctgatgaagtttaccgggttagctttacggtggtgatgaagaactgggatccgtttgtatctttcgcatagttggccatggacagcaaccctgaaccaatgaccagccagcaaatcaaacatgaggacttgctgctcaaaagaatgaaatttctgtgcagtaatatagtagtatacaactgggatatcaagaaaagcagttcacctggtgcagagtggttgatcttgaagttctcatcagggaacattccaccatagatcgaatcacagccggttccattgccgctcacggtgtcgcctccttggatcatgaagcctgggatgatcctgtggaatggcgttcctttgtaggagagaggtttgccactcttgccaagtcctttctcacctgtataaatgtgaagttgagattgctacatgaaactatagtagccaagagatgcacttgatagtgcagtggcaaggggtgtgtggtttcaatcctgatatcccgtgttcaatcgccaacacgcttgcaattttttctttaaaaaaaatgtttggagggacatctctctctccaaatctcgtgaactatagtagccaaatcaactggagtacatgacttggggcatgctcagtaagtaccaacaggccccagagtgataaaggaaataacttatgtaacaccgaatatgccaataagtattaaccctatagtataacataaaaaggatgcgagcaatatgccttttcatttgacacttttagagaagaaaactaaaaggacatatagcctttcacgtttgggaattgggatagctgaccaaattgtataatttcaaataatttgtatgaaatcggtagcattacattgaagaaatgtagtatgacggttgggaagaaatacctgtgcaaattgctcggaagttctctgcaaagagcagatgcagagaccattaccaatttgtgtctcagacaaaaacaattaagttgaaaacaataagtaattaggttgatgttatacctgctgttttaggaacagtgtttccaaaaagccccatgacaatccgacctataacaaccaagtagaaacaatctaaacgtcaatgagcatatcatcaatcaaacacgcattattttagataatggaagatttcattaaacaatgaacaatcttcaacatacataaatggcattattaccagagaagcaggcaataacaaaattttggtgaactcaagaaatcagggagtcaggatgcacaaacctgccggcttgccattgattgtgatgtcgaagaagaccttggtggtgaccttggtcaattcggcttctgattctaccgcctgaaaagagaaaacagagagagcaaaagttctaaaacaaatagaaaatcgaacacattggagaagagtgacgtacgagtaatcagatcagatcagggagagtggcaaactaatgatagggtggcaactaagaattgaaggggaaaaatccgggcaatgtgaatgatataaacagaatgagcaagcatcatcaatcgagtacctgggcgagagagagggtggcggcgacgagcgcgagccacaggcagagcgacgcgtggcgcgacgtctccctcgccgccatctcggatctcctcccgattcctcctcctcctcgtcgacggcgagcctgagaatttccgcgctaatgcatgcagcctccgcagcgcagcaacctcctaataaataaaaaagagtagagatcatgcgctggctgacaggtggggccggagcgaacggtcggccccgcctatcagccagcgggttggttaccatatttgcagttagttacaaactgcctggtaggctgacagttttgacttagcacaggctaaaacagcttgggattttacgatgggcatcagaggttgtaaatcacttggccaccaatcattagtgcagttaagatagtactcccttctttttaaattgattatcatataataaaaactaaaattaatttttcaaattgatcacatgtataaggattttattagagcacaattaatacatcatgtaagaatgtgtgcatgctaaaggcagagtggaattgtgcattgtgttttaaccaactcatgcattaggagagaatgtgtgcatattatacatgacgtcttgatcgatgtgatttaaattattcttgttcttggtgcacaaacattatagcagacattattggatgctcaatgtaggatgaagggagtaacaattaccgaatggctcatgcgcatacacaaaacagacaaccttcataggactctaaatagaataacaaatgtgttactaacatgcgagtaattaagggccccgtctggaaacgagcatgttgaattccagtacaaatccatgtcaagccccaatagttttgatttgcattgcacctgactcaataggttcattactcgtccacacaagagccgcacagcacaagaactataaatgaacgagtcattgcacagaagaatctgatatacaacacaaatggtcatcaaccgatgcaaagtctctttaagctcctctcgactagcgaatggaggtgtacatccactgtcagtagctggtaccaaaaaaccaccatgccagcatgttgcctcaagagcaacacagggatctgcaatccaggtctcagtctttagacgtactggctcccgggcctttctttccaccatatttctgcattggaattaatgtagttcagtaagctaatatattgtacatttaaaaaattgtatagtgcaactccttcaggaaaaaggaaaatgtgtagcgcaacaagtcagtgatctaaattggttagcgatgtcttctcatggtgacacacctactgtcatcatcttacatgtgcttggctatgatactacctctgatcactaatatttgacaccgatattgatgaacagaggggagtatatcacactatgagaaaacatatcaagacaaggccagtagctcctactcataacatatgatttactcttgaatcttagtgcagtaagtacaaacttaatcagaaggtactagggatgtaactctgacaagcccccaatgcaattgcaaataaagggcctttctaatttttactgcccccaagacagctatcatgactaggaccaaatacacaaagtaatggccacttggaagattaacatatggtgcagtatgaactactgaacttccaaatggcagaagaaaacactatcaactatgcatacatatcataatgatctcacctgctttcctatgctgaatgggacatacttgtactttatcatatgcacaatttgccgcttcattgtcaggacaaaaagcacaacccaatagcagagaagtattggccagaagacaggaacgtcgaatacagagaagaatgtcatcagaaaagcaacacaaaaggcttttgtgatggcatacctgaaaaaaaataaattagttagcatagctgacattttgcatttgcatcgcaaataggccttgctagacacgccaacacaagcacacaaagaaaccaaacccattggcagtagaacacgaaatagggaagtgtttaattacagtggcatgatgtgcccatgacaaactaatgcaattactattcctgatctttttaagaaataaaattcgatgctataaaacagcaagtgcctcttgttttgtgaacaagtgtcaataaagcaacgtgtaaaagcagctcatgaactaagttccataaaaaattgtaagcttgacgaagatgttacgtaatataatatctgaacttaaaaacaaacaggtaaaagttactgtactagtacatcacaagccaacaactaaacaggataagagcacgcaaaaaatgcaatagctccactagaaaaattcatcgcggactttccagctatgcacaacctaagcaattaccatatcaaaattatctatagccctattaagtagtaactcccaatggaatctgcataagccgtaggttagcattcatagtgaagcctttgcctatccatctactacctcatcatccgattaatcagtggaacacatgtgttggtcggtgaattgaatattgatgatccaaaccatctcagctggttcgatcaaaacctcacattaagaaatcacatttgtacggtcgcatcaccaactacctacaccagtttgctgcctaggatcagaagcgaatcaggaaaaatcgtataccagaacttgaactcggggaggcggcggatgaagggcttgaactcgtcggagccgcgggtggggagggccgggccggcgtcgagcgcctcgagctccgggtcgaccatgggggagaggaacccgatgaggaggttgaggaggtagatgccgaggccgtaggtgacgacgtagaacccctgcacgtagtagacccgcagcgcgtacaccgccgcggccacgagcgtgccggcccaccgccccgccgtgtgcggcgccgcccgatccaggtagtgctggaacgcccgcgacgcctccgcgcgccaccgctccaccgacccggaggcggacccgccgccgacgggggagggctccatggtcgccgccgcgctctggtgttgggggattccgaggcgaggcgaggcgagtcggtggggctaggtttcgtggcgttgccctgggcgatgggagcgctgcgcgtggtttgggtttggtcaaagcgaaagcggagaggaggaggagggaggaggaggaggaggagaggactagacgagacgaggacgcttcacattctgtaaaagcaaatggggctctgagtctgacgcgaggtcaggaggccacacgcatccagcctcacgccctcacgcgtctttctgatatcaagaaggcaaggattcaactcaaattttgtggaattttctacaaaaataatgtaatttgtctgtaatgttatactctatccatcctttctaaaatataagtatttttggacttcgacacggttttcgagatgctactttaaccaacaatatctataaaagtaatatgttttaaatacaaataattgtatagtacgatagtttgtttaatgataaatctactaatattaattttacatgatttttttttatttttttctattaatagtcacaattaaaaatatttgacttggcactattttaaaaatgcttatagtatacacaatcttcatggagttattgaacgcagatattatcatgaacgagaacgaacagaaagagatgctcagcacatgggcaattacttgcagtttctgaatttttgacgtaacaatgtctgaattttgtttacacgaggcaggaaacagtctcagagagcagtctttgttagtgtttataaagttctctggtcaaagtaaagctctctcacagcataggagatctctggattaggagtgctacgagacaattggaaatgctagaaatcgaaaatcatatcctcatctgggtcgtcttcatccagtaggctataatcttcatcgaacctctcgcactcgaacagataaggtgcgttgtgctctacgttctccttggtgtcattcatctctacgatacggttcatcttctcaccgatgcaggatctaaccgccccttctgtgagatcttgatctgagcctaggccgagaagagcgatgcactcatcttggaactcttgatcattggatgataagattaagccagctatcgattctgcgagatcagggacatactcgcgaacctgaattatggaaagaacaagttacatcaaattgtaggcaataacaagttacatcaagttaccttaggttggattaacttttggatactcatggcacgcttttcaaaccgtaaaacggtgcgtttcgtgtgaaaactttctatatgaaagttgttctagaatatcagattaatccatttttcaagtttgtagtaattgaactgacagtacgcaaatgttaggccatgtcatttgtggcttgccaccaaactaagattcaatgtgtgtcctgatgaaaactagcaagaatagttgagggcatacagacttacaaagcccattcccaagctgaacaatattgccgtctagtctttgttcggtatttaaggggagtggtaattttgctagggtgtactaggcagtaggcacaccagttcttccctatacagttttcccctcgtagtataaagccgacacacacttgatatttcaagggaaagaagtatcaaggaaagtgaagatgatattcacattgaggtaggaaccaacagagtgattatttctgatgataagttacagaaattataatatgaagcttattatgacgtcaatctaatttgtgtgaccaaaagagcaactatacagaaagtggtcactttgcgaggttggcaggtggcacagattaagaagtgttgcattgaggttgcactaaatctaacaggtgtcggttcagtactaccttatgtctaacaatagtttttcttgagttataaattataacaggcagaaaatacatacaagtaaggaatggaaataacaaacacaccagttacgtggttaacagcaaagtgtagaaggcacaaaccttctggccatggcagctgagaaagtcttctgcatggtctgctttcaatccaaacaatgcagacttaagtgcctttcttagaagatgcctttcaggttgagagctcttccattcatcaacagcagtagctacagcaggtcaaggatagccaaatacagtgatgggaaatccaacagagatatccacagccaaatagacaggcgacaccatcactagaaaaaagaaagcatgcacaaaacaaaagctggatatccttcgtggtaagtgtgaatggcaatatcgacatgagaaaatgccatgttatcccattgaagctcagcatttccatcgtcatcaatgaaaccccctttaaacttgaaaccgtagctttgccagtctatgctcatcagcgcactgagggaggattgtgagattggacatggtatgaactctacaaaatgcaaaacctacaatagacaattcaccattgagtggaagcagtgagcatacttgaaccacaccttcagcataaacattggacgccatgctgttataacttttataagcttactaaatacaagcaagaatataccacacaagaggccctcttgcttgtatactacacccataaccagttagacatcacaagaacaagtatgctaatgtaattgcataattagtttatgtaacttagaggcctatggtgcaaacctgtgtagatgaacaatttgtcatccaacagctcaaatcagatgaagtaggtgcaagcattatcactacttcaacaagttgccctttagcttttcttttgtctacatattttgctgttccagttccaatcttcaggcgatctctgaagtgagacggcagaagagcaaaacatacaagccctatcaactatgtaatcaaagctatttgaggaatgtacaattgcagagatagatgatacacatatggtattcattagtatgcacatgactgaattcaactactacataccaggctaccgaaaggtaggatacacaagcatgcctaaaaaggttgaactgaaatgctgaatgggtttgggactttgggtgatgggaaaatggggcaattagacattactcaaatctagcgaatagcaccagacactgttggccacctgaagcagttcatctgatagatcggtactttgtttaacaaaagaaagctattaggccttgatatatacaattctagagctcaaatgcggcaggatctgatatcttcacattaaataatgttgatacactcaattgtgcatatttgattaatacatttcagattttattagatgtgatgggataagacttattcccccagccttcgtgtgtgcacaagtgagttttcataactacattcagaatcagtgactgcaattattttatttaccgcttcatgagcgacaacttttcctatgtgacacaaagtctaaaacacccataaattaacttcaaacctgttgtttagcgattcaagtgcaagttccagaaaaatgattaaatatggatgctaaattgctaatgataagcttccactgaaagtcaaaatccaaaagataacacacatcataaatctatttccaatagcaaagtaaagaaataaacaaatatgtctagagttaaactcagcaagcaatgtttacctgttcatgtagcatgcttcacacctgtcagatgtgttagcatgtgagagtgcataatctttaaggccagaaactagacggtcaatacttgatgtggtaatggaaatatggacatcatcagaatcttgtgacagacaaacgtctcctgatccagcactgtctgtttgcgcaacaaagagctcacatgctaaattctgagtagtacaaaagaaatcaaacaaccatttaagaggtcacaataagaaaaaacagagtaaaagcagatagatgcttctaattctaggcctgtttactgtgcaacaactaaaactggacatatgcaaacacaaagtaaaattagacatgttcggaggaatggaatgtaaccaagtactgaggatgaatcatgatcatcagttttatatcctttaattacatctcaggatacacaatattgttggtctgaaaatgcaggcagacaaattggtgatatgatatcagatggctgttaagaacttatcaaacaaatgcatctgtaggaaactccaatattagggttttcagttgttttgccctgtagcatagaccaatgaacaccgtgttttgttacttttgtatttgtgaattttcagaagtaaataaataaatacaggaacatgtattttcattttgcacatcatgcacaaaggtatgagactccatataaaacgggaacacatatagaaatacatcaaacatgtcctgcagtgtgtgaaaaagtattcacataatgcaatctgcacattcgatttagatgatataagtggcatgaaatgtactgttgttagagcagtacgccacacatgatacgggataatgtactgttgttagagcagtacgccacacatgatacgggataagctagaaggctttgtaaatgacacagttattctaacaagaaaaacacatcctcagagaacagcatcacccgctgctaagagatagacacacaatagcaccagtgtgtatggtcagtatggacgaatagcatttggcattttgacttgaggattaaggactcaggattaaagggattaatggtgagtataaatatgatcagtcattatgaaatatggaaaaaaaacatagtgaacaaagaaaataggaagaacacactggttacaactagagaaaaaagttcagaaatacttacagatgctcttagcacgaatatctgcaaaggtcaacaacagaaacatgctagttagaaagtattcgggacaatcgcgcaaaaagaaatggttagcaacataatgttactaattctatcatatttggaaacaaatgactatagtaagtctgtaatataggattgttatgaggattctattattgacaggataacaaattacaacgatcactaatgttgctaaggttgggcaggtaaaattatggtgaaaaaacatttaaaaaatatgaatgttccttaatacaaccttgcggacaaaaccaaccaaccataatattaagtcatcaacatcagcttcagttggcaggcaaaggcatacttcagttccactgtgttgaaaaaggcataaacgattcaacaaacaccagatttccataggtcacatcaaagtaacacaagaggacctgcctgaatatagcacgacttttgtacgtggtcactagcttggtaaatcttgtgcttgaagatgtgtcttcttgaagattaaattgataacgataaatagctttgtcatcgattcctacagattggaaaagtatgcaataaaaagttcaatagcattgaataaacacatagaattaagataataaaacaatagtttacaacatatatatttatgtatttgcatggcaaatgctaatttgtggagggatccacaggtgtcataacatgtattcaaaacagaataaacatacacacagaatttctggaaaatatctgaagaaacataacaagataagtatacgcaacataaatatttaacatttcctttgactttagaattcctttttatccaataaagccattttgaataaattagacagtatgtacagaactacattatatgcaaaaaaggaacaaaaaggaaccaaggagacagcaagattcaaatataagttttagcaaagtgaaacagcgaatttcatggcatactactgtggttcgaccgatttaagtatgcccacaatgctatcaacttttgcagctcttatgggaaaattctcaggctttgtgggatttccactccaaaaagagataataaaatgagcactagcagcatgggaccatggagaacaatggacaacacatgataacttaaacatatgttttagaataaggtgaaagtattaaatagacaagatgaaatggtttatgtcagtatggcacaaatggagcagtggaaccatgtaacacatagattagatacgaagcatacctgtagttgtgattaagagggtaccatctgcagatggaaagaattagtgtgagacaatgaatgatgaaccaagagttatgacaaactctaaaccaaatgaagatacatggcacagtgtcaggtacatggttgttgcccaagagaatgtcagggaaaaacatatatccatcttcccatcaagaccatctacaattctacatatgaacatatcaaatgtagtgataatatatcttaagcaaattctgatgacttggtgaactccatatctactccgtacctaacaggctataccgtacaaaccaacttcccagatgattcagcggtgttgttaacaacagaaccacacatctcatgcaatccgcagtctgaggatgctactgacaaccagcaaacagggaaattgagcgagagaaggtgatcgcataccccatttctccacgggggtctcacgcgccaatgcatctagctccaggaactcctccagcttgctcccaactccagtatctgaaactgcagtagttcacgaatgtaagcggaaggaaggggcaacagatcacaacggcgcaagcgcgcagctgcactaccagatatacgcaggggcgaggaaccagcgggttccggggagcgcttgacggagaccgtgagccggcacggcgactccgacatccggcagcgctgcaccgcccagtaaatcaactgaaaccgaacaaggaatccaaacaaagtgtatcatcaggggagaggactcggaatcgcacgcgaagatgagggcgagggcgaggcgtacggagtggaggagcttccggtagggcgaggaggaggtgggggacgccgtcgatggaggcggggaggacgccatggatggatggagcggagggaggggaagcgctcggcgagttgatgagagcttggtgtactgacgaacaatgcaccttccttccaccgtcggtcaccgccgagctcgccggagttccgccgccctccggtctccggctctgcgccgccggtggaatccacggtacccgtcaacacaaatacgaataagaagaaggaccaaaatgtaaatgtgctaattccccgcttctcttttctcgatatggccgcaacacaaatacgaataagagtaaggtccaaaatgtaaatatgcgctccccaactactcttttctcgatctggccgcacctcagatcgaacggttcagacgcgtgcagttttggattagcgatcgtggatggatttaactggtaatacgaaaataattaaaggggctcttcgaataaatactcctcgctgccatgtggtggcccacctgtcagctcccccccctccctccagtgagaagatcttctcttcttcgccgtcgtccgccggagcgccgccgcagaacgaccgccatctctccccggcgacctcgccgttgcgtgagaggcggccgcgctacgtcttgcccggagcagggagcgctacgagtcacgacgacgtgggggaatatcgcacgtcgccggctggtttgtcagtcgcgatgcaggtggagctcgctgaccgcgcggcagcccggcccagcgagacgggggaggctccgccgtcatctccagccgccgccgccgctgcatcagcagcagcggaggacgcgccgctcttgccaggtggaggtgggggtgtgcggcggcgggtggtggtgagcgagcggttccggcagcgcagcggatccttccggcgggaggtccgccgcgcggccgaggagacctacctactcacgcgcctcacgctcatcctcctccgctacctcgggtactcgccaattccatttctgatagttctactctactacaaggctgctatcacttcaaccttgcgatctgtttgtgttaatgctgtaatttggggaaattgtatcatggcatgtttaccactgagctaaatgatcatttctaggctttctactaagatcagatgctaaactgcttttgtgattgtgcatgggagtatggccttttcgtgttttgttctttgcaataacctgtctctgtctgatttatgcaggataggctacagatggatcaggcagttcctagccctctgttgttacaccttcttgctcatgccaggtttcattcaaggttagccttgccattactcttttgttgagggagagaaagcatttgcacttgcttggcacatctccacatttttctttggttgattcaccatgtcttcataagtagtatttcagtaggattttgtgttatatacctgagatcacaattgtcccatccgctggtttgaaaccttaagactagcatgggttccatcccacatcctcttccttagttagtgctagagctcctagccagttttcaaaaggaaaaacaaatttcattaccacagaaagtgtttaacagaatggagatggccttgactcttttttttttctttaatacagttgtatattattatttcttctcgagccaagtttgtagaagtgttgtatatggagaacaaccaagaaacaggtacttcttgctatctttttcataatgctatgctcatatttgtattttaatttgtcttggtgtacttggcatagtctattatgctgttcatatattgaaccctgaaaattcgttatctaggctggatttatacatacctaccgatagaactgggttgaagccagttgtggcatttgtcacgggtggagcttggatcatagggtgagtaaaactgtacaagtatgtactatcctggtctccaactttctgtatttttactacctgaagttccagtaagatttagattgtgtgttgactctataatggcaaattatacatatcacatccacaggtacaaagggtggggggcccttttgggcaggcgcttggcagagaggggcatcttagttgcatgcattgattacaggtactcaaaataaattccaaatatgcatatagaagaatgagggttcataccattttcatggagcataccaattatttgtttgcagaaactttcctcaagggactattggtgacatggtagaagatgcatctcaagggattgcctttgtctgcaataatatagctagttatggaggtgatcctgaaaggttcataacttacaatgatatcaaactttcaaacttttctgttgcaattacaaaatggttcctaccaacgtatgcccttctcatgcgctgatgtgcacaaattgttactgtattaataattaggataccatcagtggaatgtgagttagattgcgtcagagacatatttcattttggctatttatatattctagggttctagtaataggcactgcatggtataaagatcttacatatggaacttctgaagcattatgaatacaagaaacaactcagcgttctgattttggtatggcatatattgaggcatcttgtccgtatctgctctatctaaatgatacttacaggatttatcttgttggacaatctgctggtgctcatattgctgcttgtactctcttacaccaagctattaaagaatctggtgaaggagatgcttccacttggagcattgcacagctaaaagcttattttggtatttctggcgggtaatatcctattctctttacacttacagtaggtgacatgcagcaaggcttgcattttttataatgtgtatgagaatgcgcatgtacacactactttcagttttcagttgtttgtatcgtcaaatatttgcaacagtgtgcagtggaatatatcatgtagtctgctgagcttctttgtgagcagagctgtaatatgctgctccagatttaagaaatgagaagttccctttttaagaagtgacgtggcaattgggctcactctataaatattattgatgattcatgttcagcctttgtaatttatggatcattttggtacctttgttgttaatatgagattatattacatttttagtagtttcattaatggttcacatatacaggaattctggtgtatcggacttgacagttgatttatgatttctacagctataatcttcttaacttggtcgatcatttccataaacgtggcctgtaccgatcgatctttctcaggtatatttttgtttacagctagttaaaagtagcatagtattgtattcatgtcctccacaacaactcccacataactattgaactatgtgagcatatcatgttgattatctttatatacactaaaactccacttcaacaatatgtttcacagcataatggaaggcgaggagtcgttgcaaaaattttctccactggtgatggttaaggacccagctgctaggtctgcagtatctctattacctcgaatattcctttttcatggaacaagtgactattcaataccatcggctgagaggtgggttcaactggaatggttgatcacatggtgcatgttttcttgtcgtattgattcgaaatcattagattggacaaaccaactatatacttattcagttgttttctcttccaggagatgaatgtctcaggttaagtgaaatgaaacttttctctcgaacaaagtgaaatgaaactcatttaaacctttttgacattattttataataagtatgccttatgataaagtttccacatgctgttactgaccaaacaaaatgagatgactaaaccaaactgagggacttgggtattctaaggacttttggattgtttatacttcatagtgccctgatcttgtctgcatccatttcaaatgaattttccatgttgtttggcatgctgaagaaaaacatagactagtcagaaattgtttcttcttgaatcttattgtagttttgcactagtcaagaagaagagataagtctagtgcaacatcatgtcgttgtgccatttcctgttggtgttgagtagttaacactagttaagaagaaacaagtgttattcttagggattctagtgctaccatctagctttcatttaggagatttagtcacttgtttatttttcctcctcaccagtaacttttgtagttgtgttatctgacgaaacttctatattatggatattgccatattggactatttctattgattgacttaattgaaaaaatgcagcgaggctttctttgatgctttacaacagaatggcgctaaagcagatctgttcttgtatgatggaaagacgcatactgacttgttccttcaggtaatctattgttacattagtggttattggatatgggttgctttgtttagacattttattctttttggcttttatggtacttttctttcttctagatataaaattattcattcttcgatgtaatgttgttcttctctatattgtgatttcaagatggtcatagtctttgatttaagaaccattatggtgggtagtataactaagtaccttcagccaatataaaggcgttatcggcttagtatacaatgtgattgtaatttgtttacaagagaaagggcctgaaggttcaacccttcaaagaattaactgtctcaactgatcatcatgtataaactgtattgcttgatgtttgttattgccccaacatgggtatcacgccctggtgtatttggcagtgtaatttgaatgcacaaagttcttacacttgatgctttttctctgattaatgtgtgctgtaggatcctctccggggtggtagggataagctgctcgaagagattgttactgtgatacacaatgacaatccagatacatctgcccagcatcttgctgtacctgttgcacgccgccttgttcctgaattcatgcttatgcttgctggaagagttagtcctttctgattatgttggcgaccagtgatggcagctatgtatatattcaatgcaaggattgagcccagagaaatctgctgctcccggattagctagcagctagtcagttagtgtagtgttccaattaagatgccaaatgtaccccttcgttgagtagctacccgccagtatgtacagatcttgcctcagacgtctgtcattgactcattgttgtattgtatcttaaggtctagctcattatgctttagtaacacataacttgatatcttatgaagctctgtttggacaagggtcaatctgaggagagagcttgttgtgaattggaagaatattgtgaagacaactgttctgaccgaagaaaatcgtcatgagatgtctcctgcctttctgtaattcagtagtcagtaaattcagctcccaatagagttgctcgcagtactggaatggaggggtgttctggaagacgtttcatctgcgcacttgaagatgtctgtgtgtcttgtaaaagagtgtgtggctcagttattgatcaattagacaagaaaacattgcatgcgaaaggtgatgcttcttgatctattagcacagctctttttacagaggaacagcacatgataaccttcacatgccattggttggaaaatgaacatgctcacatggtggaaaagctggccagtcttcattcctccatggaccagatctaatctaaatatctaatgttgcatgatttgcatctgaattgagtaacatgatggtaagagtagatgaacgtgcattgtgcgtgggcataactcataagaagtggcaaaacatctttggacgactgtttgcagtgtccaaagttcaaagaaacttgccgtgcagtgtcctgcttccatattattgccatctggtgtgtctggcagaaatcttgcaccgatcatcgtcatctgtcattgtcgcactaaggaatgcatcctgggtttacctgttcagagttcagacttccatttcttcagatgttttcactatcctgagtagcagaagatgaaatggaaatgggatcactcagaaatgaccgctaatgctagcgatcagtagtctaacgcgcatcatgaatatcaaagtacgtgtgattttctacaactttgatcacaaaacatgtggtttatgcagtttaccttttttttttaagtaagagcttgtgatcacataccacatctctccaaggcattcagctacaggaatttcttcagtgtgctgccagctccaacgtacgaaactgcattccgggtcgtcggactcgcggccgccaaaacctgtgacttcgaacgaatctcctccgctacgtctggtattcgccaatttcatttgaatttctgatgcaattgtacactcatacatactactcctacttggcattcatcttggaaaattcgtgtgacatgattattaagcaccgaactcaaacatctgaactttactaggcttaatgtactgaaaatgaacagttcttcaaagaggaatggatcactgtctcagcagttcttcaaagaggaatggaccagagtctcactgataaactgtttcatataccattacaaaaaaagcatggatatgactagatctcactggaaaatgaacatgcccacatgatgcacaagctggctgcttgctattcattcctccatggacagatggactaatctagtgttacatcagagggataatacattaatccatgcaggggtcctgtagtgacagacagcacaatggcaagaagaatatgtgaacatggatgagcataagaagatgccaatcatctcgggctggctgttgcatacttgcattgtccaaagtccaaacttgcagtgcagcattctgcttggaaattatcagcatctggtgcgcctcacagaatcttgcactgatcatcgtcatcgttgtgcactaggagtgcatcctggagacttgttcagacaatccatcgaccgacccttccatttcttcagagatgtaatcatcctaaaggatagcaaaaacaaaagggaaatgcaaagggaaatggagttactacctatgcaacaaaccagtcaattccttttcttttcacgcatcatttcttatacttttgttcgatcgtgcatagctatgcaactttgccgacttataagaatcatagacaaatttcaggcagcaaagtaacagtacctctggttctttattgtccttgacagcgacacacttggaagcactaatgcttgcactcttcagatagctcctcgaactcaagtctgtggatgtcacaccattttggccagcagatccatgttgttgtgcatcttgtgacattggagggcttactgtagtgcgggcaacggaatctgcactcctctcttggtcattggtgttttgttggttataaccatcctttgatacacctactctctccctgttatatgcaaaatcaatggagaagttagtacaataattgatatgaaagtaagtaggtctgcacttttgatttctgatattgccacattatgtacctcggtaaagaagcatgcttcctctgcagtggagaacctctttctcctttgctgtagttctcctcaaggtgtgcaaactgtcgtttgaagcgatcaaccccactgcagtaagataacaatattaacagaatagctatgttcacggtaaaaaaaggagagaaaaccatgcaaggacatgataaatatatattagatgcacacatggctagtgtttcctgtaacaatgtccatgcaattttcgggtgaaaggagccttggaaataaagatataccaaaatgagagcaacaagaatagatcagatattaactcatgatagcactgcaaagcaaattactactatacttagtaaatttgctttgccaacaagagtatttggcgaaggcaattttgttggtgcaaagaagtatattgtacaccatgctaacttgctggaacaaagccagatattcatctttgtcacgtcaaatttaaaactgatgaaagaaagaaaaattaatgcaagactccaccttggatagaggaagctaatctgctctccacctttcatatactcttgcagcatctgtgggtgatactccaaaatctgtttgcatttcataattatcaatcttgaaaagctgaaaattttattattaacacaaagcaggaaacttgagctattgctttgtacctctcgataaattaattctctaacatcatcttttgtcagcttccgtctctcgaattcaaactcaagttttgagattggatgtcttgagggctcacgttccacattagcaagacttgcgaagtacggatcagccaaagcctgaaaattggaagagaatataacatataaaaaatgtgtgttttctgaaagtttttttttttaaaaaaaaactacttttgaggtttggaaaggatgctatgctttctcttgagcttacttcttcagctgaagaccgatctttaggatcaaatgccagtaaacgctctagcagacgaagagccaaggggtcagtattgcggaacttctgagagaaggggacagcatgttttttccgcatggtgctcaagtatctcctggccttctcatttcgaatctgcagagacgcagaaaacagtaaggtgattgtttcatcttattagagaattggatcttcttgaatgttactgaataggaggttcaaggatatatgagaatcggtataaagtaaacataccctggataaggtttctgatgatggagttccaagaagatctgttataatatctaattggtgcacaacattcttcccaggaaatagtggtctcccagtgagaagttcagcaaatatgcacccaatactccaaatatcaattgcaggagtgtactgtatgcaaattggctattgttagaacacataaaacacatggaacgctagagcatcagcattgcacaaaagagttcacagtatattgtttctctacaagaatgttactcatccagtttcaagtggcgcagctttgatagaaaattgtatgtacaaacaactaaaatatcaacaaaaagaaaaataacttaattttctatacttcatttagcacaactgtaagttggatagataaagaaaaaggaaaaaaaaaagaaagcattgctaaaaacaactagaccagttcatctatggtgccacaaaagcattaatcttgattgaaagaattctagtgttgaagaccttactttggagaaaaatgagccacataattcaggtgctcggtaccacctcgttgcaacataatccttcacaaagtagaacataattaataacataaagacttaaagaggaatgtaaaatctcatataagcaccttaccgtccaaaatattgctgaaggggcatcattgaatgatgctcgggcaagtccgaaatcacatattttcaatttgcagtctgagtttgccagtatattcttgggctttagatcgcgatgaaatacattagctgtgccaatatagatgatttatcagagaataagctagaattccatgttaattgataaatcaacagaactatgtgtttaatggtggtcaagtaggttcttggggaattggggattatcagtagttaagcttacctgcatggatgtacttgagagcacggagaagttggtacaggaaaaactggtagtgctccggggtgaggtcatcgttcgctctgatgacttgatggagatctgattccatgagctcaaaaacaacataaatatcttggaactcccttcgagaagggggaagcataatgtgtttgatctcaactatgtctgggtgacggagcagacgaaggagcttgatctcacgcaatatgcgcgtagcgtctgatacatgctcaaacacatcattgatcttcttgattgcaacccgctcacccgtgcgggtatctactgcagcagcaactactccataacttcctttgccaatgacttcctggatctggtactggcttgcttctccatactcagtgaagaactccatttccactgtgttctacaagatcacaattttgcaagaaaatattaagctaactaaaaatacagagtggctggttataaaacttcttcagtagtagaatagccctataaacaaaaccatgatcttgtccctgggaatatcatgaccaacctaacaaaaattgacattttcagtacatagacatgtaggtttattcgcaaatgaaaggaacacctgctccataccatgtgcaagacgcgacttgttcccaatagaaacagtccgtaccagagatatacataggccagaccaagtcaaacctggagtactaattagtagccgattctgatgagatcatccaaaaccacaagtggacaacttggatatgagctcctaaggatcagtatgacaaggatgatgggaccaattgttgagaacagctccaaaagagggcacaagctttttgcatagtagtgctgcaattgcactcctctaagaaatggagcatgcaggagcaagtaatttcagaactaagcaaacagagaaagaaagaaagaaacttaagttttacgagatcgatcgtttcatagatcactggaataacacaggtcaacagccaggatgacgaatcggatggcagtttacaagcaactatcgctctacaagcaaccatcgaaagaagaaagattggatagaacacgcaagctttacctgcacttgagctgtattgcactttgcacagatcatagaaaaaaagaaataatgatattgtacagtatgcaagtaattcaggtgccacgaagatctgatctagtctaagaacccctcgtggccacgaatcaaggatcacgagaaagcctgaaactttcatttcacccccaaactgaaaagaaaacgaagcaaagcaaagcacacttcacactaggcacctcctcaccttcttgtggctctcgacggggagaggcatcttgcgcttgggcacgcggatgcggatggagcggagggcgacgagatccgggtcgtcggcgacctcgaggtcggaggaggcggcctcctcgccggcgttggacgactggttggagccggacgccgtgcggcggtggaagaggcggcggaatccgtcgacgagcgtgccccctccccccatccccctccctaccagttccccgccggcattggctagctacaccaccgcagctcgccttccaagctctcgcgttcttggctacttcttcttctccttccaagctcggacctttcttcccgcgttcccgcgaccaagcttgcctcctctctccccgcgcgaagtcttcggcgagtaatggatggatggatggatgcagaagcagaaggcgaggaggaagaaagcgatggtggtggtggtggtgatggggaagaagtagcaggatctcctcgtcttatacttctgattagtgaccgatttttttttctcctccccgtctgccgcgtactccccctatttcatattataatattttctagcattacatatatatatatatatatatatatatatatatatatatatatatatatatatatatatatatattataaaacagaaaaaataatagaaaactaatctataaaatataacacattgcaatgctaaaaatattaagacattttgtattaagacattttgtattaggttatagcctcatcgattacccatattttctagtaatactaaaacggtttattaagaaataaaaattaatttattagtaaaaactgtcttatgaagacgatcaagtgggtggtggtacgtgcaaatctggaaggaaaacggtgcaccggccggtttccatcttgccatcaaaggaagcagcagggaaatcccagtagtggaagtacagctagatttttagtattagtacgatgtggacaagacttactcctacttcatttgcatgcacggctgtactgtactccaattgtgtgaaagttatggccgaatctgccctgcacgtacgatttggtctcaactatgtattttcctgtactgtataataatctcaattctaaaatggaaaataatttgctagaactatactactactagtagtacttgcgaattggtctagaccgttacctgtatggattgaatttgtctgcggaaattctctggcaccaggcacaggaacatgctgcaattaacatgcggtcaacgctgcacagaggagagacatcctggttccagttggtaaggttaaccggattctgaccgctaacgactggaaacaccatgtaagaacaatactacaatactacggtccccatcgtttagcatattcatatgcttatcagtcagaatttgaattttcaacgttaaattttgagttgattttgggattttttttcatcgaagtatatttttcagtctttgcttttagatcgctaagaatacatatataaaaattttattcacaaattacttttcgtttgtaaatatgccgtttgacttattccaccgatatgccaaacgatggcacccgtaaaacgcagcatacgccgatgcacgcaaatgtgcaatgccattatgcaagcatgaatacgaaatcttgctcatgtacgaacataaacacgcaactatagattatccaaatgctctacaacatttataaccattgatcaaattctacatgaatcaaatccccatcaaataatgggataatatgcatagcaattttcatctgctaatgcttaatcagatcagatagcgatgattggaggagattactcgtagtagaccaggccgatattccctgtgccacctccatgtggaccccactagccatgcatccccttgacgtgacggtgatgcgagagacaggtggcgtggcggtgcacacagacacagcccgggcattgcagcgtcagtcacatgcacggtcgccgccggccggaaggagacgggacagctggcgtgttgcctccccgccgcaccaacgccaacgcgtcgtcgccgccctcgtgggccggcttggctcgacgtggccttttcacccgcgggccagtccaacgccgtgtgtccccactcgacgcgggtttcgaggagggtggggcccgcatggcggttcctggcccatgctgacaaccgggcggtttgtgggccccacatactgggccggatgattggagtccttcaacgtgggccacttagtttcggcccgttggcacgcgggagagaaaatctctctctggtcacgggcctccagccttactggcttccttccggcgagggcgaggcggagaggtgggcgcccgcctctgcctccgcctccgtctcgccgcgctccggcgggtggccgggccggggtgcctccacggcctcgtggaagccgcgctccggcgccgccggcagcaacgtgtgggcgaggctgttgctgcgagcgcccgcagagaccactccgcttttgaagggtatgttgatctcccccatttatggcagcggtttctgtttggttccgcgttgctgttcatgcgccagtgatggaggatgtgttattgcttattgaatttgattgtgatgtccattttgctatttactttcacgtgtatgtttgatagtagtcagcgcaagtaaacctggcatctacaaatgcagaagggaatcaagggattggattttgggatctcttccttttggggaatttttaggtgccacaagctaacatgtcctaggagctagaatgtctcagtgattttttttcaatgcataaaatcgatggttcatttctgcaattggacgattcattacatttttagcttagagaaatagttaatacatgaggtacaagagcgaattcctttggtttccataccgtgactatgattctgctttctgccatccgcaattcagtctaggataaaccgaatggctctcatattgttctcccatgtaaacatattagctgaaataggcactatctgaacccaatggccattgtctatcgatcccaatatctttatatagatgcagttatgattggctgcatggctttaatttctcattttaaactacagaatgcattttaaggtttctttgatgtgaattggtaaagtatttggttgcatacatccgcgttggatgtagaggcccggttttacccgttttctaaaaaataaactggtaaaatagaatatagaaggcggcaattaatacacagtgtatgctcttactattgagtgtttagtgccttagtgatcaactggagcatgtaaggatatagacttctgatcctcacaatatttcaaactttggcttataactttttcacacttggtttagtatcctcaggaaccatttagtacgagtcaggcaatcctcatgaaccatttagtacaagtcaggcaatgggttgcactgactaggatttaggagagacagtgagttgcaagctaatgacaatcttcttactgttttattcttgaaaacctattttcgagtgtgtgcgtgcgtgtgtgtgtggttctatttctagcatatgccattatgccaagcatgggcgcatggcacacaactaggatttgtcaggttagaagtgcccatcaaggttttggaaacaggtggagaaaatggcaaccaaaatatcagcttcgaagacttggacatgcactgatgcacatctgattcttggagattatacgaagactgtgtgggatcattaccataagagcctccctaaagggctctgtggatcaagcaaatggcagctgctattggtcaagagcagagctcctctcaaatattaaggcattgcaaatgaagccaaatgctgctggtgcaaaaggcctactccgtatggtgcaccagcaatcattggggagcacctgcttagacagcctttaacaggcacatgcctgcttgatcaagaccactggcattctggagctgcagaaaacaatggcaacctagaaaacattattctgcacagagacccagagcacactgcagcctggttaactgtctgttggatctatcgggctatgttcttcttgattgtgcaaacaagagttctactggatggatggagctgtccaatcaaactactacctccgtcccaaaataagtgcaactatggatatccgtgcccaacgtttgaccgtccgtcttatttgaaaattttgtgaaaaaattgaaaatatttagtcacacataaagtactattcatattttatcatctaatagcaataaaaatactaatcataaaaaaatttaaataagacgaacgatcaaacgttgaacgtgaatagtgcaaaactgcacttattttgggacggagggagtatcagttgcagacttgcagttagatgatgcatggaacgacacacttctgtcggcaagcctgacaagctattgcattctggaactggtgtcctcaggcggtagtttcaagattgtgcagtgacgagaggtaaattccatatccaggtaattcaccgaaggaactgagagatctcccagatacattacctttccacttgcaagtagcaaccaatggactagttgatgctgccatgctgggtcctccactgcagagtagtaacaacaaacaagttgagattgccagcaagaactgacgagctgttcagctagcacttgtgtactccacttatccactactcctccaccagtttgctgcagcttgctttgctcctacgcccgtgcagctcgcgcgattccggctgcagcgcacgttgggatcgatggagtcggtggccgttgaagcggcgcggtggatggtcggcaaggcgctgagcccgctgtcgggagggctcgtcgaggcgtggctggcctgctcggagctcggcaccaatgtcggcgccgtcaagctggagctgctctacgcgcaggtgatgctcgacaacgcccgcggcagggagacccgcagccccgcgctgaagcagctgctcctgcagctgcgtggcctcgcctacgacgccgaggacgtgctggacgagctggactacttccgcatccaggacgagctcgacggcaccgacgaggccgccgacgagcacaccagaggctgcctccatggcctcctcctcaacacccgccacaccgccagaaacattaagaagaggtacctttctgcttgttgctcgggcggaggtgacgagaaagctgttgccggcagtgacctctctttagctggtgaacatgatgccgatgacgactgtaccgatgaagacgacaacgacaccggctctactgatatcgaccacagctctactgcaacgcacatgcctagaaaagaaaaacagtggggatcacagagggaggacactatgaaaacaccaaagctgaagttcgatagggtggatctgtccacaagaacgaagcacatctctgagcagctgaagctagtctgtgccaaagtctctaccattcttaatctagagttgccggaatcaaatcgcaccattcgaagcagcattgctatgcttcgtcctgtgaccacttcagcgactatagagcctgaattttatgggaggaagggtgagaaggatagaattattaaagacataactcatggtgattgctgtgtcaaggacctgaccgtcattccaattactggtccaggaggaatagggaagacagctctcactcagcaaatttacaaagcagtaaagaacctttttgatgttaatgtttgggtatgtatctctctcaatttcaatgcgtacagattgaaacaagagattgctgattcaatacctaaagttgagaatgagcaactgggtgacctagatgagaatgagcaactgggtgacctagatgacttgattgagcgaagattgaagtcaaagaagattttgcttgtcttggatgatatgtggaattgcagtaatgaggatgattggaaaaggctattagcacccctcagaaacgcacaaacaaagggaaatgtgattctagtcaccactcgttttccagcagttgcagaaatagtacaaaagacttatcgtccaatacaattggaagggctggaatttgaagagttatgggaattgttccaagcatatgtgtttggtgatgagaaattaataaaccatcatgctatcttacaacagactggagaaatgatagccaaaaaactaaagggctcccctttggcagcaaaaactgtaggtcgattgttgagaaatcaccttgatttcaatcattggacaagtgtcctagaaagtaaagaatgggaattacaaactggtgacaatgatattatgccagcattaaagcttagctatgactatctccctttccatctgcaacaatgttttatatattgtgctttgttccctgaagattacaagtttgacagtgatgagttgattcacctatggataggactagacattttacaatcacatcaggaccaaaacaaacgaactgaagatatagcattgagttgtttgaatcatttggttgattttggatttttcaaaaaaaatgtgaatgaagatgggtctccttattacagtatgcatgatctactacatgagttagcattgaaggtttcatcctgtgaatgtcttgctgtcagtagttctaacgtaaggtttgtgcaaattccaccatctatacgccatttgtctattgtgatagatgacatggatgtaaatgatagagtgacttttgaaagcatcaagacggatttcagcacactaagtaagagactggatgttgaaaagctacactcttttatgctatttggacgattccatggaagctttatcagtcctcttggtgatttgttaagtaacgcaaaatcactccgcgtcatcttgttgtctactccatcatatgcagtggagaatatgttgcacaacttttcaaatctcgtccacttgcgctacttaaggattattaggggatattttccagaaataaggctacccaacaccatttcaaggttttatcacttgaggatccttgatgtacgaaaatgcaatggtcactttggtttaccaagagatatagataatcttgtaaggctacgccattttcttgtccccgatgacaatctccactctgacgttgctaatgtgggtaagttaaaatgtttacaagaactaaggagatttaaagtgaaaagacaaagtgagccatttgcattaagacagttaggacagttggagctgaacggaacactaggcatttataatcttgaaaatgcacaggcggcggacgaagcaaaacttttaaacaaaagtcatttgcacaagttaatattacattggtcaacaaaggattgttcccaagatgaacatattcttgaaagtcttaagccacataacaatcttcaggagctacaaattgaagggcatggaggtgccacttgcccatcatggttaggttttaacttgtcaatcaaaggcctgcaatctcttagtctgcatggtctagactggaacaaattcccacctataggggagttatggttggttaaccagcacagtgaaaaatccttgagttgtatagaaggccaaagcttttggaatttaaaaaggttagagctagttggcataccgcgactagaaaaatggaccggaaatgatgcttcccgtgtgttctctcagctagaagtgttcatagtaagagattgcccagaacttatagagttgccatattcaaagatggacagcactcaattccctacactaaaggagcttgagattgtaaaatgcccaacgctatcatcattgcctcccgttccttggacaaactctccatgccgtgctctgattgaagaagtgagatcagattttcagcacttgaagtactcaaatttataccaatctaaatcacacttgtgggttgcgggaaagaagggccatctgaattgtgcattctcaaaagtacttgcatctagtaatttaactgagatgaaatatttgatcttgacaaaatgcccttttttgccgttggaacacctccagatgttatcatgtttgaagaagcttgaaataaatggttcaagtagttccttgttgatggttgaaggtgggagcgctgttagataccagtttccagtaaagaaacttgtgatcagaaagtgtggtgctagcgggaaggaattgacgctgctgctgtcccatttccccaaactctctgacttgacaatgtatagattggagaagatagcaatgcttggtgtggctgagcagcagataacggcaacatcggcatcttcaccatcactttctggtaataagttggagaatgcacgtttcggacaagagcaacaacagccaagaggagaggacgagaaagcagcggcatcttcaggactgctgctcttgcctacccagctacaggagttgttcatctcctgttgctcaaagctgatcctccaccacgattcacttggagaaaacatggaaggacgcctaagaggcatagaaggagggttacaaggcctgcgctccctcgtatcattgactattatcgattgccctgatttcttctcctcctactcatcatcttcctcatctttcccatttccttcctccctgaaatatctgtctattgaccgtgtaagtggcatggagactctgtcgctcctctctaacctcagctctctcaccaacttaggcatagaatgtggtgatttaagaggcgaggatttgtgttctctgctcgcccaaggccaactcacaaggctgcgagtcaacaagaaccccaaattcttcgtcgggatcaacccctcatcactgcagcaccttgtaacggatgacatcgcaggagtgcttgttgtgcccatctgcagactcctctccccctcactcaccaagctaaccattttttgcaataacgaggtgaaacgcttcaccaaggagcaaaacatggcccttgagcacctctcctcccttcaggagctcagttttagtttttgccggctgcagttcctcccctctgtgttacacaggcttgttagcctcaagagattagagatctcgtgcagtgagttcatcagttcgttgcccaagagtggtcttccaagttcactagaaatactagatgtctctggaggcagcgaggagctcaaaaggcagtgccgcaagctaagaggaaccattccaatcatcaaagacagcgactgggatttgattggtaatgaacattctcttgtttgagccatcccggttcactttctgtttggcgcaacgttaatactgtgtgattcatctacctgaaaaacctgattgttctgaaatcctgtgcagattctttcttggattagtatgtgccttattctagtcttggagaatcttctctgcatccatctccattgagttgataatcaacttgtgctgcttccatcacgtgtacaaaaactggtctgtcatttcatacgagttcatatctgatgctttagatgctcattttttggttatctgtctgatcgcactcttctctttttgcaatctttcagctgttctgaataggtattggcagtgagagaattgtgggatttaatcccctgcacacagaaagaacttcaccttgtcgccgcctccaccgtctgtcagctaggtaacgagcaaacaatccttttccgggaggacaattggttgcaaggaggaaccatccgagctattgcaccctccatctacgatcatgtctctactcgtatccggaagcgccggatggtggctgaagcgctgtctaaccgtagatggatcaaggacataagtggcgcgcttgggactcaggcaatactcgaatacctcaaactttggtcgctgattcagtcagttgattgttcttccgcagagcccgactcactctcctggaagtgggaaagctcaagcaaatacacttcaaaatctacctaccgagctttgttccttggacgaattgcctttgaatccacaccgatctagaactcgttggcaccacctcgctgtcatttcttcctctggctggtcgcgttgaatagatgctggacagccgaccgattgcggagtcggggattgccgcatcccgaccgctgcattctctgtgatcagcaggatgagagcattgatcatatcctagtcggctgcccagaatcaaggcagctttggtggtggactttgagagcaatcggccaccccaactgcctgctggtgaatgaagcttcttttcaccaatggatgtgcgatagcagaatggtgctaagtgagtcacatcgttgaggcttcgacacggtggtgacattggtagcatggacaatatggaaggaacggaacggtcggatcttcaatcagcagtgtagatcttgggcggatgtggccagagggatggtggacgaagcctctctttggcgtaaagcaaacccggcgatccttgcgctgtaattcaggagggagtttggtcgccaaaattagcgtgagagatagacttaggattgtctgttattgtcctgtatcagtcccgtgctgtttttttttctttcaaatgtaaataacttttatttctcttaatggaaaaaatgcgctccttgcgtattcccgaaaaaagaattgtgggatttcatggtaatttatttatcgctgggcatggctgaaggacgccgaccaaattttattagattggaggagaaaaggttacaaagtgatttcaatcacaacaggcaaggccgggacctgtgcaacagaaaaaacactgatcccgaccactgaaactacccccaggccctggctactccagtactctgctatgtcatcgctattgtgccatccgcaaggagcccacctcctgccattgacactgtccgtcgacgatcttgctattgttaaatttgatactgggccgactctgggcctactggctgagactcgctgtacaaaataactagtttctgatgaactgaaacttatacaatatgttatcagtttgacagattgtattgtttcaaggaacgcaggtcaatatgtcatttgcatgtcatttgatctttcatattcttcaatttaacacagtggagtaattcttaacatttcacagtaggcaaaaattctttatcattgaatgcaagcctcattattgccctcagcctcttagaacaaataactcatcacttgttgatcaggaagcggtaaggtacttaactctgccatagtttttttaaccttttcaggcacatgatataaatcagctgacttagttttgctcggctccttaagttcagatatattttgtgaaaggtgctgctaaagtttcgttttttttgggaatacgcaaggagcgcatatttgtattaaggatggaaaaaaagtttaattacaggaaatacaagaagtgaaggggagatgcaggaatacaattgccccaaaagatctattctcctatccgatgttgcgacctctcgacagttggctgtggcaagaactccggaatggctgctcgcgcaagtctccagagttctgcttcggcggccattgcccttgccacttccgcccaagtcttttgctgctgattgaaaacgctgctattcctctctttccagattgtccaggcgacgagggttgcaatggtgtcgaaaccacgccgagctgccttggtcaatctctttcggctatcgcaaagctagaggtggaaggagacttcgttcgtcggcagagaacttgtttgtccaatggccctcagtgccatccaccacaactagcgggactttgggcaagcgaccaggagatgatcgatgctttcatcgcattgatcgcataggacacattggtcggggtgtggcagtccgcgcctcctcaatcgatcacccgtccagcacctgttaagcgccactaaccagacgaagtactagcatcgaggtggagcgagagatttccagatcggggtagactggaaccgggttatccctaggaacaatgcttgataagccgatcgggaagagtaattgcccgacccctcccatctccacgaaagcacatcgggctggtccgtgaggtgcactgcacgaatgtcttgccacagggataaatactcaagaatggcttgaataccaagggcaccagagatgtccttgatccaccgcctatcagacagagcttctgcgaccgttctttttttgcgaatgcgagccgggatagcagcatagagagccggcgccttgcagcggatggattctccctgcagccagttatcctcccagaacaaggccttcacgccgttccccacaacgcacaagtttcgttgtttcaaacattttttcgctgggacgttgtttcaaacattcagaacatgattcttctgctgcctgcagtggctgtggcatgtcattcctacaataacaagcaatcacctcgtaacaaggtacagtttcttcaatcttcatccctatccttgcctggtacaaaatctgcagttcagtgtcgtctaaagaattgtgtgcagtttgttgtttcactagcagttgtctacgagcttattgaattgtcttgtggttacaccttggtggtgtcaaaacaaaagagttcactccaattatttatccacatgcccttttgtatgtgttttttttttcaggatcttagtcatcctgttagaagtgttgcaatcaaaaagaaaatcagaagtgctgctaaacaagtgcacagccaatccattcgggcactcctgttgtgtgtaccaacagcagttatgctgtatgtacatgtactctatgtatactagtttgaatccattatctaaaaaaaactagtttgaatccagttctgtgcatatgaatgtactctatgtatacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5511 - DNA, 6405 bp, Oryza sativa
tcctgcagcccttttcaatcaagaaaaataccttcatataagggcaggtgtgtgtaatttagtttactagctagggcatgcttgaaagtcattcattttgcaagcttttcatatggaacaatttgatttaatttacgagcatgatcgatgagtgtttgcatgtttacacggatctgacaaattaacttgttctggaaacggtaaacaaattaaactgaacttttctacgaattaacagctgataacgaacgcatgttctgaacctaacttttcttttaaagataactatcttttgaacctaactagagggtccaagttagatagggaagttctgtaagtgcatccatcttgagatactaaggctaagcactaagctagcaggaagcaaggtcagttaagcatcagcagctagcagtagtgtagtacaacctggcttcctaagaaaaagatggccagccagacacatggttttgaatggttggctccggtaattaccaacgtgatcgatgtaataaatcgtgttgatcacagctggtaaaaaaaagagagagagatgaagattaatttggtgagtttcttgatttgggatctaacaggtgtcgacattggcgaggagcagatcacactagttactgccgacgggacacgtgtaggctggttgtggaagagacggttaaaaaccgtaagatacgccactcttccgagtccaatacggtgagtactaaagatctacgtattcctttcgtacgtacccagctagctagcttagctactgcctattattcgattgatgtttctttcacccgtgtgtgcgcgtgtctatgtctacgtaaaaacgtgctttcttttttgtggaaaaggaccttccaatgataaattgttgataaagccaaaccactaattagcatagctgcagtgacaactgacaagggcatacttcactcagtcagatatacagcccattgggccgtaaacacttgggtctcactcccgttcagactgtttgatggcccaggtgtatctcaagcccatacgacactagcttgggccttgatgggccgatacaccataacaacttgcgctcaaagtgggaataagtgcatccaaggtctcttaacttgtcaacgaattcgattttcatcctgcaaccacaaaaccagatacaacggatccctcaattatcaaaaccggtgcaatataagtcccatggtggtttggaaggcggttttggtttacgtggcgtctacgtggctaaattgacccggtcttcatctgacgtggcaatttgatttggaaattaataaaaagagtgaccccacatgtcagctacaccaaaagaattaattaaaaatggtggagcccacgtgggctccacttgtcattcactcccctaatcttcttcctcctctctctccccatctcccctctcctctctccaggagctggcggttcggcgacgcggccggccggcggcagcggagccagagatgacctcggagacgaggacgccggggagctgcgcctggacggggacgccggcggtgattgttgttactggactcagagttggtgttgttgttgttgagctcaccgtggtaggagctgagagggggagaaggagagatggggcggccgccgtgctgcgacaaggcaaacgtgaagaaggggccatggaaggcggaggaggacgcgcgccaagctgctagcgtacacctccacccatggcaccagcaactggacctccattcctcagcgagcaggtcgtgaaaatcaacgatatcgccattgctgctaatgggatcgagcttgaggtgcatttgatcatatcagatcagattaaaatatggtgtttttgtttatctcttctttttccctttcggcgatgcggcgtcaagggaggttcggcggccaacgatgccgcggcgaccccccgtctgacctcctcgccagcgtcgagtcggtcgcctccgccacctcctgcggcatccacgtctccaagttctccgtcagctttccccgacgacgaaccggactccggcttctcgcccgacgacccggacctcctgcgcaaccgccccgtccccgaccggctcctcgtcgtctccgccggcgtcgcagccaacctcctcttcgccttcctcatcatctacacccaggcgctcgccgtcggcgtccccgtccaggcgcagctccccggcgtcctcgtctccgaggtcatccctggctccgctgccgccggcctgccgcatcaccgaaccgccagctcctggagagaggagaggggagatagggagagaggaggaagaagatgaggagagtgaatgacaagtggggcccatgtggaccacaccatttttaattaattcttttggtgtagctgacatgtggggttactctttttattaatttccaaatcaaattgccacgtcaatgccacatctatgccacgtcagatgaagaccaggtcaatttagacacgtaggtgccacgtaagccaaaaccaccatccaaaccgccatgggacctatattgcaccggttttgatagttgagggacccgttgtatctggttttgtggttaagggatgaaaattggatttgttgacaagttaagggaccttggatgaacttattccctcaaagtctcaatttgtcgccagattttcgtccttaaccaaaaatacaatccctcaacttacaaaacctatacaaataaggttcatacatagctcttttgactaggctgcttcatcctacgtggaattgacgtgacgcttacacgacaatttaatccggagaacaacaaaaggagctgacatggcagcagagacaaagtgtgggacccacatatcagctgagtcatgctggcatgtgggatcaccacatggacacatggtcaatcttcttctctactgtactgcccctaacagaggtacagaactggagtagtatagatcaagaaaagaatgacaggctcgtcttactttcaatggtacaaaaaaaaaatgtatataccccttgcatgcaagtatgcaactatgcaagctggcgggtccttgtgtatcactcattatcaggctactgtatagaagcaggttaaatcaatcgatttcagtaacaaaatggtcacttggggcgtgcgcagcgccgagcaagcgaacaccctccagatccaaaactttacggcgatgacgccctctgatcgtagctcccttgctgaactttctgctgtctgtctatcaagatgcaacctcaatggcacttcccagtggccatgctgcttccacaaacgcgttgctgtaagggactttctttaccaaggtcatctcttggtgagaaccaacacctgcgagagtgcaagagcaaaacaaattagtgataaatttgtgcaaaatctgtaatgcggtcttgattatatttagttttaacgagacataccaaatccatccacaagtaaggtgtactggtaaacgagatccatgcagatatatggaatgttatccttttggacaccagggtaggcagcttcggcgtccttcaagtttaacttacatgcacgcttggcagccttttcaaaatctgaaggtttaaccttagccacaggtgccttgggattcacaaatccagcctgagcagagaccagaaaattgtttactggtgtatcatcatggcaacaaaagcaaacatcttcagtagttcaacaaccttacctcagctgccctgtcgaagaaaaatgatgccacaaacaaattcttctgtccagcgccaccaccaccattccaaatgccaccaaaagaacatttcatgtgagtgcatgcttggtcaactttaagagctttcactacatcatccctgcattttgaataactagcaccagatggtgaagccgacgcttcaaatttgccattgccatatttgtattgccctacaatcacaatgcaattagaacaaaactatcttaccaacatagaaaagataaaattgcatctccaactattgtcacagattggtcatttgtgttgatgaggatttagatttatacacatcactataaataattctaactgcagactgatggttggaaagaatatcaaggaaaccagtaaggtatttgtttcatagagaatttgagggtaacctcatttaaaccaggttacgatccactataagggtgtgttccttaccacctcttcccaacttctatttctcgttttccacgcacacgtttgccaaactgctaaacggtgttttttttttttgcaaaaaaaattctatatgtaagttgttttacaaaattatatcaatccatttttttcaagtttattttagctcatgcttaattaatcatgcgctaatgggtcgctttgttttgcgtgtggcgaggtgaagttcccaacctccacctccgaatgcagcctacgcattacattcctcccttgaccaaaatatgcataagggtaacaacaattgaaattttaggaacaaacataagctacttggcagggagttaaatgatagcagaagaatatggtagaagtatgttactagtaccttgatgcccctccaatgtacagtagctgtaacctttgccattgccggcttttaagatctctgctctagcagccagcaacccataatgcaaatagctgtgaagaaatgtgtacagttatatatgtggttcaaagactccagactaaaaacaggtcatgtgatgtcatcttatacagcagataataaaaaagtaaggagtattaagtttgtggctatgtcagattaagtgtttgctgtagaacattacatagaataccacgtgatatttaggtagaatctttacacataaaagtacccttacgtttggtctggacttaagtttctcaaatttgcattaatacgctattcttgcatttttatcaatacgagatagtatcttagaggattacaacagctgtctgctttgcaaagaatataacctatgaattggcataggcagacatcagaaataggcatgacaatatgccatcagatgcttaaatggattttgaagattgttaccgtatcacaactgaataacttttttcttgacaatgtagcagcagccaaaagctcaacggtatttcatactaacctgtgaacataaagataatatgttgttcctttaagaaacagtttcttcacatatgaatcttcaccctctgatggtttaggagccttcactgcatccttctctgcaattgcatatgccatctgcacagatccacctccaagatcaaccactccaactgtgtctgcgtaagtctttcccaatttccccagcagataattgatggtaacctataaggatagagaagagcaacacttgttatcagttaatggactaaaagctagacatagaatcactagttgtgaacagatcctaaacactcaaaaggtgaattaactgtcagaacagtgcaccacatggattcagatgatctgcatctattttcagggaaaatgttgtttctggtgcccttactttcaatgtttagctttcgtcatttggattttgtttcgtcatttgtttctggtgcccaaattttgtttttcaaaaatgaaaatagttattttgcctaattcactcatgaaagcgaaaatttctctttttttatcatgtcctttaaaacttatatctttgaagctggcagatgtcagctctaagagaattggcagatttgttgctgaacaaaatagttttttctaaacaaaaagaacttatattgtcaatctgacaaatgtgaggcatttctaataatcaggagcacaaagtaatgttctgaaccatatgaataaatcaggccagttttgtacccattcatatgcgccttcctgaggtccatcaagaactgtaacccaatccggttgggtcttgaacgaactcttttcgcgaagaagatccctgacctgcaaaaattgtgagtgtattcaatattagggacaaccaatataaattcagtgatcgatcaaacaacaattaatcaaaggtgaataaaagcaaaatttaccgcttgcaaaatctcctctgatttttctgctcccaacgctcttagcccggcggtggcctgtgtgtgaattataaagcttattattagaagatgaccaagcagcaataggaagctctactggtatcgtacaagaactcaccccaactctaacaggagtctggccgcgcaattccacgggaaccactcgtttggcatcctcaaggagagagacgagcgatttggcagcctcctgcgggttattggcgtactcgctaagccccggctttttctgcaaaaggggaagtggggggaaattaagtaaaaatggattgagagatgaaaggatccctagcagatccagatccaattgggtggatggatcacct

SEQ ID NO: 5512 - DNA, 17105 bp, Oryza sativa
cggtcggcgagcgtgtcggggcgggcgccgccgccggccagcgcggagtaccggcgcatgttcttggcgtcggcgtcgaggggcggggcgagtaggaggtccggggaggagggcgtgcggtagcggatgcggcccggcggcggcggcgacggcttgaccgcctcctgctccgcggaatccagggcggagagaggtggatctgcgcggcgtgggctctgcctctgcctctgagatcgcagtggagagtataacgggtggggtttgacttggcggggatcgcgtcgcgtcgagatgggcgtcgtcgcgagctggaaatgcgtgcgcgtgcgggtgcgtgtgcgtgtgtgtgcggcgttgggatctgcggcgagagaggggttcgctgctgctgctctgctccccggcgagccgagcgccagaggaagaggacaaagtggcgggcttggaatggggacgcgacaggtttgctcttgctgacgacgatgcggatgcggtgcggtttgcttcgtgcgcgcgccggctcgatcgatcgatcgcgcgtcccccggtcaccggctttgcccgtttgccgtgcgtgttgctttcagagtttggctaatctgtgcgcggtccacgcgtgtaccgtgacttggtttggtacgatcgggcacgacatgttccttggatttgaccatgtgtatacatcaagaggcgaatgcgatcgatcttttgtggtttgtttatatatccagaatgcttttattttcattcctttacaaggcttgcctctacggcttatgctttttttctcttttacaaaattaaagtgttgatgaatattatttattccagaattatatattttgatttttactgctttttctttaagaggggttaatgtaagagacaaacgaccctgaatatataatctttcgacacgcaattattggaatattcaataattcgcttgctataattgagcatataagcagtacactcttgttgtattctttgtcctctcctcttatgcacgaggttagcttctcttgagggatatcttgcttatctatcatgaataacaaacgcttttctcatgatttcttcttgtcccatctacatataagataacatatgtaacctaacatgtctaccgaagagcatattctctcctctaatgcatgaggtaccatttataggcggacattatgttgtttgtctattttaggcgtatagatagtagatgattatacgacgaacaactccaatggctagtgtagtattatcgctattggcatttatgcgttcctatgtattgtattcaagttatagtaatccttccctttttaataatacctccatccagaaatatatgggattattcccaattgggtacaaattaaggaagaaagtatacaccaaatctgattgtgtgaaaagacatatatagttaacacgttgaatgatgtgcatagagtacatctttaaaaaaaaactactaaagtttggtaggagtgaatgaattttaaaatgcactacatattagtattaatgagtttgtgagagccttatatgctgaaatcagtttgttgctgcccttgttgcctcagtataacaaaaatcgtctatattcttggacaaatgaaggagaaataatcccctatattcccgggcagatgagtagatgtcgacaatgattttgtttgcaaaatgggaaaaaataagataaaacctcctgaaagaaaaaaaaacaaaaaagagatttgacaaaattccatagcccaggtatcgtgatagaaaattttgaaatacgttttgtttgcaaaatgggaaaaaaaacaagataaaacctcctgaaagaaaaaaaaacaaaaaagagatttgacaaaattccatagcccaccgagtcaaaggagttactaggccgagggcaaaagttgggccgtaatcggccagccgcgcaagaagtaaaggaggcttggactgcgacgtaaagcgcgctctgggagtctgtgggctggaagcctgcaagcgccgggtctgggaggaaggctgggccgtgttgtcgcgacgctatcacaggcacatgcttgaacaacacgctgggcttgcttttgaccgcgatctcactcgattctcttctcgttgacttgtctcgtgccattttctcgtctcttcgctgtatgcaccatgtgttcacgtggcacgcacgtgcaacgtttcatataatccacgcatgtgttccctttttgactcgtacaagtatgaatagtatattgcggtgctataccttttctttgcgtatcagccatctactgaactgcaagtctgcaacgtgatgcgaaaagaaaaaaaaagagctgcaacgtacgtgatgcgaggactgtatgaaactgctcgcttgggttgggccttaaggcccatcaatatcgagtgcttagtaatatgggccgcttcgctggcgccgctgtatacaaacgtgacgtgatacgtactagtacagctttgaacgcacctcgtcgatcgatgcaaagtgcgatctgcattaatagcgttgcgtctccttgccaacctcctctgcatgcggtcgcttcccaccgacgcctccatcacatcggcgcccgtcgcggtcaactcgaaatcaacataccaccagccgcgcgcgtgcagccgtcgtcgcatctcaccatcgcagccatatcctctccctctcccacttcgcctcatcactactccgttccctaaccaccattcctcgccatggcggccccggcggacgactactacggcgacgacgacgacgagtacgacgactacaacccccacccctacggcggcggctacgacatcttcgccacctacggctccccgattccgccctcccccaccacctgctaccccgtctcctccgctgctcctacggccccgccgcctaagccgtcgcctactccgcctccggcttctccaccgcctgcgcccactcccccgcaaacgcggccgccttctccgccgccgcagcagcagcagcctcggccggtttcgccgccgcccgtggcggagccgtactactggcccaagccctacgactacggggatgcgccgcgcgagcagccggcgtacgccacgccggaggtcttccggggctggcccttcttcgcgggggcgcgctgccactcgcggtgcggcggccgcgactactggaggcagttcatgcgggggctggattacctcttcggccacgccgatggctacggggagcgccgtattggggtggactaccacggcgtccccgtctacgccaacaggaagggaggcgtcgaggaagccgtcgtcatacaagtggagccgccggccaccgggactgtagagtggcaccacgccgccgacgacccggagtacaactacaacaacggcaatgtgagcgaatacaccataccactcgggatttttcacttcacttctgacttgctattgttgttcacttgctacgtctgctgtcttgcatgttgagccagcgcttatcttgggatgacaatgccaaagatgaaacatatgcatatgtgcagcacaattacagttcgtatgatcgctcttatgatcagtcttacagtcttgatgccgtttccgatgaaactacttggtttcctaatcagaactaccagcacgtgtacaaagaggaggaatctcagtatcaggtactaattaacttatcactgatcaagaagaatgaggtcaattagtcgtcagcctgagtatttagctcaattgcgtgcaatagtactgtaatttagttatgtttgattcatttttctgagaatatgctagctaatcttgtcagtggacatatttgacatgtaaaatgacagaaaatggaacgaaaaggattgtttattttgagggagtcgctttctgtgactagacagtttaatcaatgacacattagcgttcgcgaaaaaaatcaatgatacattactcttgtgtagcattcaacagatcctgcctgctatcttcgcttctaatccctgcttaatattaaatttgcgtgcaggaaatcttgtccagctcttgtgcagaaagtaagatttcagctcagcctatttattgttacaaccagcagtttagtgaacaaccgctacatgttcttgttgagcccccagaaacagtttattctcagaagttggagtactatgaggtttgtctgtcatctacaaatgctgtttacagtgtcttcatttggtaattatgcatttgcttgttcaggttgagttcatcaatctcaagggagaacactttttttttatgtagtcttgtgattgtcaattaaataatttgtgcagagcttctcaacatacaaccaccataacagcaacgatgattcagatatgttgggacattcatatgacatacagctgcccgatgaacatgtgccagatgaaccatttgaaccaattaagccttcttgggctatgcattcgggatactatcagtcctgcacagatggggcatctgctgaattcgaaaatgtaagttaggtagttatttcaggaattatgttgtaaaaaaaatatccaactgagactatctttttcacatttgatgttataccgatatggtgataccttgctgcttcaagatcaaagtaattgtattattgaaattttcagtggaagctatcgttatcacatatgttgtgctactaataccttcctgaggcaatattattttttctttaaactccttgagtgctacattttatcggaccatgaacttttttattggactatagctacttatgttttcctttactaattcgttactttgacttgcagcatactttaagctccagtgaattcagtggtattgcaagcttatttgcaacttccttctaccctcaacaaacacaaatttatgagtgtcatggagatgagaatgtttccttgcagcaaaattggcagtgcaactggaatgtggtttctgaaaatgatttccaatcggtaagcgtaacggtgtctatgtctgtgaacgtgcttttttaataccctatactcttatttttatcgctccattttactcctatttgtgtactgttgaatgtgtgtcatggtcggtacacatgtagttgaagtgctaaggatggcgcacagggggcagaaccaagcggcagcagatagaccatcaatgcatttgccgcacctatcgtacctccttagttgtttgattcaatttgtttaggttgagatttgttaaactttttaggtttgttaggggctggctttatttaagagagcttggcattatctttgaaattaagagcaaattacaagtctactctctcatcccctgttctctctgcctctccccttttttggtgctgcctggtgccatctcattcaaccatgggtagtaagactgttaacctatctagctacttcccactcctatcttattagatcactccctaacgcccgaatatattatattgttcttggcctcatgggtggctgatgacgatcaatgaaaacttcagacatgtctgtgagtgatgctttttttccccttgcaaacgatagaattatgaattagtatctgttttcgttttggatgctgtaaatttaaaatgtctggacctttatagtatgtcccgtgtatcctttcacattcttctgaaatatttatttttgctatttaatatgcaatccatgacacaatttgttttgttgctcaagaatggccatcacatgatctcatttgctgaagttcaaaatggcactgcttggctgcgattttttgcggctgcagctgtgcataatgtctgtggctgtggcgcacagccgtggctactagcagcagacgcagccacaaaaatgacagccaaacaagcccaatatatctctttcagatttagttaatacttggttgctctttgttccatatattctgatgttagtgtaacttttatccacattcatgatctaccacacttgccagtgttagtagtaattgggatttacttgccaaaagaataattctcagactccagcagataagtgaggttaactctgtctttatggtatagttttcttaacaaatcagcaatctcagtacccttgctagacgattttaatgagtgttaatagtttggttgtttgtgctttgctggtattgttgctagatttcaactgaaacaatcttgtatggtgcccgcatcacatttttatggttgaaacatgagtgtgcaactgtgcatgcgatgtctccatgttgtcttttgaactgaaatatttctccatttttatttgcagggttacgattccaaccatatgaatggctccttctggccgtttggagatcattcagcataataccacatagtctatattgttgtaatttcactcttatcttttttatgtacatttcatttaaatttacccggccaaatgtaaatgaaaaaaatatatataagaggttatgcaccaatgtatctaggttcagcatataatgtaagatcattgacgctgttgttgaccataattacttctttttatagtgatatccagtttctttttaacctgagaccataccactattatttacattcaaccatacctctgaatatattatcatattcttgtattcctgagcctaagactgttttacccatttcaggttcctctaatctgcaccgcaattatttggcactacatgtttgacttgcttgaatatataagctgatacctactgttatgctgtttcagttttctttgagtcctggctgaaggaattagcgtattgcatttcagaaccaaatgagcttttcaggatcttcacagaacatagcttgctctgcgtatcatttgataattggtacattatggcattcctgtcctgttttagtttcttatgtcagttgaatcattatgattgatgagcgcctttttcccatcttccttacagcaagtcctactcagtataatcctttgtcagtagaacttttttttcccaatttatttcctttgtcgccaatttggacgggatgagcatatttggtttactactttagtttggttttcaagattatgcagatttgtgtgaacacaaatcctgggtatgatatctggtacaagttggctatctagaaactgtttgttcttaactcgtcaatcaatcataccagcactctatacagtactattttcaaggttttgtaccatcatgaaggcttgatcgtgaagcaacaaaaaaagggatttggaagtagacagctacgtcctgttgtaagctgtaacttatgaagacgacttcccttttccaagcacaatctaatgatagttatgctatctcttttggtatctgctaggcccataggttgctgctgtcaaataggagatctattgtcgttaactctagtgtttgttggttgctattttcaggtcaaatctttgcaactctcctggacctggcccaattaggtcctcctgtcagggccttcaacgggaacctggagagcgaggaaccaataataaaaatagaagttctaaagctacatatgacggtatgttgaagttctgaagtatattttgaacttaagactggaaaacatcagagcggctataggtcaaccaatagcactaactgatacacaggtccacttgttttccatactatcttatgcttgtttagtggatgataatcaaacaaacaagccttttcttccctctacagttttagctgccataatatattttacatttcaaagctttgctactgattgttccctgctcttgtgaaggtgtatcgaagggtaacatctttctcctgtaattaaatctgctataatagcaggcccactcattggagatagatatgtttttgattcccactttcttttcttgaatcatgatcttttaaataagattaccttacccctgggaaaaagcaaagacaggccatagaaaacagaaagataccgaatggatcttaaggccatcatagctctctgctttctcatgtcacctagttgagtccctgtagttgccagaacttgtttgtaaacagttgaagaatgattgccttttacattactacgtatatatctgtaccttttttttttcctttacaactgccagtaaaaaaagtgtcaaaaaagttgggtcgaacacaaacagctgtcccgatccttcaatccttttagcaggtattagtgctactgttaagcaaatattaactaccgccgtttaggtagtgatgcagaataatgttttaatacctgaaaccatttaaggtggttgctagttctacccggtagatatgtggagtaaacattatacctgactacctgagtgcagttgaaaacaagtgacttccacaaagggtaaccccttttgtttgtgcacctcaacttacagcaagtttagccagttagtaggaatctgggagaagtccttatcagacctaaaatgcatgccagcatggaactaaagtgtagagaaagtaaatgcatagcgtattatgatcctttatttccttcctctttgatgcaccaaatagctgcgaatctatgataagacgtttcttagtagtgctagtggtgtaaacatacaattcgtttaagccttgttaagtttgactgttttttataatgaccatccacacaaaattaccattcaaaaattggaaggttgttttctatatgtaagttgttatagaatttcttgtgatggcttctttcccttgctaaatgaacaatatcactatcacagtaagttatctattttttctatgcaatataagtaccaacaaactcatttgacaggctttaataatcagtgtgtacaggtctaaagtggattatatttggaatcgtattgagtatgcaccatctatgcttgtttgcctacttgtttctgctgtagttttagttttggtgcatggagacaaggacgagaagcatttgttattgtgaacacgtaggcccatatgatctcatgattctgatcagatcccactattaattacttagtgtattattgaaaagggaagggcaaagagggagtcagatttataatttatacaggtggactaaagttgtcgtttgaatggagagaaggccaaagctaatgatatccctattctctaatccaaactgtaatgtgtattgtgtaggcaacgaggaatggtgacatctacagctcgacctgagccaccacagcgacctacctgcgtttggcagaatggcaggtatgtttccccccttgcccttttatccgtgtttgcttctcacctcctgacaataaaattcaaacaaatccgacaagttctttggtggttgcttatgcaaaaaagcatataatctcagcatatctgtcatagtctcatagaattgagccgtgatatagatttctagcttccatgtagcttcctcaagatattgcgatcttgtgaagatggcatgtagcatagcagtagtgattctagtgtaatcggcgagatatctccactgtggagtggtctcttcccgaaaatttcgctgtgtccagcaagggtccaattggtacccacatgggtgggatccggggtgggggggttttggttactatttgctcccatctcctgctgttgtctagtgacctgaactgacccacaaacacacaagaccatgaaaagttttcttgctctgtagtatgtactctgtactggtgtagtgccttgcaaatccatgctgaacaaaaaacaccgtgccgcgcccatgccccatcctttgcagacccatagccagcctgcccaggtctctctgttggactcacttgagctgcctctgcctgaccctgagacatgcagtccggttgcaatgcaaattctgaccggcgaacagcgaccacgagacggtgatgttgaagggaatcaaaatcgatcagcaacatatgcatgtgggtgttgttccatttcgcttttggatgtactccccagtatagtggtacgtacaagagtgacatcaaaccactgtttcccctcacgggttcatatgagttacctgttggggctgtacactggaggggcactgtcaattcaaaatcctagcatggacattgccaatttactacgagttctatgtggttgtccccatgctaccgcatcaatcgcccaatcaattacccaaaacccaagattggacagtaggttgccgcacactagcctccctgcatatgcaaccagggtagtgtctgttgtatttgcgcaccaaagtacggcataatgtatccgcacaattattagcttttctttatttttatcgtgtgctaagattcctttggattgattggatgaatttcatacgatttatgtcggattggaattcttgggaaattttatgtcctttggaacaaagaaataggatgccagaattcctatagattggcctcatatgaccctaattccataggaaaataaacatgagctcaaacatcatgtttctatctttctttgacaagtcccatgcacccggtctctctagtttctctctgtcattaatttacttcctctcttccagaataaataaacctagaatatgatgtaaaattacctagtaaatctgaataagagcacctatccagattggccatagtaatgtacagtattattctagtatagttggtttatttttggacggagggatatatgtttacttcctacttcgtccgtaaaaaaatcaattttttgaggaataatggacaaacatagttcgttattagaaagttctattttccgaagggtgtagggaacggacgaactgagccatcgtttcacttaattgcgaaataagcgaaacggcatatttgcaaatgaaaagtaatttgtgaataaaacttttataaacgtgttcttagcgatctaaaagtaaatgctgaaaaataaacttcgttgaaaaaaatctcaaaatcaactctaaatttaaggttgaaaatttaaattttgattgataagcataaacataagcgaaaaaataggcccttcaaacacccactatcatcgttcctgtgttttggaatccgattcatgtttatttttctgatcctgcattccaaaaaggttggtgacctgctgaggtaggtaatggggaaaataataaatgctggtgatggcaacggggttactcttaccaataagatcgctcacaaaaatgtcgcatcagggagaacaaagcacccaaggtacaacactgttgtatcagcatcaattatcaacccatcgatgccagataagctcctagattagggacctgcctacttgatcaaggaagggagcgcatcagcaaagggcatcaatcataattagtactgaaacaaatgttcctggctaatctcttgacagcgtccaggtcgtcatgagtggtcttgagctgatcggttggggttcgccatgttacccatcgcattcactgtcacgtaaaaatcgatcagtgcaccccacacagcattcattgggggggggggggggggggggctcccgtgcgctgctgtaccttttaatgtctgatgtttgcagacagtggcttgtcagccttcgctcgagcgctagtggttgttgatctgggcaacagacattgccactgcacctcccaccaagtagtttcgaaatcccctcagattattattgataggcacttaagtttacctaatccttccttaattggcatctaacatcttttttgctgtggccaattcccataaagtccctttgcctactgtacgtgtaactcaaaaacaattttaggctctgttggtctgcagtaggtccacaaaaatcaaataattaattccacatctataggagtattatgttaaatattttgccctctctactatgaccaccacccaagtttacaaaactgaacaatttatattttcttcagttactaaaaccaatttaaataccctccagccgtaagaacttttcctgaatcatacagaacaattaaattcatatgaaattgatatatgtgcctaaaggggcatgagaacttctcttacactatattggttttgtataggatggagggagtacatgacactttgtaacgaaagaatgaccctgttatacttctaaggtacagtatattcgtggcgttatacttctaagttatattcgtggcttcaactagggcaattccaaggcctggtgatgtagggatcagttttgttagtgagccgcactacagtgaatggctacgtgactgatttcttggctacatagaaattgatcggtagagccgtagagatggctgcgtctacctagcacatgagccgcagcatagctttgttgctgcagagcagtcacgggcagctgaaacgtgcaggcctagtgatcaagcgcatcatcggctcgttctcgctttttaaactgccaaataatttctatataaaaattattctaaaatattaaatatattcaattttttaaatttgtaataattaaatttcttattttgcgtgtcttaattttaatcttcagtatggctccattcttttgtgattaagttgtatattttatctcgatttttggtaacatgtttttcaagctgttaaagggtgcatatgaaaactttctatacaaaagttgttttaaaatatcaaataaatttatttttcaatttgtaataattaaaacttaattaattatgagctaatagttttcttgttttttgcaccctaacttcattttatcttctatagagacgaacacaaccttatattatattaaaggggatacatgaaactatcccgttcggacgggatgatcccttagagcttaaagatattacatgataactggatattagccattacctattaagtatcaagagataccttagaggtatcatattgtccgaacgagtatcagccaatatctatcaggtgtgaagcgatacctcgtagatatcactccatctgaatgggataccatattgtagcatttccctacattataccactttacacatgttttcgcacatgctagctgaagaaaatattcggatcttatgtttggctctaactatgttgaaagttcactatcgatattcctcttttttcgctatggaacacagaaataacacaatatccgtgcttttaaaaatcgtactaggagttgaggcactgatagctccaataatcgccaagaactcgtcaacgaagaacagaggggggggggggggggacaggcagaggcagaggaggaactgcaaggcaggcgtgggcaatttacttttgatgattgcgcatctgacaagagtgtgcaaggacaggcactgacatgaggcacatggtgctgaatcagtgatgaggggcagccatgttgcagctgtccattgggtgcactctggtggcccccattcctttcgggtctggttctttttgttaacccgactccttcaaaatgtactcctactactccctactttttcatcagttttgtcacataaataaaaagcccaaaacccgaacgacaattcacgcctccgtctccgttgtttcgatggcagtttagcagctgccgacgacgtcggccggagcggaggaggaggaggtgtttgaacccaacacaccgccgtgcggccgcgtcaaaaatgtgtgctgccgccgcagcatgtgcagctacaattgcatcgccgcgtttgcgtatcgtatcgtatcatcaccggccttgtcgtgtgtccccctttgtatgagctgttgtggtccgtccggtcctatgtttgacaaacaaaacatgccagcagtaaaaaaaaaaagtacgtacacacaaactagtcacgtactgtacgcactcctactgcagtactgcactagcacaacaaagtagcaaacagtggtagctagatcaagcgagtgactttggcttgtttgatcaacttaaaattatgagaaactgacggccattttggattagtatatatgacggttttgttttgaagccaaatcattggcattgccaatatccaatggatattttctatattctactcaatgcttggttctaacttctaaattggcctccaaccaaggccgtgtttatggggtgtttgggagagaggggctaaactttagttcacccccaactactctaaacttccaactttccatcatatcacatccaaaactttcctacacaaataaactttcaacttttttttctaaacttccagctttccccaaactttcaacttttttcagaaactaaacacagcccaaatacaactctaccctaccaaaatgttggtagtaccaaaacttgccaacattttggtaaggtattgaatcaaacaagccctgagaaacatgtagttgttacagttttttagtttctgacttatagtttattttttgaattgtaaaaccacagtttctcttgatccgaaaaatttatatacaatttggaggagtttctgagcttgggaaaagttagaaatatcagaaacttcctcaaacatattcagggactctctgcaattgtttgttttacactttcaccgttccttttggtgtgtagcagtagaagaacgggaggcaataatgtaggcaaatgtcgggtgtcttggtacgtaccctagctagcttgggtggtgcgggcactgcagtgggccaaacttttttttttttgtgtgtgtggcgtcccggttccagcgcagcagtcctgaccgagacatttgtctccaccagtgacaaatccgtcgtgtcatctcatgggggagctcacacacaaagactacgctacgccacaaatattgtctactccttccgatcgatcttttccatgcaaacgatgataccatgcactccttccgttctaaaatactatctcaagttttagaagtatactacatccctcctaaaatactttgttctaaaatgaagctatttttctatctaccttctcctctcaaccaatcacaaccattttttttcatctactttctcttttcaaccaatcacacacttttttcaatcattttcacctactttcttaatacccgtgccaacctcaaaaatgcttacattttgggacagaggaagtatatgagatcaacataatgctaaaaaaaatgattggttaagatgaaagattcatggagaagtgaattgtaagagatggttatgattgcttgagataaagtaaatatgcaaagatttaagttgtcatatttttatataaaatttaaatgctgaaaaaatttatatcttagaacgaattgagtaaggttgtgttcgttttagagtttagggtgacaatgtcttgttttccattagtgtgctttctaaactgttaagcgatgtatttttatgctcgtatatataaattttatttatccaataaacattgttaagtcaattataattaattaatcataagctaatggcttgtgtcatgaagttttcccctccatacgcccaaacaaattcagcctgagtaggaaaatttttttagaaatgaacttgtgccaattaccttcccgtacatagcactatagctacaatacttttttaaagagagagagagagagagagagagagagagagagagcatagcagcaatacggagcagtagttttctaggtgtgtactgtatgcctttgagacttaaaaaatttccagcaaagagaagtgcacagtgtaaacttgatgcatgtgttgctttgtccgtaatgattgatgcgcatttcacggcaaatttgagcaatctaagattgatcatgccccccccccccccagtaggttaagatactgtttagcatcttaaatgcagacaaaatggacaagatatcagctgtggacaaatgaactactcctagatcaaaaaagtgctgggcaatgaaggctagtcgtgctaatttcggctagtaaagtttatcagtacaagtagctgctacctaaggtcttatctttcggctcaataagcagttgagattgcaagtggatcatcacttcactagtaggagtatctttttttgaactatatattgatggatcacttcattatcaaattaagctgatcaaacctccttctatatatgcatagtacactagtaattaattagagagatcaggatactactctattaaagtttgcttatttactcagtatccgtgatttggttgggaggcaacgagcttataggagatctctcatgtatgcaagcatttggcgatctcatatataataatgcatcccaattaatacatccacacacagaatgtttcattttctgtcaacgaaagcatgcaggtacgtaagtaccctagctaactcaacttctttgttagtcattatcgttaagctcatcccccggataatcatgatgattttaaggccgcaagcaacataagcattgagtacgtatacgtggttgctaggactaggagtactctatcacatgcaaacccaacataagccgccctgtgtttgttgcaacgcgtttgatcgagcacacaactggagtagtagtaattaattaattagtgctggatgtggcaaattaaatgtgcgtgatgaatggcttgttaatgacgatgtctcacccagagagaccggcaacttaatgagcccagtgactttataacatcactgcccgtacaacacacattactctgtcataggcttataaattgttggatgtggatggatatattggatccggtctgaagcaaacgaaacacattacacggccggggcagcatccagccactacgggggtgtttaaatgcatgtgtgtaaagttttaacatgtcacatcggatattatatagggtgttgtatggagtgtttggacactaataaaaaaaactaattacataatccatcagtaaaccacgagacgaatttattaagcctaattaatccgtcattagcaaatatttattgtagcaccatattatcaaatcgtggagcgattaggcttaaaagattcgtctcgcaaattagtcgcaatctgtgtaattagttattttttagcttatatttaatatttcatacaggtgttcaaacattcgatgtgataggatgtaaaattttgaggtgagatctaaacaggccctacattgcatttgcatctgcatccatgcacatgggctgcagga

SEQ ID NO: 5513 - DNA, 27846 bp, Oryza sativa
  unsure (1)..(27846): unsure at all n locations
ccccacatcatatattcgacattgcgatatgagaaaagctttagatttcgtcgcacatacgatgctatggttttatcagtcacgggcgcaagtgaatcagttgtagctagtagcttagctaggttggttgttgcacaggctgcagctgctttgttgcgtgcaacctggtggaccatgctagctagtgtgcatataatgcaatacaaccagcaacagatgcaaggctccaacgttgcattgctgcatgtatgtatgtatggacggtacgtgggcctgtcacatcggcagcatgcgtgcaatgtacaccggcaaccagccggcaatggcacgtccggttgggatgcacgctcacgcccgcaaaacctccttttcttttctcccaattacacgaaaggcacatagtacacgtgcataaaacatacccgtaaatgtgtacttttaatgaataatgtttggttaagacccgctaaaataatgattttcgcatgtgactctcttaagagacctgtctatgaaaataaatctattttcacagatagacctcttaataaacatgcctaacacaaggctcgtcctcactccctcttattttctcttctcacctatctctttaaaaaacctccttactctactcggccactcccctctctccctcttatcctctcctcacccaaggccgacgggagcggtggcacctagggcagtgacggcgggcggatctgaccccagcagacggagagacaacaacaatggctcctccgctgctccctcttcctctccctctccctctcactctccctctctcttactctctccttcgcccctcatcatctttgtctctcaaactctataggctggcagaacacaaaatttgacaatttgaccctttccgaaatctaatttcgcaaatgaaacgtggccaaaacttatttcaaaaatgactcttttgttcaacaccaaatggtacagtgctaaaccatacgatttggcgctaaacaaaagggtcgtttttcaaataagttttggccgcggttcatttgtaaaattagttttcaaaaagggtcaaatagtcaaatttaatgctggcagaagcacttgaggatagcagcgggtccagcggtgcgtgaggaggtcggcaaaagaggcgcacgttgacggcggcaatgatgtgcatcgacattactagcggtgttgcctccttggggcatctccaccgcctcaggagtgcccaaccccctcacggatccatcactgtcagtctcgagtgcagcagggtctcgacaacaatgacggcggctgagatggtttgagctagagttttgactttttgaattttcaaaaatgtactctcatatagtcatgtatatcataaattgaactctgattggtaaatttgtggacacactattgaccattacaccatcggtattttcccgacctcttgtttcattgatagcaaaatttgctaaggacatctaaactttgtgtaattggctggaagacattgcaaaatcgcatatctgctaatggacaccataaaatttgtatacttgactgtaggacaccgaggcaatattttatcaaatttagacataaagagttgaaattttaaaaagacaaaattacccttagcctgattgaaccatcgcaaccccgaaccctatacccacatgcaccctaccctaatccccatccaaagaccctaaccctaggcgacggcggtggcagcgagagctggcaagcagtgctgggaagcaggtgatggtcctgatggaactgaagtggatagggctgagggtaattttatcgttttaagacttctctcccctagttttgccaaaaatgataaagtattatctcgggtgtcctacaaccattacataaattttgtggtgtccatcaggcatcagcagcgacatgattttgtagtgtccctcagtaaattacataaattttgaatttcatgaagcaatgtactaccaactaggagttgtagtcttatggacaaaattctgtgcttaatcggctataaattaaacatgtgtactgcttgaagctttgtatccaagcagtactggatggatgaatgtcaaacaaaattctggcgggaatcgaactgaattgttgtaatcactggtacaagtactagtactaaaactaaagcagcgaccgtatgatgatgagtcgccgtccatttgatagcaacacgaccaacaagttgcgttgtagctagcccgcgtcaggtcgtggcatatccatccatccattcatctagctacacaactatacaattctagccatccatctgtccttctccccatctggcctttcaattagtcctctctcttgtcgtctgcgtctcctccaaattatatatcttgtcgacaaattggcacttagcaattaggccctctttagttaccaaaacaaaaaaatttcacccatcacatcgaatgttcggatatatgtatggactattaaatatagaaaaaaaaccaattacacagtttacgtgtaaattgcgagacaaatcttttaagtctaattgcgccatgatttgacaacgtggtggtacagtaaatatttgctaatgatagattaattaggcttaataaattcgtctcgtagttttctggcggaatctgtaatttattttgttattagacaacgtttaatactttaaatgtgtgtccgtatattcgatgtgacacctcaaaataaatttttttccatctaaactgggccttagcaacaaccatgctctcatcacttaattacgagctagctatagccaagaaccaaacagcagttcacacccatgattggcacaattaatttactactaatcataataattaatactcctagctatactaatcattcatcccatgcatgcatcactgagcttgcatacgtaccagcagctgcatcagcaggaagaggaggagatcgagctggatcatccgttgtcgctctcgaacagagaacgtcgcaacagtgacaggttcttgattaatctatctattataaaataagcatgcaaaaggaggaatcaatcggcagatatgtatgtgtagaatctagcatcgacataacgattggaggatttgtctgagccactcttttgggtccatgaccatggtgaatcacctaatcaaccccacttgtgggatcatttgtgtttgtatatctaaacaaggttctcggaacagaattgttgcatcaatcatatgctcctgtccatctaactactgactatatacaactgcagatatatttactaactttccaagtggattcgaccagccaattcatgaatttggaatggggaagagcaattctaacttctcatgctgccattccgcaggataaatcatgtcgggcatatctatttgtcagacatcttaagctcggtttccctcaacataattctactttgccaacggataattattatagtgtcctatcatattgacataatttcatttatcaagagtaattaattaggatatctatttcatgttttacccatattaaatatctttgaaatctctcactttggaaactacacaagcagttcccattcttttctgactaacatacatattttaccttggtttcatcagcacgttttttaaattgctaaacggtatatttcattcggaaactttttctttaaaatattagataaatcctcttttggattggtaataattaaaattcagttaattatgcagtaataatgttttttttattttccgtgccttaacttcaacttcattttcaatagaaacgaaccccactttacaaggggtaaactcgcctaaaaacgtacactaatctcgaacggcataatgcttcccggaaaaaaaaacataccctgactattccagtgatactgaatcttacagtttgctgtttgccaacctgaatagcgaacctcctgaagccaaatatccttgagagatccgtgcaaatgattcgccagttgggttactgcacccccttcttggtcacctcaccatcatttttaaggccgtgtaaccgtgttcgttgaagttggaaactaacccctcgcatgcatatataatacagagcgatttattagcatatactccccccgtcccataatataagagattttgagttttttcttataacgtttgaccactcgtcttattcaaaaaattttgaaattattatttattttatttgtgacttactttattatctatgttactttaagcccaacttttcgttttttatatttgcaaaataaatttgaataagacgaatggtcaaacgttacaagcaaaaactcaaaatccattatattgtgggacggagggagtaattaattaaatattagcttgagtattttttaaatatattgatatgattttttaaaacaactttcgtatagattattttttaaaaaaaatgtaccctcgtagtttcgaaagcatgtgcgtgcgtaaaacataggatggagttgggaaagtcaataaacgaactcagtataaaagctttaccccatgaaaaaagaaagagtagtaaactagtaataaggcaccaccagtgcaactacttctcgcagctaataggtagccaaatctttatgtatggtgcaaagcctagataagccctttccatttcctaaaagaaagcctacagaagctttgaatcccaaatgttagatggatctggtcaaccggaaactaagtgacaattaaattaacagcgaccaaaccaaatcggagcacgatcaaattaacagcagtaatggtccccaggcaattggtgccgaccagagcagtgttctcacggcgccaaaaaggctaattcgatttaaaaaaaaacatgcatagtagtagaagggctcggcgtaagtgagtgaggaatatttggttgccagcaacgcttttttaggctgtgttcgacacccctcgttcccgaccctctctccctcgttttttcacgcgcacgtttttcaaactgctaaactgtgtgtttttttaaaaaagtttctatacgaaagttattttaaaaaaaatcaaattaatcaatttttgaaaaaaaataactaatacttaattaatcacgtgctaatggatcactctgttttccgtgcggagggaatgagttcccatcaggacatgcgaacgcagccctagtagtataagattagaccagtctgattaacttaaataaatactatttcctccgttttacaatgtaagattttcttgcattggtagattcattaatatatatgtgtgtgttttttcattaatatctatataaatgtgagcaatgttagaaaattttacattataaaacgaatggagtagctactatatggttgtagctaaagttatagctagcttccctcttagtagtaataaattaggttctatactcaatgaagagaatggcaaaatcctcttaaaagggtagtaaggactttgatcatatactttctcgctcccaaaaatacttcatttttaatctcacacatatagatataaagctgaaaagactgtaatactgtgcacttttaacaaatttaaatgtattaattactctaaaagatactccctccgtcctaaaataagtgcagttttgtactattcacgttcaacgtttgaccattcgtcttatttaaaatttttttatgattagtatttttattgctattagatgataaaatatgaatagtattttatgtgtgattaaatatttttaaatttttcacaaatttttcaaataaaacggacagtcaacgttgggcacggatatccaccagctgcacttattttgggacggaggtagtaaagtcttcgtgggacaagtgcgatagacttaaaaaaaagtaggctgtgtttagttggattcaaagtttgaattttagttgaaattggagatgatgtgactgaaaagttgtgtgtatgacaggttgatgtgatggaaaagtactgaagtttggatctaaactttggatctaaacacagccgtattgttgcgagggaggtagtggcattaagcaagtacggtaaattttgtttgcagataaccttctgtaccataaaaaaaagaaccagagatttttacccttctctaaaaagaagtgtctctatttagagatttctctacttagatgaataaatcatactctcttcgtctctgagtatttgatagtagttagttcgtcttttaacaaatcaacgtcaaatagaaaaaaccaaaggtaatatgctagcagcaaatagtggctgacaaccatatagtcgtagaatatgcgtgtacaacatggtctcttgcaaggtagagtagctacagtgatggttgccggtgcagttgctttcagttgagcaagtgggtaggagccgtagtagtagttaggtgaatctgatgtgctaaaattttggggaattgaagattgtggcaaatggcaatggacatggcaatggcaaaattatggcaagtgaggaggaggaggaggcagtgctaccctgtgctcccttgtgttgctccaaaacaccgtcctttgcagtagcccaggctccttaactgcagcatctattacttcattacacaaccatcttgcacgtgtcctgtccatcctctgcatatgctccatgtcctacagcaacaagagatactacatactgggtgtatccagcactaagatttccattttatttttaccacagtgctatcttcagtatctccccaattctaaattaacacatatatctattcagattgatatatcaaatcttatattaaagttgtttattttaaggcgaatggacttgtacataggagtaaaatcctagagattttttttgggtcagaatcaagtgtatgttttcggtacaaacacaaacctgcattatgatccatcatacaggtcatgatggaagttgtgcagccatgcatccgtgcgaaacaaaacaatccgggagattgttgttgttttcggggaaatttggtggtcgttttcgaacagtaggctgatttgaaggaagaaacggggagaggaaaggtggtggtgagctggactgaaatcagcagcggtggtgactgcaaccggccaagcaggacgacgttgctgctgctgttggagtcactcttggactgatacggcggccacaggagggaccacgcagttggtgacgacaagggatccggagaactcgcttcctccatgtgactatccatccatcattcgaactgggaggagcaaacttttctgcctgccttgatgaaagctcctcccctccacaatttctcaatctccccggaaacaaatcccctgtaggatttctgaaaattctatatgatccatagtagaaattcgatttcgatcaggtgtttgggaaccaaggattataaaaaaacaaaaaaaacgatgagaaccgctttttttttctggttttcgttgacttcgttgtggatcgagctgacaaaccagttggtaaatcttttcaatttttaaaaaatcaaataaaatttagaattttgttaacatttgtttaagtttatggttttcataaaaatagacaagaccactccggagtggtattcagtgaatgattttgcgaaccatgtgtgagactcgtttgagtttcaaaaatttttatggaattaccatgctccggtctaaggtcatgttcatttttttttcttattgattattgcatgcacgcttcctaatggtattgtggccgagtttagttccaaaatttttctttaaactttcaattttttcatcacatcgaaacgtcacatcgttccaatttcaaccaaacttccaattttgacgtgaactaaacacaccctatatttccttgctaaaaatttcttcattggtatatattaggtgatgccctgcgctttgctgcaaatatatgttatataatgaagaaatgatgaaatgatttgaattgaaatattttaaaaatgatttgagaatgatgatttatcatgtatatgtttagttttagaaagaaataaattatggatataattactatatacttgcatgttaagctttgtgtgttttaatgggttgatgtgatatgcttgtatgtaggttttaggagtggtaataaataccatatttgcatgtttatcggtcattagtgtacattagttttatagaaagaagagatttcgtagaaaactttttaaaattaacttcttcactttttaaatatttaattcattctggttcaagtgtggaattatactacttcacttagagcaggtacaatagcagactataagccaactataaacatattttaaggagataaaagataagagataagagcagcatgctaaagatttgtagccagatgcagcacggacttcaagatacacgtgtatgacaggtgggaccaaacattaattatttagagcaagtttaatagtatagccaactaattacatactacactattaatacctggtcccatctgtcatacacatactgtgtcttggagtccgtgctatagctggctacaaatctgtagcccgctgatattctctctcttcatttatctccttaaaatatatttgcagctggcttatagcctgctattgtacctgctcttataagtaactattgtatgaattgtctattaaattgactatatgtgatttggagcaaataattagctatactattaaacttgatcttaggattctggtcagaatgggattaaatcctgcgaactgttggtgaaatttcgacgaccgagacaacatatgcccaatgataccgtattgatttgttttgtctgttccatgcattggttaggctaattctcacgctaagtggctatagtacccccgcactacagtacagtgattactggtcatgttcaaaactcaaaagaaacatgttggtagagtgaatctgaacaagacgacaaatgatcctatctctcatcagttccattgtataggagtcgtagtagcaggagtattcaacatttctacggacgctctcgccagcacaaaattgaatcagacaagcagtatactatgtgctaagagcaagtttaatagtgtagtctactactagctctaaattatctatagccaatgtaatagtcaattcatacaatagttgcttatgatagtattaatatctggtcccacctatcatacacatattacgtcttggagtctgtgctgcagctggttacagatctgtagcccgctgttcttttctttcttttttttatttctttaaaatatgtttatagcttacttatagtctgttattgtacctgctccgatgacacaagcagttaacagtgagaccgctccgaatgtccgacattctgacgaagaagatgttactactagtcctgattcagagtttttcaccgccaaaacagggaggtaaatgcatgttgactcgtcggtcagggtaaagcccgtacgcttaggaaacgagtcaagggattcttgatgacagtgagaggttaaaacccaagagtacttccattagctatgctagtaattactgctacctgccgtgccgatggagcatccgggtggtgttaaattggattcttccgtttggtggagacgaaaacgatttgggagagaattcgtatggaaaatcttctatactagtatacgaggtactagtactacagtacgtagaagcagaagctgaggaagtgaagtggagtagtactcgtacagtaggcaagaacaaagctgcgactgctgcggctgaaaacgacggtgcaacaaaagcgagcgaaaggcgaaaggcgagcaatctgtagtatctgctgtgtgtggcctctgtattatctgtcgcttccgttccgtcatgccaaatttgccatggtagattggtagtagcaaacctgcagccttcgctcgcacaaacacacgcaccatggcatggcatgccatgcaaaggcgcacgcacaggcacgcgcgtgcgcacacaaaagtcggtggaacgccaaaagatgagccaaaagctaaccgggttgataaaaagtccaccagttgcatcaacgtggtacccgaccttgtttatttactacctttccccatctagtctaatctaaccttacttagttactccttcagttttaaagtataactatttttatatagcttaaaatcttatattctaaagtagagtaattagtaaacacataataaaatatagacacatatcctctttcatcaaactagttatcgttatctatttttcatgaccgacaccaaatacctagagtttgggttaggccattcacgacggcctctcccttctcaccttagacatcaatgtggcgtccctctctagcacagatcggggagacaggccgatgagcttagcggcgtggagaggagaacgacaagcttgctggctagggttcgagcgggtgcggcaactactctctccaatgatgaccgttgtagcctcgcatggggtgtagagttgaggcgttgcacaaggccatgaaagcgcatggccacgacccccacagcgtggccgcgctattctcactcatgccgcacgatagcttttctgacaaagagcgtgtgcccagtttaggttacaaatctcgttcggccccactccgagccaagctgctagagaatcttctattatcatgggttgatcgaatgccacatatgtgcactgaccttatagtttgcgcaagtgatgatgggaagaaatgtggcattatagattagtagattagtagaaaaaggatgtgccttggatcaatggaggcaacaagaaagttagcaacaaacagttgatgagacaattagaaacagattaacatggtgcagagacgatgataaccgattgatggttattcttccaaggccatcaatacaatgttgcgacatggaaaaaaaggaggggagcatgaaaatcatgcgatttgaagatcaaattataaactgttatggtttgatgtaggagcgttgttgaaaaataagggatagtacctagtgtgcgggtggcgtaatagagattgagagctaggataatgattaaatgatgaataataaggtaaggtggaaattgtaaaaatgtacacatgtttatttaagtgttacaggttcacccaataggatagccacacattaaaaatcaggatattgaatccggtacatcttaaatctacatgagcaacatccaaaagataggagtatgctcataggccttcatagagaagagctaacctcacactcatcattgctcttctcctcgaccattgaggtcagtgagctacgatgtgataatcacgaattgagatcgcatgattaagaaataggataatgtcataatcaggagatcgtcgggagaatgacggtgacacgggcataaggcggctctggtacgacaacagattatatcagtttttcttcatgtaagcttacaccatatcttatgttctcgtggtttgatactatgcaatcgtctttcttttctattcagattcattgttaaacgagtagctgctatatttcgggagcaagagaacaatagtactgaagtactacagctcccatcgaatggcatattcactcaaagaaaaagctaatttaaattttcaaacttaattttgacattaattttgagatatttttaacgtagtttttttttcagtattagcttttaagtcaccaagaacacatatataaaagttttatttattctctaataagcttagcttattagaaaaaagccaaacgataaggccctacatgaattgatcacaatagacgccctggccttgctgaaatggtaatgtcacctgctgtggttgacgtggcaactgcgtatcatgcatgtaaagccgatttactcgagggagggaaatggaaatggaaatagagtgccctgatcacaaagacagcagcgtcgtccacccaacaacaaagaaacaaaacaggtggggccccacccgtgcagtgggtccctggggaaagtgatgtcgaaattatcccccgtcatttgtttattggatttgtgcatgataggacgcgcttctgtggcgacggaccgaaagcgaccgtgtttgtttgacagggaaatcagacgcagccattgcattttttgcaattcctcccccctcaacccacaccacccctgcataattccaattccaaccggatcatatgcacttcctaatccctcattagtagtactaaactcaaactcgcgtgaagagttgagatggattatgctttccttctttttttcttttgtctgaaatctgaatgaactctctcttctgatcgccatctcgtatccactgtagcagttcatttttcagagagacacccatctacagttaaaaaaatggtgagacaaggccattcttacggggaaacccgcagtttgaaggcataaaaaaagagaggcaaatggcgtcgcagcgtgtgaaacagtatccctggggacagagacggggtttaagataatccaacctcatgtcgataaatatgatttctcatggggaagtgtgccatcttatcgtgaaaggccctcatctcatctcgctgcagcggccctgcggtttttttgcagcagcagcggcagcgcagtgggcagaaaggacaaagaggaacgggacggtggctgctgcagcctcgagaaacgctcccctcacctcgtgtgggtccctcccggtcagcaccccatattacggccgtgtcactcatcaccaaaaagctcaaaatcatgtatctgacgtgggatgtttgatcggacgtcggaagaagttttctacacgaatgaaaaaataatttcataactcttcttaaaaccgtgagatgaatttttttagcctaattaatacgtcattagcatatgtgagttactgtagcacttatggctaattatggactaattagacttaaaagattcgtctcgcaattttcatgtaaactatgtaattactttttatttttatctatatttaatacatatgtttttggaaaaaaaattgataactaaaccagactaattcccctattttgttacctcattattctcgtattccccttttattaccgtacggatcctcctgcagtagactggcgcaattaaatctccatcttcttgctcgtacaacgtaaatactcgtctcgtattccccttttattaccgtacggatcctcctgcagtagactggcgcaattaaatctccatcttcttgctcgtacaacgtaaatactcgtactactactgccagtgtacagtaagaggaagagagtgatggagctagaggctggagtgcactggagcggatcgagccgagctcagctggaggagctggagctggagctcgacatgtataaaaatggggtccacggagatccagatctatccaacgctccacgcacccatcctcctcacatcaggcagcaaaaacaaaagcaaaattacttacagcaaaaacaaaaaatttcaccaaaaacaccctgaaagaaggctcaaaattacaatgcaaaaacattttcgcgaaaaacaccctggagaaattgtggcatcacctgtcactcccccggccccaacaaaagcaaggggcaagccaagtaaagaaaggagtagtatagatcgatagggatgcagcgcactagtacgagtactacttctactacatagccatagcttagcttcttgttctagctcggctgcgagcgagctcttcttcctctgggggaaaatggagctcttcctctgctcttcactgcctcagtggcgccgctcccactgatctctctctcgtcttcttcttctttgagcttgctttgctgcacactctagtggtggtaatagaacacagctcagcagcagcagcggagcaagaagccaagaagccaagaagcaacgagtgttgtggtaaagaaagcggaggaggaggacgaagaagctcgattgcttgcttgctgtggagctcgccatggacgcctacgaggcgaccaaggtggtgttctcgcggatccaggcgctcgacccggaccacgcagccaagatcatgggcttcctcctcatccaggaccatggcgagaaggagatgatacgcctcgctttcggccccgaggcgctgctccacaccgtcatggccaaggccaggaaggagctcggcctcctcccggcgtccgggcccgggacgcccacctccgtggcggcggccgcggccgccgcccactcgcccttcatgctctcgcggcagaactccgggcgctgcggcaccgcgccctcgccgctctcggtgtcctccccctcctcgtgggcgcctcccccggtgttttcgaggaacaacagcatcagcaatggcgccggggaggagatggtcggcctcggcgacgagctcatcagcccggccaacggcgggggcccgccatcgcccttcttcggcggcgacccgctcatggacgagctccagctgcaggaccagctcgcgttcctcaacgagggcggcgtccccgcggggcaccagatgcccatgttcgacggcggcgagtgccggagccccggcggaggcgacggcggccttttctcctacaacctagggtgggcgaacggtggccccggacaccgccggagcgcgtcggtcagcgagctctgcctcggcggcgccgacggcctcggctggaagccgtgcctctactacgcgcgcggctactgcaagaacggcagcgcttgccggttcgtccacggcggcctccccgacgacgccgccggcaagatggacccctccgccgtggagcagcagtgtcaggacttcctcatccgctccaagtcccagcgcctcgccgccgccgccttcccctactcgcccaccggctcactccccggctcgccatccgcagccaccaagtgtttgagcttgctcctccagcagcagcagcagcagaacgagagccagaggtgccaactttttccacctccgagctcctcctggagtaccagtatccctttaacttagctccgattccgtcgatttgcagggcggcggcagcggcggcgctgatgctaggcggcgacgaggcgcacaagttcatggggcggccgcggctggagcgcgccgacttcgcgagcatgatgaaccccggctcgcgccagatttacctcaccttcccggcggatagcaccttccgcgaggaggacgtctccaactacttcaggtagtatactataatcccaccgcccaccgtcaccgccatgccatagctttaatctgatgatgccctctcaattgaagcatctacggccccgtccacgacgttcgcatcccgtaccagcagaagcgcatgttcggcttcgtcaccttcgtctacccggagacggtgaagctgattctcgccaagggcaacccgcacttcatctgcgacgcccgcgtgctcgtcaagccatacaaggagaagggcaaggtccccgacaagtacaggcaagccgagcttacttacagtccacattgcctctctaggttgatcccctataaccaatttgtaacttgctgttactttgcaggaagcagcaccagccgggcgagagggtggacttctccagctgcactactccaactggactcgatgccagagaccccttcgacatgcaccagctcggtgagcttttgcgatcatcttcttcatggtgattgggtgaatgattgttgctgaaatcgcatgagtctgtttgtaatggtgtcaggtgcgagaatgctgcagcactccaacagcgcgaatgagatgctgctgaggaggaagctggaggagcagcagcaggccgccgagctgcagcaggcgatcgagctccacagccgccgcctcatggggctgcagctgctagacttcaagtcgcgcgccgccgcggcgccgacccccattggcaatcctttcagcgcttctcagaccgccgccaacgcgaccggcgagtcgcctcccgattccggtaggacctggtgtatccgaccgaacgacgtttcacctgttgccgcgccagatgcagtgttgctaatgtttaccatggcggatttgcttgcttataggggagctcggtaagggaagcggcttccttcttgctcacaagaaggcggtcaacggagccgataaggaggaatccaccggagagtcctccagccctaacacagacagtgaccaaaggtggaattttgcgattaacatattgtctcatcgtcatcatttaatcatttgttattttcgccacacttagctttcgtccagcaatgcagacaagtaacatttcaccaaactgatcttttttcctctgcccattgtgcttgctctctttggcagtgtggagcataatctgccggacagcccgtttgcgtcgccgaccaagtccgcgggatttgctcgcgatcctttcgctcccactgaggcggagatctccgccaccgcgtcgactggttgtagcgccacctatgttggcatcaacaatggcgccagcaatggcggcactaaccatctcctaccttctgccttggacatgccctcaccaaaaccttatttcttccccatgtccaggtatgcatcataataatgtatggccccaagtgctattttagtattgcaaattagtacagtatgcatctgggcgccatgatttgctgagtgctatcattcattcatatgcatgcaggctggcctccgatcacggcgcgatcggaatgtaaagttgttctgaatggaagtgagtaatactactactgcctaatcctagtaagcacctcagtcctcttgcctttccacaaagtctatatcaagctctcaactccatgcttcctagtattgaatcatttgcttttcaccccccattggaatgatggtgccttactctcttttcctctgtccttgccatcacttgccccttgcaggaatactagcagcaaagaaaaagagaatagtggaatataggaaaagagtggagaagttgcagcatagtgttagtttcagtcacccccctttttttttactttccttttctttttcatttttcaagaagatagctttattaaaccataaagagaagaaagaggatgccctggcctccagaagagaagcagcagcagcagcatcaatcaagccaccaccaaccacaccaccaatgttttaaaatgcagtgccattcagataaaaatttagagcccctcctattactaccatatcatatcaccttagttaatcttagttactattaccacccaccgacccaccaccattgatgaattaccccccaaagctcttgataagctaccaccaaaatagccactagttttatagcattaggggtgatgtttagccacaagactagtactagtaccaaccacaagatacatgtaacactactactgcctgattgcagctgtgtgcaaggcagtgagtacagcagatatgtaatggacccaagaacaagtgacaggtttgagtgagagagagagagagagagaggaaggcttaattagctagtgtagtgtatgtaaaatcacaagaagatgaacaagtcagtcagtgtaggtgtgatgaaaggggaaggaccactcactgctgatgctgcaccattctgttgtgccaatgtggagatgtgtcagcgttggtgttcatggtccccctgatcagcaaatgcagtcccaatacaagaaaaaaaaaggaagtttctttttttcttttataatttcttcatggccttcgcctcataccatatgtatttctctgaatgagttgaatcactcacctgtcccaattgcgttgagattcaccttctccggcgacggtggccgcctccatggggcggtgctggtgccggggtgggggtcggatacggagaggaacggcggcggcggcgaggcttgagttgttcttgccgtcgccggcgccagcggtggcgcgggggtggggactgacggcgttagggcttgggtattgtttacctttgggagagtagagtattagagatcgtagggtaatccgagatttatgcggctggatgtttaatattaccactttagatttggtattatttaagaactgatgttttttttcttgctaattttcatttttagtactttgtccactgtagttgactgtcatagaaagaagaaagggaagataaaatttttagaaataggttagctttggtttttaccattatgatgccgcctaattttctactgctgcctccaaggtgagtaggactacatatatgttcccactctttctaaaagaagattcggtcgaaaatgggaattttaggagaataaataaatgggcatagtagctctgctagtggtaataacgcattattaaggataaagaagagggaaggcgtaaaagtggcacctttggtgacatgcttttggggatgctagtgccaacagccacccccagcgtcaacatccagtaataaaaaagaaatggacgtgaatacgacggtacaattaaaatactcccaagaaaaacccacacaaacaagttatcactccctcaatcccattttaacacagctataagtgttggtgtctaactttaatcatctatcttatttatttattttataaatcatctaataataataaaaatactaattattaaaaaaattaaaataagataaaacgatcaaaattagatatagaaacttatagggaagttctactacttctactcccattattgtgatctcctgtaaataaacttgttgcagcagcagtggtaggtttgctccctacattcgcagtgccaatcatcctatgaataaagcccaggtcaaagtagtaaaaaaaattaatccattcgcgttttcaccgcagcgccggtgtggtagatcgggaaaagggggtggggggaagcaagcgtgggtgtggggcccaggatgtcaggcgtgggtgacgcccacgtgtccgtgccgctgtgtgtgcgtgcatccgacaaggacgctacactgggccgggcccatttgctgccggatttccgcggagcacatcgtctcgtctcatcgcatcgcatcccatcccagatttgttgcagcagccagctacccgcccccagctactgcactgtacgtgtacggtgtacctgtacacgtagtaactttttccctttgtcctcttttcaatcagacgcatgcaatgcattgcacctactcctactcgctgtatagtagtatactacagtaatcactagtactagtaaaaaggccgtaacttttgggcgtgtccgctgttcggatgcacgtgaatgcttgcagaggggcgcatcatcgatccatctttcaattactagtgtggaccagtcaaacgagggcaatttgcaggtaatcaccctgccttaggctctgcttagagagcttctagctgaacagtttagtttttggttcacattatgagaagttgtagaagtagaataaaaaaataaactaaaagtttcagattatcagaagctaactaccaaccagctgcttttcagaatcttaaactccctaaacaaaccctaatcaattaacagattcagcacatcaggagagcagaccggctggatggtacgtatccgtggctttgcagtttgcaggagaaaggcacagtggcctttcctgaatggctgaatagtcaaagcatcgatgggcagcagacagggttggccacgcttgggctggttaattaatccaagcttttctctatcaatgaaatatttttaatgaaaatatatccgtccatttgcttggcaagtgtgcgtgtgcgtgccatgttgttgtgtggcacctcactggagggtacactacaggaggagtattttgatactagtactagtgtgtgtatgatacattggcaccgtggtcgagtcgagagagatggggctttgcatgtgctccccatgtgcccactgccctgtgcccatctccggtttgtccccctctcgctcaccctgattcaatactactacaagtattccttctttttttttaagacataagtgtgtacaagtattattgtttgtctatgtatagtacatctcgcatgcaatgtatacggatggatggatcgatcaaacacccctgttattagttgatttgtgaccatgcatgcgagatctaatccatggcgttgttattggccacagcggctgcatgctcatgtgtggcgacgtacgtactactcctacgtgatgaagctgccggcataaattttccggcgacaggacaggcaccagtacggagagcaacgtaagataactctgcatacgtgtgtgtatagatccacgtcaattagtcgcaatactaactacgtcctaaaatgtagctatttctagcacagtagtttgtcctaaaatgaagctatttttctacctaccttctcctgtcaacctatcacaatcattctttttcacctactttctcttttcaaccaatcacacaactttttcaatcattctcacctactttcttaatactcatgccaacctaaaaaatacttacattttgggacggaggaagtatatctcagtactatcattctatcgaaatgtcttgggtgatgaaaaattactccctccgtctcattttaagtgcaaccataattttccgcgctcaattttgatcactatttaattttttttatataattagtgtttttattgttataagatgataaaacaagaataataccttactcgtgacatatgtttttattttttattaaataagatgaacggttaaagttaagcatgaaaaactatacctacacttaaaaaaataggatggaggtacctagcatgcatttccagcagaatagacggatggacgatggatgtgctacgtccaacgcatagctgcgactacagctacagatggatggagactatgccgtcgctaccatctccgatggccagaaaacgaaagggatacggataattaattattcgagacgaggtatccaattttttcttggctttcttatcacccgagactaatccgatatttccctgcacaaaccagtggttcattattcggattacatctactactctatgctcttgcacggccaattcggtctctccccaatcagcaggctttcccatgtctgtctgtccagcaccaacaccaccaaagataaaaatcatcatctccacctgataaaagtgtggaacctctcaaagcaaaaaacacctgaaacctcaaggcctgtagcttgaggttttgatctaaacaggcccttagtgcatgcaaaagcagcattttttttcctcttttctgaatcttcacctgataaaaagtataaaaaacagagagagagagagagagagagagagagagagagagagagagagagagagggatattgggctcctgcttctgcgacaaaaacaaggcctgacataagccgccatggtagtattgtacaatcagatgtgtggtcttgatgatgattagtatatgatcgaattgtattcgtgcattcccccccacagacaatggcgaatttttgtcccagtccaattcttcccatatgaccaaaccagttgcatccccttgcactactgaaggatgcattttgtgagatttcttaaccttgaaaggcagcatgcagttaccagtactgttttccaaattcgagacaggctttcatcaatgaaggtggtagtactccagcacagtgatactactatattcgatcgaggaaagaaaatcttgtttgtttaggacataccagttgcaaatctgtctgtccctgcttgcttctgccgctcgcttcttgtttatcactccatctcccccccaactcgcccttggtacgtggttcgctgcaggtttccgaggtaagtaaaaattaacgagacgaaacaccatgcaagctactagccccgtgcgcacgggagaccgcgccgtcgtcttcttcgtctcggcgatcgatctgttcgtacgttcgttcgtggtcgtctgcaggttggtttccttcagacgcacggggacgagtttgttctctaccagtactactactagtagacagtctacttatactagcagtagtatatatcagctgtgtatttttagccgagttggggttggagtggtgtgtgtgtgtgtcggcgtttcttggcgggcgaggcgttgtttcttgctgtgtacggtttccatgtttgttttgagtatgttcatcgctaacgtaacgactttaattgctagctgctcctgtttttgcagcaaaccgatgcgatgcggatgcgaatgcgaatgcgaatgcgaatacgagtcgtctttaattcgttagttgatgcggatcgagctggattagttgttcacatgcatccccatttattagggctatctcccctaatataatcctctttgttaattttgagggacaatcacaatctctctggtcgaaactaatccagcgcggtgtgtagggctgatgaaatttgatgccagcccatgagattctccttgcgtgttcaggtccatcaacaggatatggcccaatctaagctgggtttaatgtttccttcctcgagaaacggatgaactaagcacaataaaagcccaccatgtgactgcaaaactattagcatgtgtttggttgggggatatggtgggatgggttaggtccattcctgttatttgggatgggttggacccagtttctgtttggttggagggatagaacggaccctgttttttgtttggtttgagggatatggtgggtcagaatggttctatcctctgtttggatggagggataaatgtgggttgttttggtggagatatctcctggtgaggttacctcacatatgaaattacttggacaaaatctccataaaatccaggataacatgcacaagtactagaaatacagctatgtattagttcccatgatggttttgacggttagcccacatgtcatcagcaagtccttgtctgaactgaaccatcaatgcatggtcatttgcttgcccaaatggctctgttgtggtctcacttattaaatctaatggatctgtaataaactgatcaattccatcatttatgacccaattatgaataatgcaacaagctacaacaatatctacttgagttggataagggaagaatggggtggcatcatctagaattttgaacctcctctttagtaccccaaatgcacgttcaactgtgacacgaagggacgagtgcctaaggttgaacaactccttctcattttgcaccggattattcccccactctttcaagtggtaccggacagcacgaaatggagggaggaatcctggtttggctccatatccagcatcaactaggtagaattttcctatcatatgatggagaagttggtcacatttctattgagatggagaaaatgatgaactaaattgttctattaccttggggtacaagaaggccattttcacgttccaatgcatctcttaaaactacaacatcatgtgctgtaccctcctaaccagccaagacataagtgaaccgaagatcaaaatctatagctgccattacattttgcgtggcatgagacttcctaccacgaaaatagggctccatattcttctcaacagaggctctaatatgtgcgccatcaatagctccaatacaatcctattttatattcaacaccataaaagattagggcacattgaggtttgttcaaatatataattgaaaatgagacacggattaatctcacaccttaaagtaaggatcccacctagggttcccggtaattttacttggggtgtccaatgagggaggcctaattagttcatctcgcagctcaccaacagcatgaaacactttgttgaaataacgactaactgtttctccggacctatcaaaattagtgcgaactaatctatttctaagattgtgccctactgtatttataaacatagctacttgttcctcaatagacatgtggatggtatcttcaagcaaaccacgatttctaaagagcttacaaaaccgaaagaaataatcttttctaagtctaagcatgtcgacacatgtggtatcgttcctccaaatttttgtgtttagatactcaattctcatcctatccctttcaacaattgggccatatttaacaccttccctcctagaaactctctttcttttcctagaatgaataatcatggccatcattgacaacaatagattggcagcagcagcaaaaattaaaatcttggtcctcttatccatctacaacaacaatcaaagaaaattaaacacattgccatgtcattctcaagcataaatcatctcatcataaactacttgcccaaattacatactaatacttgtttccatcaggaaaataagtactatgtaaaaattgatgaaaccccaaatcacatactaatacttgttcccatcaagaaaataactgctatataaaaattgatgaaaccccaaatcacatactaatacttgttcccttcccatcagggaactaatacttgcccaattcacatactaatacttgttcctatcatgaaaataactattgtgtaattgatgaaacaaaaatattgcaatgtgcttgaacagaagttgtggacagcaagggcattcatgcaaacggagtcgcacagatctagcattataaacaaaatagcagatatggtacatagctagggtttcattaccttggctatggaggtgagggggagctgacggggcgggagaggcgggagttccggccgtgggactggaaggaggaggcgcagcagggcccgtggcacgacgccggcgccgccgccctctctgcgccgccgcccccttgcgcgctagttgccgccgccaccctctctcgatttggatttgtttcgcttgtgattgtgaaggggaaaaaggtggtgagaaaagagatagggttactctcgcgtggtctcacgtgatgcgcgagaggaggtgggatggatcggtccgccacattttgccgagcgagaccaacccgcatatgggcagaatattccttttttgacccaacccagcccacacagttcttcaaccaaacacctgtaaaaatgggacggctctagcccaacccaccaaaaccttgcaaccaaacacacgcttagggtactccctccaactattttcattgtatcacttaacccttaaactttttattcgttttaccaataaattgttaaaaatgcttcacttatttcttaatagtatttgtctctttaattttacctctctatacacatcatttattttggagtcgaaaatattttcatttgtttatggatgtttgcttgaacttggtgtttaaatcagttttaagtacttccaacctatgtaaacaatgttaaaaagatctaaaagaaaacattgaaacatagtataatacatctatcatctttatcaaatttctacgaaaaatacaacttacataggaggaagaaagagagaaatactattacagagtaaaataaagtgtagaacaaactgaaaaaaatttacagggttaaatgctccagcaaaaatagtttaacttaggaggaaaaaagaaactgccgtgcatgcgaacatggcagctggaaaagtttcttcgctgcagttggatgaccgaacaacccactagtagcttcagatcagatgcagatggaagaaagaaagagagccagatcgagagaatgtcaacgatgacattggggggagggaaaaatgatcacatcacatgccggcacatgcgctcgccgccgggtactcttggtacacgaacttgccctcttgaacaagccggcaacccttgcaccctttgcacgacgacggcncaggccagcacatcgcctgcatgggcgccgccgccggccacccgccgccgcggcaggtgccgcacccaccgcagtacgaggggcctccgcatgccacttcggcgccggaacgccgccccatggcgggagctggtggtggtggtggccagggacgaacgctggcaacgccgccgccggggcttcgcactgcggccactgcgggtggacgacgccggcgccccagtgggtggggtcgctgcacggccacgggtagcagatgccgcacatgttggtgaactgcaggttcaccgtcgtcgacgacggcgccggcgtggccttggtctcctccttcacctttggcttctcctccttcttctcttccttcttgccttcctccggtttcttctcgtcgcccttcttcttctcctcctcggatttcttcttctcctcaggtttcttttcctcaggctgcttcttctcctccttcttggcctgatccggcttcttctcctccttctttgcctctgcaagcttcccaaattcaatgtctttgatgaccccgcaggccttgcatcttagcttatgggcgagctcctctggcttgaaatggcccgatatgatcaccctattgttcgagttctcataaacgatgttaatgatcttctccttgtctgcttcatgttcgttcaattcaaaccacagcttaatcatatactgtaccacctttttggccttacgccacaacttagttatgggattaaatttacataattcagcaagtgcattgatccatacatacctttgagtttgttaaggactttctggatcttcttgcaacacttttcacactcgagatttgccttaatgatcaaactggccatttgctataaaagcatccatgcaatacaaaaacagagcttaattctgcaaaaaccttaatgcatatgcaacctttgctttgcagcaaaactgtggaagccagaaaggaggaccaaggactcaccttgtctgccatgatggatccaacaatataatcctaacaaagttcagcaagttcgagtggaggcatgttgccaaaaaggagtgaaatttatagggttgttggtcattgcaatactataatcgactagtactttacattgcggtcaatcgtcggtgaagaggagtctaccatgattggtcacttcaacgtgctgaaacctaatccctcttattcaagtagaagattccgaacaacaacctagtgctccataattagagagaagagtcttggaagcccaagttacagagcatataatggtacgtctgtcaattttcggtttagtactaaaaaaacatgctagttgcaatggtccacaaactgaagctgattaaaatggggcgccaaatcgatatgctaggagtgtaacgacgttcgagcttctagtgacagactgacagacagatgttcttgctaatcgatcactagttaattaaagctgattaacatgttagtagacattagctagctagcttgatcagattcatcgttggtgaattctttaatggagagattgctgttggagttcaaaccattctggagtcttgacccgtaccctccttcctttttcagcaacataaaaaaataagataaattttgctataggacatctaaattttgtgtaagttgctgataggcattgtaaaaaaaatatgtcacggttgaaagacactttaaaaaactagtaatttacttcaattcgaaagataaattcttaagaaagaagagaatgcccatataacaacatgcttcaaatataacgctagagtaaaaaattaaaaattatgcaactccacatttaccataattccaagtacatcactagcatacatcgtattccatcctcattgcaacttcagatcaaaagctttcgatcctagacattatcgtcttttagaagaaattctctccaatcgagttaaaattatcctccagcaaattattaatttttaagtgtctttcagcaatgacacgttttgatgtctactaacaaatcacataattttttattg

SEQ ID NO: 5514 - DNA, 5967 bp, Oryza sativa
cccgtgtgattggaatcagcaatacaattagcaacccaataaaagaggtgaaacgtgatcgatgaactgtacgtacctgatgacactgacttgcgttgtagcttgattagcaacatcaggcatgcatgcttgcatgcataaggtcgtctaacaatggtcaaattaagcaggttagatgccactagatagctggcataaagtacaattataaatgatccatgttagttcgtctgatcgatcatcaaacgctgcaccaaccgccatgcatgcatatgctgattagtagtaattatctaaaaaaattctgattagtagtacttaatatcaatccagatggccgccggccggccggccggaggaatagttagttgcggatgtctgccgagattgccggcgacgatggccgatgggtcccaatccgaccgtgcagtgctcggactctcaccatggtttgtaccatacgcagcgcgtgacgtgagacttaattgttgcctgctccctcggtcaaaaaaaaaatcaaactgtgggtttccgtgccaaattttgactttccgttttatatgaaatttttttataattagtattttcattgttgttagatgataaaacatgattaatactttatatgtgacttatttttttaatttttttcataattttttcaaataagatggacggtcagacgttggcacggaaatctacggtttgcattttttttttaagacgggggagtatagacgagacacgtcctcatgcatctgtggttacagtacctgagtcaactggagtcaactcaaaaccgtgggcttcgatctgcttggtattttcgctggcatacaaatcgacaatcaaatccatccactgctccatgtgggacacgttaccgcatacgttgtcacaagagatttcacgtcccaaaatcacatcaccggtgcacgaatttggtactggatagtagtggtttatatactcaaacttgtgctcacgcagcctttcattttttttttaataatgaaacttgtgctcatgcagcctttcattttttttaataatgaaaataaattacatcttgggtctccgtccatggacacacagcacactttgtcctcactcgtgcgcactacccatccctaaattgctctaggccaaacacgcttaacatcagagttctttagagagcggcttccggaaaaaaaattacaacttgttaatatgagtattctattaatcctattaagctctaggacgggatgtcacaataggacatgaaaaaaaatgttgaactaccataaaaaatgctacatatactcttttaataagtaaataaatattttttatgtcattatgtaagaataaattttgccataaataatgccttgtataataaaatcatgaatataatagtcttatataacaaaattatacacttccaacaatatagctagtctacaattttcaaatttccttcatatgtaagggcaaaatgatcattttcatagggattaaacattcaactaacgggatggatatgaaagggatcaaaaccaaaatttagaggtatacaagggagtggacaaaactcgggggtgtagaagagattggctaaactttcagaggtatagaagaaattttctctaaaagaaattaaaagaaggcctttcatgaaccatactctccttcccgcacgtaaaacggagcacgtattattgtatgattaattaagtactagctatttcttttttcaaaaatgggttattttgattttttttaagcacatttcatatagaaactttttgcaaaaacgcaccgtttagcagtttgaaaaacgtgcgcgtgaaaaacgagagagggattgggaacttgaaggtaagaatacagccatgtggtgtttaggaaggaggaactaaactttagttcctctaaaaaaatataagttctgatgggaggaagctgcatgggtagctattcgatcggctattccttcatgtgcaagcgatgtcaaattgtcaatcactggaatacatgtctcaatccaactgcacccgatcagctcaacatgcgcccaatcgaccactcaacaggcatgctgattactgagttttgtccgttgtgatgatagctagtgtacatacagtgcatgcaaacactggtacgataacatgtcactctaaaacacagtagcggtgtctcaattggattaaggcccatcaaccaccaacctagctacaccgcgagacccatttgtgtgatatactgcgatgagccaatgaagtactactacttactatacaaaagccagttagatgaagttttattgcgagaataagttaacaaaaccgcaaatttctgccgctgaaaatcgattagaacatgcatatcatcatttccactgtactcgtgtatggtaaactgcaaattactgctcaaaagagggaacttgtgtatggtacttcagtggtatattttcagacatacaaacatcaatatatatcctacagtatatactaccggggagttattcaaaaccttcaattctatgcatggagaattcagatgtgctagcaaatatagtttagggtaaatgggcaaggttaggctgatagtttagaggcagctcatatgtctaacttcaggctatgtatattcagtggttcacattgatcacaatcctatgctgcctaatattatccaatagcaaggccgcatgagctagctggaaagcataaacagagcgcattgcatcaaattgcctcaccgtcacagcttgctccaatgcgcggttggttctcttaaccacctctggacattttctgacagaaaaaactaatcctctctagtagtatgtgacatgacaacgaacagggaccattttagcactaagatgggaagtggccgatagcacatttagcaattttcaggctcatatatcaactgcaactgaagaacatagcatccttaaaaaaaccaaatatgcgattgatgataaatcagagtggtgtgctaataaaattttaattgatgaagtctgaaactctgaatcgacaccgcgatctgccgtccagtttcagatctcaggagtgacaaattagctccttttcggttgttcgcatgctatagtttactgttgaacaaacctaactaatatgtagaatgcaaggtttgtgaaagggcatatagcctagtggttgcagtgatctgagtagcactctaaggtcctgagttcaaatcttcataggagcgaatttcagattgggttatttgagggctagttccctgttcgataggctaagttcctaggctaagttcctattaaaaaaaagctgtatatatccggttggatatagaggccgggtaaaaaatacccttctccagaaaaaaaatggaatgcaaggttttggagcttgacacggtgatggattctaataactcatttagatgacatgcaataaacgagtgaacgcctactcgagctattaaaacagttcccgcttgacacccttgcctctattccggaactacacagcagcatacctgggtgaccgcccgcgtctcacggcggggatcaccggcttctcaaaatgcgagttgaaaagagtgagaggggtcttgtgcactgtctgaagcggcgtcggccggcggccgtgggcgagtactcgaggcgagaaaaataagggccggtttggtttgaaacttaaattaggcttgtcaatatttaacaatttaaatagtgtttaatgtctatttggtttgaaaataggccatttcaatagtgaacttaggctattttggattcaatccaaacacaactttaccttaccaaaattagtcatacaaaaacttgtcaaaatttagcattgacaaaatttggtaatacctatttagccctcaaaccaaaccaacacaggcttggcttcggagtacgcgtcggactagtgtacggcccagaccacctaaaagcccaacatacttgccagttgcatgctacatacggattacggtccatttaatgttcgggcttactatctttggtgctaagcggcccatatgaagcagataaccggatcgctaagagaagtggcgaaccgttttttcacaattaaaaccactctcctattttcacaatattgaacatgttggaggagagtaagaacgaacgaggctggaagctcagattacatctagatcatacttttgttctgaaatgtttaagaccaaaaatataaagaggacatgaaagtcttgatatctcagatacgtagaccttatggaaaatcaatctcaagcttaagttcaatgattgtagctgcatttctcccccatgataatactctcactgtcccaaaatataagagattttaaatatatgtaaaatatcctaatactaaaaatctggacaaaatctattcatattcgtagtattaagatatgtctcatccatctaaaatctcttatattttaggacggacggagtacaatttataatattcatatccaaatttcaattataatgaatgaatcaccaagtgaggaagaacaagtcgaaatgtacagtagaggttaatcacagaggtgtcgaaagcttccaatagcagactttccgtgtgaagaattcgataaataatccatgtacaacaactaagaaccaaaaaacaatgactatcaggattacatatatttacccttattggcagaagaggaagggaaaaaccgtcatgaatcgatggggcgtgaaacacagccatgagcccgaagctcgttgaataccctatctaacaatctggacagtgccttcttccaagagaacgagtatctggacaatgaggctgacacccacctttacttgaagactcattcatatcatcaatacctgcaaagcatgtagtccccatatttgagactaatcccatcgcaaaaaaaatagttaatcaatcctgtcaattaatgaatagaacatgctttgtccactcttctgccgacatttatgaccaacgatagcaacccttctcctgttccacagctgtatttgtagtcgtagtgcacaataaaagcttttgggagctatagcatccagtcagtacgccacataagggtgagactcgttgatgcacactgctatcggttggtctgattcccaggttcaattgtgtcagtttgtcagggaattatgttgcactcatccatgaatttatcgtctcgagttaggaacctcttccagtatctcctgtagcttggtatacctaattcaagccaaggtttcatattgccattgtagtgcaatgctgcagaactccgtgcaacgtcttcatcaattgcataatcatatccaagtccagatagaatcaacctctcatcaaggggataaatgaggtgttggaaagataacaaacttagaggaaaggctgctgctcgcagagatgtctcatccttcgtcaagaactgcaacacaacagagtcagattaatacgtgcaatataatagtaaccatgaggtgcataaaaaacagtgggacaaataattttcagactgagactggaaaaacacaagtagcactacattatctttccagatcaccctttgttgtgcccttttcttatcatatgctatcgcaagaaaataaatagaccagaactataccaacctttttcagaagcagcaggtagttctctgtaactttgtgcttcctccatttatccaaatttataacatttattccagacatccatgcacatgacttggtatcaactgttgtactacccaagagatttctcacttgacccagtcttaaaccacaaaattcgatagcaccatttaccttgtcccccatatcaagagaccacaagaaagaaagatcacgttgaacaaccacatcatcatccaacacaaccaccttatttagatccttaaatatttctggaatgaagaaatgtgagtgactaaataatgatagggattccattcttgtcttcc

SEQ ID NO: 5515 - DNA, 13834 bp, Oryza sativa
  unsure (1)..(13834): unsure at all n locations
tcctgcagccctgttcttagatagtatgacatagtgcctaccatgtgcagcactaaatttgcgagcagaagaatcatttgaacccagtgaagaggatgtgaaatactctaatgtcaacctcatagatagacagtgatgactcttaggcaacgtctgagcaccaaggttgtagaggaatgcactctgcttcatatgaaagtgagcttcatcctcagtcatgtcaagtatctgacgaagtttcctgtcaacatttcgacaatctacagtgcaagattttgctctagctattgtttgctccatctgctccatcttcttgttgatactgaaatcaattgataaatatcattaaaattatgaaagtagacttatatattgatgatgggaaaattattcatcggttgattctatactattttcagatgaatgcacatttttctcaaaaaaaaaaaactatttccccttaagagataaagagtttaaatggcattgtaatttgcaagatatccagatccagtttcagtaacatataactgcaactttaagatgacaatgaaatgaactgtgaaagaccagaagagtaagcaccagaattttaattcttacaaggacggtagatcagcatcaacagtcgatacactaagaaccctctcatggtcttgtatgttttgcttcattagcacagtaagttcctcctgtccttcaagcttcgcaatgcttggataatatgagcgtgccacaaatagttggtcttttagccttttcacaatggagtccttcatgactactttgtgttctctggaccagagacagtagctaccaaattcaagttgacaagccttctcattttccacttcatctgtgtttgtgcctttgtctagtctctttctaactttgctaacctcctgaaagcaatgcatgctcgttagtacctcttgttgaaaaaaaaattctcaggaagaaaaatagagcgctctatgagaatgaagctatcctcgagagatactaggatgcagtatatttagcattgtcctaaaattttgtccttgaaagatactgggacacagtatattttcagcattgtcctaaaatattgtccttcaaacatacagggacacagtatttttcagcatcatattattagaataatggcatgttattacatcagtacgactaaaaggaaaggtaatttttggcgttattgcatactatctacaaatatgtgtttgacctgaaaatatagcatttgataacttctagcatcataatacttactactactgttactgcaggaccttagaattccattttaatgactgaacgtgtcacaaaagtagcaaaataaagtacaaattcgaatgctagaaagcatactcttgtgccttgagttgactccttcacagcctctgatgggtcaacttttggtgagggaagaactgtgtatagatatgaaaaagaatactataaatatcatacagaataaaagaccaatcaggaataactggaatacagcatatagacttcttaaacaaagagcagcagtgaacatattgttagtatcacaatgacaacattgtttctaaacaacatttgcatctagtatgtaaagtaaagtattgggaaatggtgagaagcaagagcgtgggactgaagaaaacttgagttcacatataatatttaggatgaaggaccatgcagttgaaattatgtccatatataaatatataatcttcatgttactatcactgttctttgtgtaacccgaaatgctagatttcctgttaagtttaccagattacttcgtatagcctataaatctataattcatgaatgacatgctagcattggcaacattttagtcacatctaaaaaccttagctgcagaaaatgaactgaagagtaccttttggtttagtgctaatacgggaggtgtgtcgatcagtttgcttatgcttctgcagccctccgctgttaactttgggcgtcttctttggtgcatcctgaaggggggaaaaagaatgtgttagtgttgcagatgcaaccacacaacattggcaattcaccaactgctacaaatactaattctaatttttcatacatttttgcaaactattttttcataattcatgaaaaaaatgtttaagtatttcccttgagaggcaataaccaacaaggatacagtgttgtcctcggaaagctaacacgctagacttaaaattcacctctaagttgcaggtagcaaggattagacaagtatcagtcgtcctggccactcatttattacatcataggagtagataatgcgagcaccttacgatgcattggcaccaattgaggtttcagaagcaaacaacatttacaaagcagtcaccatcatcgaacaggatttgcaaatgcgaacctgattcagtccattgacagtaccgtcaccatccgccttctccacgtgatggaactcaggcaaaacaacctcctaaaagccaacgcgaaatgcaataatttagcgcgcgacgcagccttgtaacacatcgaaatcagaagtaggtgcaggagaaggagaatgggggggttaacagttgcgggtacctgtcggcgccgctcatccgtcgtgacgtaccctgcatcacattcacagtcacagacaaaccaaatcaaacaaaattatccggcggcagttcgaaattacagaaccacagagcaatcgaacaacaagtcgatgcccagatccagcggaagcggcactgatccgagcacgagggggcactgcattcccctcccccaaaaccctccccactaaaatggttccagaaaggcgagagggttacgaaccggattgagagcggtcgaagaggaaggcgaggggaacgagcagcgagcagaggaagagcgccagcacggccacgcgtggccccctccgcctcttcgccggcggcggcggcggcggcagcagcgtcgccttcatcgccacctcgccccactactgacactgctcatggcgaaccgaatgcttgggggaatcgaagcggttgcggtgctcggccacactccgcttggatttgaactgaacaacaacaactcacaattcacaactgatcgatggatggatggatcgatgggtgggtgggtgtagtgcgagtgcgagtgcgagtgcgaaaggggagtggagaaagatggggaagaaagaaagaaagaaaaagaaaaagagagagagaaagccaagccgttgagagggccagcgtgtgtgtgggcgtgacgtggggtccagctgtcacgtgatcatgccaagttgccattgccaaccgtgtgctcgctgctgggccggaggcagcgtgggccgcccgttcgaggatgggtggcctgtattggtaacgatcctagctgggccgaaattaggatcgctgccattgatagctatccatattccgcccaaaactgaacgtatcgcaccgggaagtccatgctccatcgcagccaggctgtgtctgacactagtcttcactgaaaaccaactagaaacaaaaaagaaaaaaacttgatcatatttgaggctaggagcagactctgattcttctacaacgaatcagggtcactggatatgatgatccttcaaggccaaacggcactagtttctaaactctgaacaagcagaaaaaactgaatgaactaaagatcagttgttagtgatgaacaggtgaatttttcatacggataaagagggaaagaagcctacactcattaccactaaattttatatatacatcatttgagaccgtatatgttcctagatatggggttactagcattgacaaccaactggtaacattccttcagatctttaatttcacataatcatgtagcagccattcttcttgtacaccagaaaattgccttccagattgtccaacatctcgacgacacattctcttttcgacccattgaagtgcttgacaacatcctccaacgaaacctgcaacaactaagatcatcaacgaggaacaacatgaattccaatcgaagaaaattcagaaaaaaaagatgtcttaccccattgcgtccttcaaccagttctagtattgcatcctctgtggcaccgattgcggcagtagaatttacaccttgcccgtctatcttttgtagtttacttgctggctcatcaccacaaatcaatgacccatcagtttggcctctccttgtcaaagggcttgcatcacaaacatctgcgccaacttcacctccattggaggtggtctttggtgcctctgatgtcttggactggatcccatcagtaggaacagtaccaaaaacttgatccgacaatccaagtccctcaattgccaagaatgtctggatcatctcataagttacctgcaagtatcatgttgcattttgccaggtaaattaggccttgggaacgctttggatgaactaatatctaacttggcagtgcataagaagcagttgtttgttgatgcaacagatctattagatattaacaacagtagtctaatcatgcatggaggaagggttacattttctggaagttcatctttgattggcttcaacttttcatgtgatccaagctttgtaatggcaagacggatctgtgaggctatctcatgtgtaagtcctacctcctcacaaaacctactccagtccatctcacatccatctcgagcagcatcaagtatgtaggaaatgactgttttctcttttattggtactgctctgcggtaatgctagaataaaccaggatgttaagcagtgaacttaccaaatggatctatagcaaacaaaaacaagggcaactcaccgcaactttctggaacgaaaacttcattttctgccacaattcccatgaacaaaatttcgcgccacccaaactccttgggagattattttgtgtaggttttggagcagcaggtatactttctacagccgataaatcatccacaggaagattcaattcttttgccaattgtgtgatattttggatgaaaatactgccgtaatgcgagatgaagtgctgaaaaccaaaggtcggacattatgagtattaagacaaaatatgatcacatccgtcgtattttccagtagggtgcaccgcaaaaaagtttagtgctctgtgttatggcataaaagtgtgttagctactattattttctgaagtgatacctggttaacaccatcaatattagccaacctagctatggtgctaggcctgaacttcgcaaagtttcttagtgtctgatcaccacatatagcgtacctgaaataatggattaaagagattcaattcagtgttgctccaataagtaaagagcctagaaacctaaacctattgttgtcaacatttaagtatttaactcacggcgccgttccaatatcttgtgcaagttgcatcctgacattcaagagtacttggtagattttcaattcatcctgaaagagatccaaaatgagactaaagaactctaaaataatgaattttacaaataattcctctgagaaacttacctcagaaattttttcagattctgatgggcccaaaggatttaagccctcttctttacactgtgaaccaccatgcccctctagctcaatcatctctgcagtcagctgtaaaaacagcgatgctccatcccctttatcagcagtggatagaaacttgtacccattaggactaacactgaacatagacacaaggaatcagtgagttgtggctgtttgagcattcatgcttgggttaactggagtcaataaattcgaaatgagctagcaaaatagaacaagtagaatattatcttatgcagtgaaaaagaaaatagtcagcacagcacctgatggatctaaatgtatcatggacagtctccttcaaataatctgcacacagaataaaaagaaataacaaatcaaagtgacaatgaaagacaggacaaattgttgtgacacctgatgaataaattcactcactgtagccattaattaacagtacagcattgacaaaacgatactccgaaatctgaatttcagtgctaagagacaatttaagaaataaacatgtagaaaaatacagatcttgagctctaaaaaaaaggtctctaggaatgaaggtatacgagaagaagggtatcccaaaaaagggtcagatgaaatgagctattatggtgcctactctgtacaaaatatgctgtttgcatccgtgccatatgatcgaggacctaaggtcatgaaaaacactacttttactaaaagaatgaactgcagcatcacaatgtttattgatactattattttaaaaaaatgcaaccatttattttctccaagaaaacgacactgtacatatgtacaaaacttcaagtcagcatacagaacatgtatcttagcttgcacaagaaaatgactaaaaatatgtagagagaggcatacgatggtaccatgtgctaaaagcaggccgccaagagctttccaccagtttggtggatagtcttttccccgcccatgcaatggaagtttatcaaaattgttttcaactattttcttgacctacaaaatgagaaaatacttaccatgaaacataatcctttacaaaattgttactactgctcaaggctaaggtatttttttcaaaaattattagttgtatcacttatatcttattatcttataatgaactaatttgtgattatgaaaagcttgaacgatcaccaggatagtgcagaaaatataagacctaaatatacattccttgaaatattctattcacattgatctttgttcccaaaaacattatcagcacacaggtgatcttatccaatcaagtgctaatggccaatttatgtcacaagctggcaaaaatcacaaacatcaggatagaaaccatacacgtgatccacggagaacatcaataggcaaattaaggccccaccgtccaccacaggacttaatgcaggacagcaacaagaaggattcttttgacaaatccctctcgttttttgtccttgtgcaattttcacaattacctgcaaatcaagagatatgtcaaaaaccaatgagccactagcagttgaaataagactcgaatatatcttactctttttaaatggaaaacattactagatgagttcaaactgactcttaaatgtaacatatatacttaccacagtcagtggtgcggtcttcgccaaagtactgcagcaagaattttctgtgacatgtagcaagcaggcaatatttttgtgctgccatgaaggactccatgatggcttttcgatgagtttgctatcagtgaccaaaaaaatatgagacactaaaatagtaagcaactgaaagaactaggctgcaaatatgtaagatatatcactttggcatgaacagagatacgatgcacataatattcacatacacttttagcttcagcacaatagaaatcagatttcataaaatcacttctttggtaatatagccagcagactgaaggcagtccatctcttccacaacgcccactttcctggtagtaggattccaggctctttggacatccataatgtattacacatctaacatctggcttgtcgattcccattccaaaagcaatggtagccaccatcacaagtacttcatctctaacaaacgatctgtaaaggagaagcataaattatgatgagcccctattgtaccagaccaatattgcaaaggcagcatgcatattataaattgaaaggtattaactactcatttcatctgtctaaatatctttctagtctaataacttcatgatctagtgcatacgtaacagaatgccaatatttctacaaacattaaagatcaaattatagcactgcaatattcatagatgttcgtttttcctcatgaaaattgtggcacgatcaataaaatttaatacagttatgcaaaccgtagccaacaaaacaattatgcaaatcattctttatgcaaacaaaaagggagtaaagtggaaagcataatgaaatgtgcacaaagaaattaaagtagatgatatacctatgtgattcctctctagctttatttcccattctaccatggtaaatgctggacttgattccagcagcaaccaatgcctcatgcacctgaaagaaaacggcttacaagtcatcacatgtgcacctattacgaaagttcaaaaatacgtaaatgcatgataccataagctgtaaacctgttcagtctctcggatggtagtacagtatattattgttgagccacccacagtacagttctttgagacatccttcacaagttcattgataaaggccatagaccggttgcatgatttcacgccatagaaaaggttaggacgatcaaatgatcctaccacaatgtgaggaatgcgcagggtcaaggaagtggcaatgtctccacgtaccctacaaaattatatggcactggtcaaaaaaaaattatatggcactatatatttggtgattggaagggaaaaaaagaattagccactgtaaacaaaggtaacgcaacctacgaggctataacaagtgaacatgtctattttgaaaagaatgagcatcaatatattttattacaatagaaattagtggtcaaagttacgttttggggaacttgtcagtgtccaaaacagcatggtttcatgaacagaagggagtataatcaaatccctgcatttctgtctacaatatattttacacgcatcaagaccaaaatttagtgccaatgtgaaatggaaaatgacatttctcccaaagtcaccagctaccgcgcagcccccactctatcacttgattcacagtttcagacatgctgtcagtttacatatgaacacaataatggaggtaagttacaagttttccaagccatttccagcttctatgatatgtggagtattgtgccaatagagatataattatacccctctaaaaaacatacagctatacactctcactattcttactttaaatagagaagaaacataataatatgatattattaatgggcgaaaattttaccaagcagggaaacaactaatagtgcaacatctatacctttgtgtggctgttgcagttaaagcgacaaagggaacacccactagaaggtcacgcaacatatgcaactgtttgtactccgttctgcaaacaagaaagagaattgcaatcaagaaaaggtcagctatttattaaactggatggtgtgagttttaagggtgggagcacaaattggtaggcagtatgaataacctgaaatcgtggccccattctgatatgcagtgtgcttcatcgacagccaacaagcagattccggcagcctgcaagttactccaaaacctgggaagaagatttagaatgtcaaatcaatagaccgaatgctatgttatcaaacccatgagtgatttgttgtgtccatgaaattgaatgagcatgcctcccatttccagacaagcaaatacataatcaactattccttttagactaaccacgcataatcacaaagtggatgtgactagagtttatcaaaagactactagagtctgccttttaccttgaaggaagtgagacagctttctctggtgtcatgtacagaacatcgaatgcgcctttttcagcctgaccgctaacagagatgtctgtttgggtgctgccaaggtattcagacttcacgccatgctgctttaagctcatgacctatttgaagtagataagacccacgattatgttttcttgtaaaaacaatcaacaaagatcaaagcaataatgatctgcaatgagtatttgaaccatacctggtcttgcatcaatgacagaagagggctgacaacaacagctgtcttctttgtaacaagtggtgggatttgataactgcaataaaaagaaatcaattagcaatcaataactaatccaatgatttcctggaagaagaattagatgatttatgtatgtgtatacccaatgaagatgaacttaactacttaatatagctcataggctctatattactatcaaaatcattatgttttatttttctaagatagcataaatgcacactagaaataagacaaacccaattctgaaagaatgttttacctgcccaatcaacaaattacacaaacgccaatatgaacattacacggcgatacaacaacccatatatcaaccaaatgcagcattccaatttagatttcatcactggaacgatctaacttgcacatccatagaaatatccacgatagctagcaaacagtggcaccgcacgaaggaagggaacagccacagcaaaattttccccacagggaactaactcaccagatcgacttgccgctgccggtggccatgacgaccaagcaatcccggccttccaggaccttctgtatgatctcccgctggtacgaacggaaccccgagaagccgaaatacgtctgaaaaaaaaaaagcagaaacgccccagttcaagcatccagatagggttttagcccgcgggatcgcggggctagggtttattagggaatgggaacgccattagggcaacgagcacttgccttcagagctgcctccatcgtacgtggtatggggctcgcgcgcgcggtcgcgcccccgcgtcggcttcggcgaggggagttcgattgagcggcttcgggaagaagaaggcgaggcgaggcggctggggtggagtggaaggggaatgggaggacggaacggagcgatcgggaggtggtggcgaaatgggtggtgttttggtgtttttggccgggtagaacggaacggggagcgttgcggcgggtctttttattggacttcccgccatttcttccgtttccttttttttttccgcatggtcgcgattattccttaataataaaaagcctgtgaggcccagttttagcccattaggccttgtattctttttcgtgtggtcggattaagtttacttgtggtccctagttatcattgagttcgaattaaatccttgaaccgcaatagttgaagtgaaacccccatctttcaaaaccaggttaaataaaacaatatacgatgattgggccccacatgtcttttatttaacctgattttgagaaagtaggattcaacattactgatattacggttcaaggatatcatataactttgaacttcggattcaacattactaacaggcccaccgttggcacattaggcttcggcaaagccggccgtatcaatttatgttttggcaattattgttaaaatcttagttgtttgatttggactgatgctaccttggtttaaattttgtcgaaaataagcatatgttgagatacagctaccactgcagttttacagaccacacaaatatactacctacagaaatgtacatagacagatcagaaagttctaactggatacgttgtcgagcaaggcctctgtatgattttgggttcacaatgctaccctgaaaatagcaacgttagcaatgcacccagcaaacaagattagctagcatctctccgctgacagaattcagaaattttagatagctcgactgagaaatcctgaaccagaagacatctctacacaagtcctggcctcaaatgtgattacaaaaactcctatgtcagataatgggtgggaaatgtcaagaggcaaagatcacaacaaggtgtcgactacagtggagattgcctgaggtcctcctcgctcaagtaaagccaatgcaagatcgtgctcattccaactccgaagcccagacgctatcttctttagcgtgtccagtttaatgtcccgcaaccatgacgggacaaacttcaccaccaggaacacaaagcgcgatacatatgccttccaggtgccatggtcacaacccagaagaatgtgcccatccaatacacccgccatgaaatccatatggtttcccaccactcgtggccttcttgacaggaaagacaatttcatgacaggagaagttctttccgctccccagagcagactaccacagaagaagagcatgttggccatggcgtaaccttggagtgtgcttgaaactggtccagggtctttcatactctcttctcgagctgatagcagcagcgtaggcaaggtctcctcatacaatacctggaccagaagaggtccacctgcaacacacaggagtcccccaccaagcatcgcaacttgatgcgccatacatgcagcgctggatagtggcgtgcgtcctgattttaactgtggagggccactggaagagaatccatttgcaagtttgtcagcccactcaatgacttgcttcaggattacctcactcacaaagtaggtgtcatggaatgttcgacaagttctcaggtaaatgaaaccaggagccatgggaagctgaagaccttggccggtgattgcatctcccattaaggcaccaactccacggtttgcagtaaagtcagacccactgcacgaggaccgtagaaaggatgagaagcaactttggatgagctgtgcaactgcatctttatctctgccgaatggagaacgcagacaagagaggatgataaagtcatgccatcttctgactttctgtgtccataaggctgctatgatgggcatacttggccaggaactgccccctgcgcagttctctagtgcctggccactgatcgcatggatatactctgaactcttatcaagcttaaatgtaattgttaagctgaccagcgcagccattggtaaaggaagcattggtggtacaccacctgcaaaatgaaataaagaaactatattcatgaagtgatattaaatggaatgaacttaaaagatcatataatgatggagctgaaatttatcagtaattaggtgtgaagcaatgcaactaaattgatgcacaagaataggatgcaggtaatacgtggatagcagctgggaatctgaatgccagcagatgcgagaatttcctttatttctgcttcgatggaatgaagagaagcaccaggactaggccattcagttccattcatcgggaccattttccagattcctcgtgtaatttctgctaagaagtagctaacaattgctgcaatagaagctggcaagaagtccacaagatctctcaaacctgcagcacataaataagattaagacttggggatcaaatcaatacggtgacatgaaagaaatggagtttcctcacttgtagtcaagtctcggctggaaaaccgtccatgagcacatgctgtaagaacagcttcaagaacaaaaggaacagcttctaaaaattcccatgcaggaactgttggcctttggtaatcatctggtgtacttacagaggaaccactgacactactgctagaagtggatgaaagattgccagatgatacaacaggtttgttcatttttctgcaaatcatactcaaaatcttgtttgcaacttgatgaacaggatttttgttgcaaagaccagaaagggttgaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5516 - DNA, 741 bp, Oryza sativa
ttcctgcagcccttggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgcataacctcttatatatatttttttcatttacatttggccgggtaaatttaaatgaaatgtacataaaaaagataagagtgaaattacaacaatatagactatgtggtattatgctgaatgatctccaaacggccagaaggagccattcatatggttggaatcgtaaccctgcaaataaaaatggagaaatatttcagttcaaaagacaacatggagacatcgcatgcacagttgcacactcatgtttcaaccataaaaatgtgatgcgggcaccatacaagattgtttcagttgaaatctagcaacaataccagcaaagcacaaacaaccaaactattaacactcattaaaatcgtctagcaagggtactgagattgctgatttgttaagaaaactataccataaagacagagttaacctcacttatctgctggagtctgagaattattcttttggcaagtaaatcccaattactactaacactggcaagtgtggtagatcatgaatgtggataaaagttacactaacatcagaatatatggaacaaagagcaaccaagtattaactaaatctgaaagag

SEQ ID NO: 5517 - DNA, 37971 bp, Oryza sativa
catcatcaacctgaaattaacgatggcattctagtaaattcaaaggttgtgacagaaaaacagacacatgaaaacagcagacatatgaaaagctgtacctccacaaatcctctccctcttgaactagggagaggacaacagaagttcagatattcaatatcatcatgctcaacgtcatcaactatattatcggtgtcttcctggaatatacaactcccttcaaatgagcaaattagcctgaaaacatgagatgatcaatctttagatgacaagtaagcttaagcaaacatcaacctatgtctccatcaagaacaaacatatgtaaactgtagatgcaaactggcaaagtaccttgaggaatcactgactaggttcaagccttctaccctgaaattcacttttgttgaaaaaggagcagcaattggtctcacacataaaatcttgcagtaatgatgagcactgtttgcaagtggtctgtccaacataagttgacctgcagtgatataaaggagtggtgagaataacaaaattccgatgtaaaatatgtataatagaacttgaagagcactgcgctaactaatcattcgggcttaccattatgcatgaaagctatctgatgccttaccattacaaataccaaaccatatgcccaaaagttgccggtggaactattcataagcttatccaggtatgacctcatattatcagagagctgtattaaataatatgaaaacatcaagctatcaagcattaaacaaaaagatcattgtcatgacatgaaataattatttgaaaaatcatacctctttccatacaaactcaactaagcgaagatatactgttaaaataatacaaccaggtctaatatagctctctatatcactagggctactggacaaccaaccaaaaatctgaaattcaagattgaagtgttaaattaactatatttactcttccaccttgctgagggaatgcataatttacctgtgatcgcaaaactggaggtaaatcactaggaactttctcgaaaagcttgaagacaattttatcagtccgacactgcaagcattcataatgacaatcaatgtgtgtgtgtgtgtgagagagagagagagagagagagagagagagagagagagagcacacgcatttcaacatatttgaggtgcaaatccactatgcaatattacaaaatagaaaatactggcatttggcatctcaatacgtatgtactagaccgactgttgttatcagtagaaattctctttcttcatgcacttctttatactgatcaaaaggtagttcagttcaccttgtttatgtggcatttatgtgagaaacagatgcgatgaattagttagagacatttcactggtgcagatgagtcagttaaatttggatctgggaaaatgtgcattctgttcaaatttctctgcagacttaatgtttttggttcttgatgatatctgcaacaatttttctagtaaaggtactgaaaagtcatgcacgtgtaagtgtgtaacttttaagttcaaaatgtacagttaagttcatacttatataccccttaaaacagaatctgaagcatatctagtactgcataaattaaggcatgtttgacagcactccaacccttgtagaagtgcactaaaatccccttccagttcaaaatcccacttgaactaatgcccacttaagatagttatttccttatttggtatgtacctcttgttaacttgttatcaaaagataaggatgttattatagaccaataagtcgtgagcatttgaaaattgaagcgatccctttagttttgggaaactagttttctttacattaagttgcaaggaacaaatttgcaaacctgagcatctccatttgagcttgacagtgactgagctgatgttgaatctgaattgccactagtctgtggtgggctttgagtagaatcttggtgcatccatgatggacaattgggagaatcagttgtcttgaaagctggtgtaggtgaaccttcatacccatcctcgaaaccttccatgccaccataagtgtcattcaaatcaaaatctttaaatttgcatgctggagggtctgtgaaaaaaagccactagtgtaacttaaaatcttcatttggaaacattcactgaagggctagaaatgttgtgcatctcaccaggagttgcaacagtgggagactttgattgtactggtacaacagatgatgatgccaggccacattgatcaccgttcacaaaaggcatcttagagttagatggccctgcagcctctgctacagcagtatttaccaaagcattagctgtttcagaggtcccagcatttgatccatcttgcatgctttggcatgcctccaagagtttacagagttcttttggatccaatgatttggcaactgcccccaggtttctcaaaagaccagatatcaactcctgacctcttaaatgctcagcattgtcagctgcaagtacaattgtggagtcctgtgagtattatcataaaactagcttgcatggaccaagtatgttcataatagtccagtctaggcactagaagtattcctacgttattttgggaggctctacatttaagcaaatggctaaaagattgcagaattgtgctgttgtgaagtcttgacataggataggcaatcttgacacaaaggtggaaatttcctgtaagcaaatctgggagttgaatataagacttaactatgaactcatctagtaccacactacagtctttgtagtcctagaaactatgccactaacaacctttccaataaacaagaaccatatacaacataaaagctaccttacttgaaaacatcagaagtcttatttcaatcaataccaagtaaattcactcagaaacatattcagataaagtcaaactcaagtacgcaattgaaaacaaactatactagtaccagctcaccaatacatacgtgcagatggaggatctatgttattgtaccataaaaacattacctacagttcaaataagaatatgtttacttaccattcaaattggcgcatactccaaggagacccaacaataaataactgctaattttgtcctcagtaaatgcagaaccaccaacagcaacttcagggcgggtcttcctccttcgtctgttgtggcctgctaaacgtcggcggcaacttcgcttcccttcatcaaattcttgaagagggtggaatctgtaaaaggaacatgtaagcatgtacagtaattacagagttcacccatatctttttgaaaaaaaaaatgcatactatggcaccatagcacagtacattgtaaatagtattagcactatgtaatcacacggtactccttgaacagagtgccagttcctttgaaacatttatgaaaaaatatgcatgaaaaacaaatactgtaaaaactattataattgacagtgcccaagaagaattcacaatattttctaaaagttgacagtggtgttaagcataggaacaacccacacacataaaagggtgagcaaaagaaagcattactgttggacgtgggatgcacaaatgaggacattaaggaaccaaatgttctcttacatcagacgaaaaagaatatatgaaaatactggtccatgaaaaacgtgcgtactagttctagcaattacgaaatgtaaaaatggtctcagaaattctacgattcaaaaaatatcttagcaaaaatgtttctggctttgtcaacttcaactaatttttccccaaaaaaaattaatttcagactttcagtacagatgttggaaataaaaaagtattttctttgaagagaaaataatccaaagaaattacgagagaaagcagtctgattgttatgacacgtacaactgtaattttgagctgagccatcggcagtaccacatagatcttagatatacaggcacagctagaagggcataggccattttataatatatttactttcgaacattttcttttatatcgtatattcaaatgggttgtgcaatacgactccttttcggttgtattcactgctttcataagagttaatccctaacgatttctcttagcatggcactacgttgatcacttcttccagcatcatcactaaatcttgcctatgactgatagtccgtgtttttcacaattacaacataagcatcgtcattttaatcttcgctccacaaattatggtgtccttttcattttactaccactgcgcccatatgctgtgacagatgtcaaattaataaaccacgtcctgagttaaagaatcattacactctaagctcaaaaggtgcagacaaatatcatatcatcatgaatttgagaatttgactttaggatgagaaggaaaaaaaatatacctaaaattattcttcaaaatcaaaaggtacgatccaaaatcattacttccataatagtccctccgtttcacaatgtaagactttctagcattgcccacattcatttagatggtaatgaatctagacatatgtatgtgtttagattcattaacatctatatgtatgtgggcaatgctagaaagtcttacattgtgaaacggaggaagtatataatacagacaagtctacgtataaatttatctcagccaatctagattgaacatgcacagatgatagatcacaccaactcctctctttaactatcattttatcaatttaatttaccatattcatcaggattactttcaaaatccaatgcttacaaaattgttagggttggaagtttgtgagggtctagaatctgtttagccgcattgcatcaaacttgcatagcatattctacctaatcattccaatatgaacaaattatagaatgagaatgaaaggcagtagtagtttgaattaaactaacctactacattgttggcagaaccgctggacagtgttcccaaccacagcagtggtagccttggcatgcatctcgcagaccttgtgtcgtcgatggtaatccctcacaccagtaaggtccgcagtgcagccctccacctggcacgcggggccactaggactgcctccctgcaccctgatctttttgccattcctgtcttcctcatcagcaccaccacccacccctgctccatgggcaacagcatcacccccaattctcaagctcagtgacccgccgccgttctccaccagctcgtcatcctccacatcatcatcatcaatgaccaccacccgcttcctcttatcggagtcacctctagcattaacatttctcaccgacgcggccccggcttcctcggaggaagacggcgagctgttcagcgccaagccgctcgcctccgcggcgggcaccggcgtagcgacgaagcggtcactgtcccaccgccagtcgttgaggtcccagccgaacagcctcttgtcgcgcctgtccatgtcaggctcgcctagccctccgccgtacaggtggcggctctgcgccccgacccgggcagcctccatggccccccgcccccgaaaccctagaacccctcgtcaacctcaacctcaaccaccacctccctccccggcacaccgcgtaaaaggatctactcggcttccctcccgcccaagtagtcgacgaacgtgacgcccacgcacccacggatccagaccagcgaaacccacatgcccccctcttccccgcgccgccgccctccgacgcggcggagcaaatcaaccaacccgccgcgaaaccgagctcatacaccccgaatcgccgcgtaagaaggtaaaaaaaaaacaaaaaaacgagagagtggatcagcgaaccgccggaccgagcgaattggcggcggagacggcggattcgagcgccgaatcgagcggcggagggggggaattcgccgggaggggtggggggaatttgggagtagagaggaattttggtgggaatggagtggactaaactgcaagagtcgaagaggaagacgagagaagtgggggagaggggaaagagcagaagaaggggagggaggggggatgggatggggacgcgtagcgcggtggtatggtacaaatagggggcgcctattttgcaaggagcaccccgggttggctacacgacaattttctccgcgcaggttaggggaaaataaatcatatgcaggttactgtaatttactctctctgattcatattactttttattttattaaattttatagaataattagcaacagttataataccaaattagttttattaaatataacattgaatacattttgatagtatatttgttttgtgttgaaaatgttgctatattttttttttgcaaattcagtcaaatttaaatgaatttgaataagagaaaagtcaaagcaactttaatttatatggtctaacttgatatggatgatgtgattaattgtttctttttgcatttttttatgattttacagtgtatgcatacaattactgagttgcagaatatttatgaagttgggtattggacttttattttatgtccaatcctcactccccaattcccattgcatttttatagagttcaaatgtagtgacaacaataaggttatattatattaaactataattactcacataaatgtttggagacatttgttactttgtggggcatatgcaaagttattgtgcggtactgctacgtgttaagaagcattgaaatgtatgacactcacattggctggcgacgaagtacgcagtctacagaagatagatcgttgtgagaaagtcaaatgtgagttgttggaccaaagtctgcccgttccaatttacgtaggagggggagaagcattcaactgcgtgcatcatgcaaattgtcattaaatcatgtgtaagtacatactggtatctaacaagaagtacccatcaaataaggaagttcttttaaaactatggagatcgatcggaatattcaaatcgtcaaatgtaaaacaggaggatttttagccataatgagtactggattaaaactttctgatcctaactgcataaaattgtgtgataacaatagatggtccatagatatatatgacaacaataactggcaaattaaataatggatcacatcatgatggtagtaaaagatttaatcgttccaatcaagatgagatgattcattaccatctcgatcaatggcacttttccggcaacatgtaagaacttggagcaagacaatgtttgtgttcccatggaataaattaccaggtgccattcactatcttgatatggacacattatttgttctacaattcttaacatagtaaaggcatataaaaatatattgctgtaaatatatactattattgtatgccattctcataaatttattgtataatgcgctcccagagcggaacgttgataaccaaatattgaatcatactcatgcatttatatttttataaatccacccatataaccattgatcacatttatcaatggacgtgtctctcgtcaactctagttggaagtactcattatagtcatagtttcggcatcataaaaaacgacaccatcgtagccacagtgccatcatggccgtgtcacttttgttggaagtaccctttatggtcatatagtctcgatatcatagcaaatgacaacgccgtagccatagtgttgtcacgagttgtgtcaataagattgatataacctacaacgtggctatcttgttaactacacgcggcactactcatgttatcgtggcaagcatatgtaccacgtgttgccatcacgagtttctaaaatccgccgagagtccaccgcaaaattataaaatccacgctatctctagcagcacttactattatgataatgcagtgacagggttaattaattaatcattttatcatttgtgtggatgtgatgtagcattagtttcattccattcatctaaggggaaaaagttcacctccatgggtcagatcaacgtggttatttgtcaatgtgctagctagtgtatcaccacctaccaagcccataaacctatagcaagtgaaaatttcagtttaattgatttagttccctctttctgatgacaattaatcgtggccttatcatgttagcaatcatcatcagggatccaccatatatatagttgatgcttccattatggctagaaagtatgtttaattaaggccatgacttggagaatgacatcatgtttgaggcacccgcgctcgcttattgtcgtagctaattaacatattagattatcacttcgtcatccagcgatttgccctaaatcaagtcaatgagaaagatgtactggcatagatcagaactgttaagtagtagtttttcgaacggtcaggctgttgccgacgttttatataaagaagaaggtgtcttattttaaggagaaaacgagactaaaccttacaatgcacagttaattagggaaaaactggacgaaaaccacaacactctaacctaagctaccaataccatggaaaaaggaaaaatggcggagcccaaaacagctatcgataaagagcttgttgtaagcgatacaaaggcttcgacttcgtgaggcaaatgttatcgttgccgggcttgtcgcctggcgacacagcagcttcgactccacagctatcacaacatcgttgccaaatgcatcacagaaaacaagcaagacaaaccgatcgaatcgaaacatctgtatgttctctttaaggaaacactgacaggcgagcctcgcccggcaggccggcagtgacatatttatattaaaatacagaaaaaaaagttattacagatagttttataaagattctttcttgttacaatctttattctgcaaaatacgcagaagatcaatgtccttcctaaatgcatgaaatcgatgttgtgtggaggagaatttcgatgtttctgatgagtcttcatgtccattttacctcttctgaaaacattatgctactcaagaattcagtatgagaaattgagaatccatgtgttgcatttgcaaacacggtttctaggttcttgctgacgcttccagttttcaagcaaaaccatttgaattagcttcagaatttgagtctccaggtttgcatttgcattagttttcggacgttcagactttcagtagttttcactttagaagtcaggatcggtagaacttgcagtcagtgagatgcctctcgtgcgtccatcgccacatcggtctgttccattgctgactggtgggccaccccgtgcaggggcctgactgcttgtgggccatgctggactgttgtacacacaggatcagaaactgttgtcagattgttgtttccgctggctttttatatggagatgctagtggagtatagtagtattaatttttttcttctcctgtccttatttccacctactgtcaaaaaatgcagtttgtatatggaccactgcatgtacatgtagtagcaataatgcagtactgtctgtgtagtgcttgcataaatcaagaacaataaattatcactaaatataatcaagagaatcttaaagcaattgagatggtgccactacacataatataattaaaaaaattatcactgggaggctcacattatatactccataatatatcatgaatatagtactacccatcctattttaagtgcagttgtggatttatgtgtctaacgtttgaccattcatctaataataataaaaatattaattataatttttttaattagacggatagttaaacattgatagtagatagtgtaaaattgtgattatgggatggaggtagtagtaataaagtgctaggtgcattggcagtttattggttatagtcactgattgggttgtaccaaataaataattgttaggtggagcaagaaagcagcaagcatgcacgggagagttgatgttggagatccctaatctagactttctgtcgcgctaacgacggcgacctggtttggactaaactgttgtttagaaaactcgcacagtatcatcgtactctcatgatagggagaccactatatattatatgtatgtttattgcttttttttccttgatcatgtatatatatttacaccgtccatagtatttaattagataattgttaatgccttctcgactagtttcagaaatgcaattaagcgaccaagaccggcggaatcaaggagcggcggatcacaagtaactgaggcatgggaaactacggaaagttgagtaacacagcctaagagtttacttggttgagaagacgtgaggaaagaaaaagagtaggatgccaacatatgaaaagcactgtcagattggagaatgtaacggagaattattgtagtgaaagaaaaatccggctctaattcttttggtaaattgatcaaatagatatttggatagtaaaaatagtaactctgttgaagatgttctaaggtcgtctcttggtcggtttatgctgcatgcagcgtacgtgcacgactgcacggtgtatgtccacctagggaaaaggatgccgggttgccgaccgatcgctcggcttttcttatgggagaagctagcagtagcatatgcatatgcacggttggtctggatcggaccacacgtcacacatatgcatgatttgaggtccaggaacgcccaaggtgatcgttccatcgagttggcatctgcacctacgcatgtgagggaaacatgaatgaacagtaacatgcatgctctttgggcagagaaacatgaatgaacagtacacgcatgatcttaaaattgagatcctctgcagtaaaatgcacgatgtttttgtcagggtccacatgtcagtgacaaagtcacgtgtctttgaccgcaagcgggatgtatctggtgtatttgtgattttatagaagtgggtctaaaatagttaattattgttaaagcaatttctataatggatagaaaaacgtccgcattagctcttgtccatcaaatatatgagagagaattgctttatttttggttgtggtatagcacggtaagctaaagctaattttcacgatatgtatgactcactttacaggatgggcacgaatcattgtcttgatgttttatatatatatatatatatatatgtgtgtgtgtgtgtgtgtgtgtgtgtgtgtgtattgtgattgcccagcaacctagtatctccttgggtcataaatatttaatatttagaatcaaattcggctaaaattttgatagttttatatttaaattcaacgtaaacagcaatatgcacaattacgcgcattcgtatacgtacacagcgatgaagtcaacgtcgacgcagacaccaaaggacgataagtcgataaccacgccactgttaattcgattattcctcaaactcgaggatgcatatatgcttaattatgatgctatcgccaacaatgtgagtggcaaaggggattgatctgctagctacgtagcacaactcatcgtctgtttattttatttcatttttgcggggcatcgtctgtttatttgctactcgatattactatagtactaattattttgcattcatttctttatgtgttccaataaatcaataattacttttatttccagtacctagatagactattattgttcttattacatgatagtagcaagactttttttttaaaaaaaaaagaacagatgtaacaatcagatagtgtaattaaattggttgcccctgtctgcttgtacgagaccagcagataagtttcctatatactcaagggcccatttaattactctggccccgtgaccatctgtaggcccaacgatgggccagatattatttcgtacggcccagcatttttcttgggtcctttctttaaggggaaaacacttttttattgggccatatgggcccatggcttgctttgttcagtttgttttcctaaggaaaaaaaaacgaggcatctcgaacaaagaaaagacagagagagaagggaaaaaggaggtccaggggttcggaattttactcaccgaacccctctggttcaaaaaaataacacattatgatcaaactaagcatatatttaacctccaaaacgatttactgttttgttaatcatcctaattaagagttgatgtcagctaaagcagctcataagcatgccgctatggtggcgttttaccagctggttctgacgaaggttttatatattcagtgtactgttagctgcatcctgcagggaatggatatatcgagttaatctctccataattaattttccttgtcatttcctcgctgcgatatgtgtctcttgcagatgctcttgatgaatcgaaataaacgaatcgatcgatctcgaatgaatagatggatgatgagggtggtcaaatggatatattggcacgttccctttgcctaaaaagtcaacttactaaaatttgataatgttaaatttttgacacattttagctttagcatatttttggcagtgttatgtgttttcgtttatagactaagtatagtgtttcttgataagatactttcgaaaataccaattttaataggataataatgttaaggttatctttagtttattagttaccagaactatcctataagcccaaaactgtcgaaaaaaaatacattataacacattgtactgtcgaaaattattttaccatgggtgaaccgataaaaattaccgacgaaatttttttagatcatttacgggaaaaaaaataacagcctacagacttactaggaattgtgatagtgtccaatttaatagagttaaaaatgataataaagtgaacatgccatgtatccgaatgctccatgcaaccaaccaatatgcctcttggctgcttaattcaccttcggatttgatgcatggatatatggccccatgcaaccaatgcacataagcacatgcctgagtatatagccatatatgacattgggttgctctcgtgcatgtttcaatcctacgtgtaagtgcgtatgcaaatgccaccttttttttaccccttgagatacatgcatttgcatgcatggcttggccttagccattaagcaagccaaattaaagtgtgtgtcatctgctctgcacaccacaagtcaatcgcaaagcttgcttaattagtcaattaattacccattcgatcacttgctgcattgcccattgggtgctcctacgattagcctagctcgctagctagctcttcttttaattggcggcgataataatccccactaacccacccagatactgctgcttttcttttgctaatataatatgaactgaatctgccattaggacgtttcttactttctcgttcctttaaaggctttaattacttaattaattagtctctgtgcctgatcacaaggaattaatcaaatagggttaagaaaaatcaatcccttaaagtacgtactcaaccactgaaccaggagaagaagaaaatatatagccacatatgcagagcgtgtgtgagaaaatatagaggtcaaatggggttcggaccccatttggatcgccgatccacccgctctgaggttccggcttcagaaactacagatgctttaatttgcttagtcacatgcaacgcttcatcagcagaaacacgctgaaattttcctttcttgatacgagaaaattgctgaaatttcgaagaaggaacaagaaaaagaaaatgagactgcattttgaatatacaaattaagtcccttactgtacttattagcatatcagacacaaatttaaattttaaaacttaatttaattttagagtcttttcgctgtattctagctattttctagcatttacttttaaaatactaataacacaaatacaaaaacttataaattattttttattagttcgtccatttttcggcatcttatgtgttgtaaccttttattatacactggtcgatcaatttgttcaccacgtgcctgtttagcttaattgttcatatttagaactaattattattttaatggtaggtgacgtatccgtcgacagcgagacggtcgtggtgacttcgttaatctcaagatttaccggtccagtcttcaagaaatgcttatagagatagggtgtacgtatatgttcatagaggtgagtgcacgtgtgttgtgagcgcctacatttgtaatgcgtttataagaagaaaaagtttaattgtgcatgcatgaataatagtttagtagggcgacaagatacataaaaagcagatgcccaccatcaattagttaattcagcacaagctttgcaccacacaccgatcaagctagcggctcgtttatctacactattatactatatagctaatgctcggcgaaagtcgcttaaagcttcactaataagttttttacaaattgcattattgcccttaaccaaaaaaaaaaaacgaaacagctttctgtttattcagcggcaaactgagctccagtcgacagcttcgtcgtctttatcaacaaagatacatatggatgctattgttaaagtcttgacattgcaatcctatatgatcatatagcatccaaaagattaacgcacttgcaaccaatataatcatagattagcattgacgcatgagaaatccgacaaatctgacgtttttctacgccaatagaaaagcattcatgcagtcatagataaaatgttagttcatggaagtgctttcttgtggtgtggccattcggacttggatgtgatcttatcatagctttggagaaagaagaggagtagctggctggcccaagatcgaggcagtgacacagagaaatctaggaaaaaagatactacgatgttatcaagcctgaaatcgacatcgttgatctctgcatgaacaatggcacatctctctcttttcctgtctgcctctccttatctcctaatggctcatgatgattcaggaaaagttgcccaagagctctgcaatctgctcccccttttcctttcaacttgatgcctctcaaaaaagtgaaaaccaataaaaacttcctcatccaaatttcagaaacaacatgaccacagttaacttattcagaaatattcagtgaacttattattcagaaatattcagcgaacttattattcaaaggaataaaccggcaactgatggaaccagttaactgctagctagctacctcctgattctagtagcaagatagatgtaacagaatatattctgctgacatgtgctgattcccatttgccttaaactcttcaaggttaagccatatcagcagctgttctcatctggtccaatgaaaaaactttgtctgaagaaggatacagaaacagatttctgaagagagatgtgcaaacatacttgcaccttttgcccatatgatttccagagatgagatgaggatctttcaagtgcacatggcatgagtgagtgaccaaggccagccttttggcatggtcatgcttactgtccttctgcaacagctggtccaaaagctcaatgttgctattgttctcaacttgtcatagtactacatttttttttcttcttccttcttgttgaattaaaggtggctctccttcagaatgtttgagagtttgtattgcagattatggccatgcatagatcagtgcaagaactagatcaggatcatgtgcgatagtcatcggagaagaaagcacctttatctctgaacctaaaacttttgtcaaagcatttttttgtgttggcaagaagcaatgctattggttactagtgttcagccacgtcacacgcattgccttctgtttgcacactttttttcctgaatgcaaaatgacatctcagacttcagatttcagaagcatggcgaatgggttagcaaacaaaaaatttgacaccattttctcctgaaaatgttttctccttcagagctgctgctgttcagctgttcagggttaaaaatgatcccagtgaaatttttttctcttgaatgcaaggatagagaatgcatttaacttcatctgctcaaatcccagacatattttctccacaggaaaaaaggatatatgcacttcaattctgtattcaaagtaaaaaagagcatgcattgtatttaaaacaattattatccactttgccacttttcccctattgcatatgctttttccactttgcagcagacaacctttgtttccctcctccttaagttccattgccctcctttctcctactcttccttccacactgcccaatttccatctccatttccttcatcagaggttgttctgctcagtcagaggcatcctttgccaaaaacatttatctgcttcaatggcaacttcttggtctgttgctttcactatcttcttctcctgtattctcctgcttgaaaccatctcttcttcaggtcagtatcccatattttgttttctgaaatcatagatcatgatcagcataatctccatctattgatgcaattagcatgcacctaagtgtcaagagcatgtgtcagattgtcacagtagaacaagaatcgatatgaatctctatcgaagtatttatacctctgaatctgatgacaatttttttgttgttggtgatatttcgtttcagtagcatctcttgattgctcatatggttcagctcaagtgaagatactgtccagctcggtggtcagtgagcagcaaaatgtgtacctcttcttgaagccgtttcagagcacgagatcatgcagcgcgaggcggctcgccggcgaattcgtcaatggcgtcgtcgtgcccaacctgcggctcaacgtcaccggcgtcgtggtcacggccaacgagcggcagctcggcgcgctgcgctgcacgctggagtcggttcaggcggagctcgccgtcgccggattgggtcggagcgtcaaggtctcgccggagctctcgctgccttctctgcgagccatggcgaagtgccgccgccgcggcgagaagcattggcgcagagtcatggagttcgtgaggaggtcaggctcgtttgtcgtggtggagatgggtgcagaagagaaggcagacctcgccgtcgccgatgtcgccgccgcgttcgaggagggcgtcggcgtggcgttccgtatcagcggccgcgcggctcggagcgcggcggaaatggcgaggctgatcggcgatgcggataaggggaggaggtggacgggtgttcttgcggaggttgcgtctccctctccccggcgggagctcgccgcggcggcaaggacgacggcgcgcgacgtgttcgcgccggtgactaacccgacgacgacgccggcgacgaacccggtgacggtgcccgcgacgaacccggcgatgaacccggtgacgccgggcatcgtcaccgtgccgtcgaccaacccggccacgggatactccaacaaccccaacctcccgccgctgtacccggagccgacgccggtgacgatgcccgacccgacgacgacgacgacgccgacgccattcatgaacccggtcaccgcgccgaccatgccatccccggtgaccaaccccgccacgacgccggccgtcacaaacccaacgacgatgccttacccgtacccgccgcagcaaggcggcgtcatgccgacgactccgacttaccagccgccggcgacgatgccggcggcgggcgggcagacgtggtgcgtggcgaaggcggggctgatggacgcggcgctgcagagcgggctggactacgcgtgcggcatgggcggggccgactgcacggcgatccagcccatgggggcctgctacaacccaaacaccctgcaggcccacgcctcctacgccttcaactcctacttccagaggaacccctcgccggcgagctgcgacttcggcggcgccggcatgctcgtcaacatcaacccaagtaattattcattttacttcgtctgttttatattataagactttatagcattgtccacattcatttatatgttaatgaatttagacatatatatgtattcattaatatttatatgaatatgagtaatggaacgtcttataatatgaaacaaacgaagggagtattaattaaccccactaaacttcgtataattactcgcgttagcgtgcatcactgacagaatcacactgaatgattcttgcaggttcaggaacttgcttgtttcaggcatcatcagcagggtaagctttgatccctcacttatgcttatgcttatgagcaaaaatttaaattttaacattaaatttaaaactgatttaaggtttttcatggaagtttatttttctacatttgtttttatatcgctaagaacatgtatataacaattttatttataaaatatttttcgtttgtaaatatgccgttgaataagccaaacgatgaggccgataatatcgtgctagttactgcgatgcattgatcctgatcaggatttaaacgtttgcagctacggcgcgggatacagcccgggggtgacggggacagtgccggtgggcggcggcgcgggcgccggcgccggggtcggcgtcggcgtgacgccgatgggaccggcggtgggcggcaccggaggcgccggagtgacgccgatgggaccggcggtgggcggcggatcggggtcgacggtgctcaacgccaacagccccggcgggaactcgatgtacggctccgacagtaacccgacgagcctcaccggcgccgccgccgccgcgctgtcatccggctgggtcctgtgccttgtctggatattcacctttgcatatgtcaaggagaaagtgtaggccttcttcttgctgctgctgctgctactgatgatgaacaacttgttctacttgattcagctgtgtacagatgcatactagatgatttgagtgaattttcataggggagaagaaggatagatgttttgtgagtctgtctgtaatctgtatatgactgtttatgagctgggtaggcagaatgatgcttaggcatcttagccatcatatatgttgtaggtgagcatagagatccttctctatggagacatgcttcttgttgtagtgcttgatatgatatcagttgatactattcttgttcttgggcagctttatctttgcatctcttccatgatgacactacctcacatttgggtttcatggtgcaaggtgagtgacatgtaggagtaaatcagtgtcggtaattgctagcaagacctgaaaaagttgtcctgactttgacaaattgttccccaaaaatgtgcatatgatttccttgggtgagtaccctgggggcgtgacacgacagggtccagcaatttttgttcccaagttatcatttcaatataaacggtttatatatgttgcagcataagcacatccaatgtgcatactaacaacacattttcgatgtgcctaaacagcaatatttctccattatactagtatttcaattaacttaaagcccaatctcaatggcatcgccgtattagataaaggagatacaaaagtgtgacaagacatgatggtatgatcagacaaatcccagcaggtataaaatgcttgggtcaaatctacctatgacatataccacgcacttcgacaaaattttagcccaggcagcaaatgaaacctctcaacttgttgctttgcagttacaaacagagcttacaggagacccagtgttcttgctgcactcatccatcctttgatgggattcatcatcctgttgttcacgaagtcttccgagcaagattcttcactccagcaccaacacatttcaatgtaacagtatttgaatttggatcaggcttgataatgaacttgacatcaaggaaatcccgtatgttgcgaagtgtttcgatagcgtatggtgtcaactgaccaacacgaacctttgacacatcaggtgggcttagagcacatagaataaacagaaggccctgaaaagtatttagaagaggaacacaatgtcaaaaggtaaaataatttaaacaaccatccgtttttaagagggaaaaacacaagttcaggcatcaatttatatgaaaaagaataggtttcttggcaaactttctaatagactaaatctatctgtactatgtaaacactttaacagaaaaaatattttcctacaccatatgacagccaaaggaacaattaccaaactggtgttgcagggctgtattatagtagcatatagagaataccacaaaagataatgattgtcaatggttcaaacaacaaagaaaatgtttgtttcaaagaccacacctgatgtgctgagtcaacaactcccccttgagcaacttcttctagcaacatcgatgcaacttgaacaccaagatcctctggagatgttagctccaaattctcagattcctcattcatttcatcaacattaggataacttacagtagcatctgcagagagcaggcagcctgtggtagtctcagcaactacagatacgccatagcctgctgacctgccaaatagatgaagatggttaaaaaaggactaatcacaattattgagttgcaagacatcagagtatagcaccattataaatattcaatagaactatttgacagtgaaaaaaaaatacctgccaccagcagaaccagatctatgatcagtgaatatatgaacatccggaataaagcgattgaagatcccacgtgcagcataaatgatgcggttttcaatttgtggagatactctagttgaaaatgatacacctcttatcctcttgaccataccttcatcagcccagttagctgcctggaaaggcatttagcatcagatggaaatgccaacagacatggcataacattagaggggcagcaaacaacacacacctttaatgtgctctttatgttgggaactcgaagaaacacttcaccaccaccaagaggaggagctccccggctttcaatctttaactccaatccctccagaggaacaccgaattgtttgagcatatgcaaggtaaccattcggaaagtatccacagaagggtcctttgtatcattagtaattcctaaaagcagggtgacaaatttaggtctcatagtaaagctgcttagggaaaaaaaagtctgcatgatcaccaattatggccatcaattttgtgcagaaggtagagggtaactataagtgccaatttcaacatgtcagtaatatggtttcaatagataagcatgtacaaacattattgatcaccaatttctaaacggatagataagtaatgggatggaccttccgctacttctaaacggatagataagtaattccatctccaatttctaacgaataataatacaagaatgacgagtaagttcaaattagtgaaatcccaatcagacaatctctatcgaatccaacaaggcccttgaagaatatggtccaggaacaaaattccactgcaaatttcgaacaatctatctgactaaacactagacagaaccataacttccccctgagccacgaccatggtgtcaacctaatacagcagaggtcccctaaattttgctaattctgcaccactattgcccaagtgttacctgaacaagaacaaggaaagctcacctttgagccgaatggagatgggcgccctggcgaagagcccaagcagtataagcggctcaaggaagtagccgatcccccggtgcaccccgcagtcgtgctcgaggtccctcccgccgacgatcacccccggcttgtacctcagcttcgtccctgcgaccgcacgcacacacgcacaaaggaatcagccagccaccgatgaaaacctaggcgagccacaccagacagagataagcccgcgggaggaagcgcgcgtccttgcctgtctcgttgaggtcgagggagtggtggtcggagatcttgtggaggaggtggaggagggagacctcgtgggggcggaggcccggcgcggcgccgccggagcggatgtcgtcgatggtgatggcggtcgacgtcagcgtcgccagcaccaccctctgccggaagtggcggctgccggagagcctccgcgctttgtcccgccccatctcgccggccgttcttctcgcgcgccgctgctcgtcggcggcgggaggggctagggttctgggctttcttccccgcgcgcgccgccgccgaggcggctactaaacccttgagctcttcttcgcggggtctcgctgggctgtgggcccacacctcacgttcgtgggcctcacgcaaacggcccatgaatggcctactactcctatatacaggaggattaggcccaaatgcagaaaaggaatggccgtcaacttcgtctagtggaaaatcagtgtccgagagtgatcaatcaccatgaagacttgaaaagtaatctaaaactaaaaggggattaaaaattaaaatgtagtctttctcaataaaaataaaatgtagtagtataaaattatgttaataaaagaaaggaagtgcaaaatttgtgtgtgtgtgtgtgttttgaagaaagaaatgtgatgtatctgtatgacatgcaaatcgtttcttggagatcatgcatgttgtttaggttcagattcaggtggttgtgtgtatcttagttatgcagaaatcgaaagtgttttgggataattctatcggctcgatgaaattggatatttggatgagtgcaataaaccttctgtcatccaaaaagctccatgttcaggttcaggatccaacgtgactcaggtcaggctccaattcagtgcagagacagagaaaggcagagatcgatacggaatcagttcagttcatatgctctcttgttaggaaacgatagacgaacaaacgataaaaaaaacagatcaatcataaaaaacacaagatttaacgtggaaaaccctcctaaaacaggaaagaaaaaaccacgggcgccagccagtaaaatatcttcactatatctgaggtaaggttacatcgccgcacagcggcttacaagagctatatatatagtggaaccctaaaatggatgatgatccataccgcgggagctccgcccccgcacccccgggcatccccatgcgcacagcccaatgggccagcttcagccttcgctccgctacggcaaaagctggcttttattaagtgcaaatgaatttggatcacaactcaacatctctattgtttactagccagccatgtgagagaagctgatgtgccaagatacagagagagatagggcatcagagagtaggtacggcgccggagcagctgagagatcatccacggcaagcacaacaatttcggtgatgtgcagaaccaagtacatatgctgccatttttctccacgtactttcttcagtgcattacatccactgcattcaatcttcttcttcttcctcctccctccccgtgacctctccatgttcctccatgtgcacccaaattaatccttcagccttcactactcacactgaatatagtatatctctacctatctacctgtatttttttttgactgaattaaagcagatactgtgaacacatgttgtttcctgactaaaaagtcaagcatatacagggaaatggttttttttatcattggacagttggattggtacactcatcgtacatatcatctaaaatatcatgaaaaacttttaaaaaattctaataagatatagataaaaatatgagatatcgctccacaaatatgtcagtttcaaattcaaataatacaattcgaaacaaaaacaacaaatgtcaactatgaaagttacgcacttttggtagccacttttgttatttttgtttcaacttgtgtaaaacgaatttaaatttgtatgcttgtagagtgatatatcatatatttatctatctcatcaaatggtttcaagatatttgatgactttttgagtgctgtgtatgaaacgagggtacatccacttgagcaataagaagacttttctatataatgtaaattaagatcagattcttcagttaagacgtaattttcatggctgaagaacagctagattatgtctccattcatgtctcataccgatagatgcatgcaggtgacactggctacggttagctggttagctaatcctgcatttgtagcagaggcttgtctaaagtgagaattattggtggccatatgcaggttaattactgcagctgcagcactacactgctgcagtgccataatgggcatgcaactgcacactcttggatcatccatcaatagtgtctgccattggggaggaaatcaaaagattaaatgtaggagaggaggtacctgacctgcatggtgctaagctatatatgagagatatatactcatctgttactactactttatccataaggccaaaagatgttaacagcttagctgctagtcatggaaaaaaagagaagaccaagaaagaaaaatgagtagccatcaagccatgagcctcctccattacttcttgcaatggcagcataggattctttcagtttctggatgccaggttgctcaactgttcatgccttgccggcctgaaatccagcacacaacaccaaattttcagtgatcagttttcagtatctgtattttgattagtatggctagctaagctccctgaagaaaattcatgcatgtctatgcagttgtgcacgtcaagttccaaaattacccccaagcttcatctatctgatagttacgaatttatgatcatctaaattctaaagtgaaacttttagataataaaagtggtttacatcttcggtctctgctgttgggacaaacccccaagtctctcttataatagatcagctgagatgatttttcaaaaacacatagattttagcacttaattctaattccaaagtgatgaattcatgtgccattgcccttcctctgatactccatgctacatggccgattgcatccaagagccatttgctttccttcaatcattaccctttcttttgatctctagaaaactagtgcatgcagacatgcagcttctcttgtttggattcagctattgttctagatgcatgcattgtagcctacctcttgtctgtttcggtgttgtttcgcgaggcagtaaatgagtaggggctcacacacacaacacactaataattcttttggtagctagttaattagaccggccgatcaaaatatatacaagtacacatggatcaccagatcgattcatgcatggatcgatctccccaagaactgttggtcgatcattaggcatgtgtccaaaggtaataagaatgagatgtcactttgctgcgttgggacctatctagctatcaagcaacctactagcttgattcaattacacttgagccatagcaaactcttccatcttttgttgcatgcttgccacagctaattgattacacagaaagaaaggtaatcggtcggttgattaattagtactgtagttaattaacatgcatacccgtatatgtgcatgatttaattactctaaattggccggcaaggctggttcgacttacctgtccttgtttgtcatgcaggctcgcgtgccttctgcttgggaccctgcatgtctgctcctgtttgctgctgttgctgttgctacatccaattgcaaaagtttcagtgccttaattttgatgtccaaacacttggcaacaaggtcgagatgatcagctgcttttagcctgacagcaacttggaaattagcattagtatgagatcgacatagatgccagacagtactgaaaatgtcaagaagttcagcgagccccataaatgaaatagctactactggtaggcttgttaaggatgatactacatctttctatgtaagttgagcatgctggtcgttggaggaatctgaatctgtcatcttccaatcagcagctagctagtatattcatgcagacacaaaagacacctgcattttttggggttctctcatctttcctggagagataggtagtaatttgatattgctcttttgtttttatttctagagatgatcaaacaagataagatagacacttggcaagcatgcatggatgaaaggagaagaagatctcaaggtagtacaagaagggtttcagtaaacagtagcaacattaaactctgaaaatgttcatcgccatgccctctagggcaggcaggcaattgccaatcaggaattagctgtgcaggaaaacaaacagtacagcatgctgacaatgcatgcaattaacacagtgacacaaatgattgacatttatcatgagctgccaaatagcacgaagcctgtcaatagaaaagctaaccacagttttgcaagttaaaaacagctggctgttacctgttaaccccagtgaatgaaaaaaagcttttgtctgacagtaacaaaacacctacactgatcaccaacagagaatgtgggcaatatacactggcattaattaagtgaataggattagcttgagcagacaaagtaattaagcagcagtaattaagtgagtgtgtactcacaggatgaacagagagcagaaggaacacaggataccgttgggccgatgggagccaaagccggcgcttttggacgctcatgccgctggaatccaaagacgagacctcaagaagattcctctccttctctctctagaacacagtcacattctctctttctctctctctctcatggccatggccatggccattggccatgctgttggttggcgccgttgcagcagctgagctgaggctgacgagatgagtgagtgaggtgacgctgctgaaaggcacaccacgtttcatgcctgcctctgcggctcgctgaccagtgggacccacgtttcatggagctaggggggaagtagcaagtacggactggaccacggccgctgaccggtgggacccacgggccagaggccggctgttgcagctgcagctgcagctgcagctgcagtagtaagaggggagtaatttagtcttgtgtcgtttttggctcattcatttcatcagcagcagcagcgcatcgctgccaagatcacggttcacgactgctctggaattgtacacttttatctctctccttttcagggcaagcacagagccatgatacagcctgaaaattattaatgtaaatagtaatcttcgtgcaaaggagagtctctaataatttgatcccatcaaatttgttcatgaacaacaagaggagagaaaaatagtttttttagcgattatttcaacagagttgtatttggaacctagcaatcatgtagtataatgctgagtttagttccaaactttttcttcaaacttctaacttttctatcacatcaaaactttcctacacacataaacttctaacttttccgtcacatcgttccaatttcaatcaaatttttaattttgtcgtgaactaaacacaccctaatttacggagaataaccttattctgatatcagaacagagaatcccgtgtattctgaatttctgatgccaaaactgttcaggaacaacaagaggataagaagaagaacaaaaggaaaatagcaatcgtttcaatatgtaagtatttggaacctatagaagtaacaatcatgtgtaatttgcagaaaccaaatccattttcagatcaaaacaagagaaaattctgcactatgacagcatcaccatctgctcccccttcagccaactgccctgcacagtttgcactgccactataaagcgctccctgctcctcctcctcctagcttggctcgcctctgctccgcttcgcctttgctccgacccggtcggcctcgccgccgtcgccgccgccaccgcatcacgcgcgcgcgcgcgcgacggcgcgagcgcacgggtgaggtgagagaggggtagtagagcagcagccgcccccgaccgcccacgcccgggccgggtggtggagcacaccgtggcatgattgggtccatggcctcctgaccccgcctccctctcctcctcctctgctccccttttgctgctgttgctgcttcctactctcactctgcttctgctgctcaatccacctgctcctctccttctcttctctctcccgagcggccgagaagaggcgaggggagaagggaggacttgattcttgcttgttgctgatccattctttcttgctctgctctgctcttgtgtggtgtggtgagcaatctgtgctggctcttctcctttcctgctctgctgattcttcgtttctttcttttctttttctttttttctgacgagcttggctggtagctgttcttgcagtgtgtccaggcttgccgcattaaaggagaggtggtttttgttgaccctgtttagcagcagcagcagcagcagcgaccaagatccgtctcgtcggggaagatgaggagatctgcatctgtatgcttccaatccctctttagctttgggataatgaggttgtgctctgctgacactgtagctttcttgatctctctgggggagatggatgccggtttggagggtggtagcagggttttggtgggatccaatcatccaagcacacacattgcagtttctgttccttccttctttagtgagtgagtagtggattggggattggggctggtgatctagctacaggctattacaacacaccattttgggggcttcttctgcggtggcatgggcactggatagattggtgttggtgctatgatgattttgtttggcattgggtagcattggcgcgtgtttgatctgttttgtgctaaggttgtgttgagcactggcattgggaggaactagaggccagatgttcatgctgcttgcgtttttcctgccacttgattgaaatgttcttttgggatcataatatcatgtgcttggctgaacagtgaacacttttgttgagactcgtcatgattagttgcgtttctttgatccaaaaaattgtttttccatgtagcaacttcagaggatacatggacacattgtttagctaaatatttggactttctagtttattcatgtaaaatattttttttgataggaaaaatacatgagactaccctaaattgtgcttgattggtgtttctgacacaagtagagacaagtttattcagatctatgaagaattatgctctcaaagatgcataattctggacaatttgcatcacttgtgttcatagatggaagtattcatgcttaatctgtttagtgttgatgctaatatgtgatggatactgatactgttctatttgaatttatgctagctactccgagtccttttggttttcataaccatggttgggactcaatggtccaatgtatccagtacatactgcaaggacatggcatcaagcgtatatcgaccccacagtgtcacaataactgaatttggtgctgttggggatggtgtgactctcaataccaaagcattccagaacgcaatcttctacctcaattcatttgcagacaagggtggcgcacagctcttcgtgcctgcgggaaggtggctgacagggagttttagtcttatcagccatctcactttgtcactggataaggatgcagaaataattggatctccggtaggataactcacatactttgcacatgataattacagccaaaatatttttgtgtgcttatgacatggtgctcgtgcacacagtatcatatattgccaaatcttatgttgatcaattgttccctaagaaccttgatatgaacactaaaatggtatttcgtagagacttgcacaaattcagttttcttgaagtttagaaaaaatgattaattaaatatttactttaattgatacagaatgtttttgttataatttcccaaatgtatttttcaggattcatccgattggccagtcattgatcctcttccatcctatgggcgaggtagagagctccctggaaaaagacatcagagtctaatttttggaactaatctaacagatgtaataattactggttagtaagtactatatctgcaccatgcatttctcttgggatgttactgtagttattttgtcagtatgtaaaaatctggtactcttggcaggcgctaatggtaccattgatggccagggagccatttggtgggattggttccacagcaacacactgaattatactaggccacatcttgttgagttgatgtactccaccgatgttgttatatccaatttaaccttcaagaactcaccgttttggaatatccatcctgtatactgcaggttggttgtctgaatagccacttgctttctgttaaatataagaattcattcacaactgtaaatttattgtctagagtgcttttgctaaataaacagccaagtgcttgtccagcatgtcacaatcctagcgcccctgaattcaccgaacactgatggcattgatccaggtaatatgaagttctgaatcattatctcccttcaatttaacctgattgttcataatgtcttacttcctcacttttcccatttagcattgcattgcattaagaaaaatggcaaaagaaaaaagtgactgcaatatcaatatgtcattcacaggctctttcttcaatttgccctgctttgtgcttcaaaatttgaaaaaaaaaaagaatccttagaacttccacttactgctgagattctggacatagaagttctcaaggaatcttcacccaaaaaaaattctgaaagaagattaaaattgttcttttgtgaagtgatcgtttatactctgctagagttttgaggtaccaatagaaaaggtattactgttttatgcaaaattaccaaaaaaagatagccctttaccactttggcaaaaaacactgctatgcaacagatacatttattttgtgatattctttcttgagatgcaactttaaccaaggttacggtacaccagttatgtattaacactatatatccatttagcatatttgcatctataactgtggtactaatggagcttcaatccattcagattcgtccacaaatgtctgcattgatcattgttatgtcagaaatggagatgatgttattgtcataaaaagtgggtgggatgagtatggcatttcctttgctcgtcctagcacaaacatcagtatcagcaacatcacaggagagacaaggggtggtgcagggattgcctttggaagtgagatgtcaggtggcatatccgaagtccgggctgagggtctccgcatcgtcaactcaatgcacgggatcagaatcaagaccgctccagggcgtggagggtatgtgaagaacgtgtacatatctgatgtgagcatggacaatgtttcgatggccatcaggatcaccggaaactttggtgaacatcctgatgacaaatatgatagaaatgctctcccaatgataagcaatattacaatcgaaaatgtggtcggcgtcaatgttggtgtcgctggcatcttggaaggaattgagggggacaacttcagcagcatttgcctgtccaatgtttccctcagtgtacagtctatgcatccctggaattgttcgcttatcgaaggttattcaaactctgtgatcccagagtcatgtgagcaactcagaacagattgtggacagacaccaatttgctatgatggtggaagttcttcagcaatacatgcacaggcagccagacatagattgtcgagtgccagcagattgctaaatcctttactgaagttggcgatgctgtagagtaggtagagagatgctctatttatttgctgcagaggggcttttgcttcgtgggatgcgtcatgtacatctgattcttgcgattgttttttttttattagcacgatgtttgcttcttgtatatagttgtgggagatgaatgttggtgtaccatgcatgtttttgtcaccatctttgatttgtgatgtatctgttccatagccttttgttgggaagaaaacagtatgatcctccttccaatatgtccagttttgtggatagggtcatcaaaattgtaacttgtaagttgagtagcaacaagagagaagagtcagttttaatcattcttttatttaaagatgaagagagcagtcagtttcaggagcgtgaaaacaaaatgagtagcaacaagaggcaggatgtctaattcattctctctttatttttttttaaaaaaaaagatgaagagaagagtcagttttaatcattcttttatttaaagatgaagagagcagtcagtttcaggagcgtgaaaacaaaatgaaaaatggtgatagctcctgaggtccaaggaaggaagcctcgttcaccagcaatatattaccccgggcaacaaattttggggtcaattctgcgtaggcactccaaactttggggccaaatgagcaatttttttccccaatcaataaccgattggacattaaacaagaaaatgagatagaacaattttctttcctcataatgagagtaacatatatttaaattgatagcttatggtccactaatggcagaatgccgaaggttacattattctttctgacttctgaacgtttggaacttttgcgatgtgaaatcccacaatgtatttacttacaattagtacatccgaaacttctccttagtgttctcgaagacttgttcagcaatcagggctccattgccatctgcccgccttatctccaagttggccttctggtagtaagcagttcccctcaaagcatcagcaatgaagtcatcgaatccaatggcaatagcagcttctgccttggctccatacaccagcctctgcattgcagcattgaaaaatattgttaattaagcaaaagctacattcttccaggtgaaccataataaggtaaggaactaaccttaatccgtgatagatgcacagcgccgaaacacattgggcaaggttcacatgatgcatacatttcacagtctgacaactcaatttttccaagctttttgcaagcctatagcacagaaaaacatttattatgtgaaaagataaccaaacaatggaaagaaactaatgttaaatgcattatcggcccaaattggctggcaaagaatacaatagtcatactgctgccaatcagtgtctcagtgaattgttcctaataaataagagcttgttttattttttaaagcatttctgttgttttatccgccagcttgaaattatctactccatttacaccatcagccaaagaaattctgagagtgcaaaacaaaaactaggaatttctgtattcactcatgaccttgttttactggaatctaaacaatttttaggccaataagatctctgtattttaagttaccacctgccaaaacatagctatttacagcacttttctatagttagaattgagtacctctgatgttctgatacaaaggatgaaaggaaaaggacaagcatacaccatcctagctgttgtaacttgtgaagataacatctagtatatttttcaagctgcggcactaatatcaaaatgaaaaggtgaatctatttggctgtccagtatatttgcattctagttttaagttagagcgtgaatcaggcacatttaatcagcagagatgaggccactactaaagaatgctaagtatcaacgaaatgtaaagagtaaacaccatgtagctggtagccacagtacacagggcaagttacctctcttattgcagttacttcagcatgcgcagttggatcagtgtaatccaaaaccatgttatggcaactaactactatctcatcattacggacaacaactgcaccaaatggacctccatggccacaatctactccttggtaagcttcttcaactgctttagacaaaaatttgtgatccctgtcttgtacggctgtttaatgcatcaaagattaaataagtgagtgtttaacagtcctccaatcagcagaaaataacagatgttggacatatataatattcattggtcaatcatgtccataagatcaaatctggtaataataccttcctgatgaccagcaaatgctgaagcaactgagatcgttccgtccttggattccacaactgttaaaaatgaagaaaataattcatttgactgcttggaaatgattgtttcagctcctcccaacaagaagtgattatattaaagaattttaggctggaggactgaagaaatcaacatgcaggccattcacaactatggtaaatagctgacaacagaacaagatttacttccatggccatagtcccatgcccccatgtaagacctatctatgatgaccaaagccacatatctatagtccccaaattgcatcatgtcgcagaaaccaccacagttcctaattctgacaaatgcagaatcctgttttggtttaattgaaaccatggatttcttctgaatgagttccaggaaggaagcaaagtaagtagcatgccagaagcggcataacaactatagtatgacaaatttggaagacatgaagtgcatgatctatactcctgtgcatgagaaaggaaataaatagcatggttcaacaccaagtcaccatcagcatcagccaacatggaacactccgtttgtcttgcaatcacccagagcaactcaaaactcttaaatcctacccctcttaccgcaatcacacataaaactaagcctaagaaagtccatcgcagcctacccatgaggcagaaatgagcaatctcttcctatcccaattgcagcagtcggttaattcaccaaacacagaatcgaaaatccatcctactcctaacaatactcctaacaggtagatagcaaatctctcggccccaaatcctcaaagaactccaaacttgttggatctcatctcactcacgccccccttttctagaccaaatcatcaagacacaaagcaggaaacaaaatccaacagttcccgccccccaagcgccgcagcaagcaaccactggtgtgcccgtatcattgacgtcatagcgtaccctgagcctcctccatggcaggagcaggagcaggagcggagcgcgagatttgggggagaggagaggtgacgggtgtgatgagatgtgttcgtcgcttgcagggatggatgggcttgggtggccttgtctcccgtgctggctgtacatatagggcctgggaggggacactgacgggtgggccagcccatgggcctgcgcgaggccgacctcgtgtggacggaaaagcgaaagggaaagcgcggatggcggatgacgcaacgaaggggcgccttgtcaacagaattaggggggccccaccagatgtctttgtccaccgtggcacggcctgtgggctaagcacatggtgtccaagggcccatttgttactagtagctcaaaaatattccgtgtaaactttaggtgcaaaggaaaaaaaaactagagaaaatccaaataatgtaattgacaaatgtacgagcctaaaaactgtcatcaatgggtgtaaattctgtaaaatatcatcgtacaaactaatttgtttcataaatgttatcgttgttagggttttgtccagcctgtcctgttaaatacgttgttcatcctataacatttaaaccttaacaatgatagtatttatgggataaagtcaattgtacgataacattttatggaacttacacttgttttttatatttcttagaattgtgcgccttgccaatgatatttattgcattttctcataaactatagtgcacctctctaatagtgactatgtaatgtgtaatggtattgaggagatataacttcttgattttttatagacgatagttaagaggtaagaacaaatttattttaggatatatttggaactctatgaatcaacttattttatgatggggaaattaactgatatcaatcatacgctgtccctctttcaaattcaccacttttgtattttctgaaaaacattacaaatatttttgtttatcatagtctatcttaattcgttgtaaaacgtgaaaccatgataatagttaacattgtcggttatttgaaaatgaagggaatgctagttcgagttggatgtaaattagtttaatgggtaagctatcttaaattaaaatagacgctctaaacgtgattcgtgtgtattgttctggtttgatttgtttcgcacttaccaccaaacttagattatactatccgacacatctgccattggatgctccctctttatcatgtcttttgatgaaaaaaaaggagcacaatccctctctttttacctactcctttttctttcgacgattctgcattctacacttggcagaaaatatatgttatttaactcttttaacattactaacattactttcgacggccatgttttgcacgttaataatggtatattatactaacttgaaacggtgctatgctctgtttaaaactgaagttgctttcggctcgaaagagatgctagaataaaaaaagataaggggggaaaacgttagtacaatgtactcccttcgtttcaaaataattttatttttcatccacactacatatgccaatacaaaacaaaaaaaaacccactttattaaatctcaatgcaattattctctactttatctattcacaatacaattatttcatatattttaaaattctaatacaatgattacttaaaaataaacttatttaggaacaaatggaggagtaattttatttatggaatggagggaatattattttttaaggggaaaaaagggagaagttaggatttaggtgggacccacatgttagctcggttggactaagtcaacgtgccgccttagtaaaaatcgctctcaaaaccgtcccatcaagaaattcaaattataccaatttaaatagttgggatcaacatatccgttatcgatacgaatcagtgtagacctatattaagggaatcaaagtggacttattcgttaattcaatgggccaactaaaagtaattatggccatttgcagaagcggaaggtggaggcccatttatagcattgcacggaaaaggcccaagttaggtactatagcccattccgaagtctatcgctatccacttcgtccccgcgtcgcgtggcccgaagcgagggagcggaggctgctcgccgcgccgcgccgcgccgccgcgcttggtcatctccgccgccgccggccgtcgccatgggcatcaaggtatatgcatatatagcacgctcttatcaccgaagcgctcgatgtgacgtcactctcgctgactctcctctgcctgcgcgcgtgttcgcgatagggtttgacgaagctgctggcggagcacgcgccgggggcggcggtgaggaggcgggtggaggattaccgcggccgcgtcgtcgccatagacaccagcctcagcatctaccagttcctcgtgagtttccccggccgtggcggcgtccctccctctcttatctactctactcccttccgcttcagttgtgagtatgattgtagcaatcgtgttatcttgttttgggaatgccttgattcggggaaaatttagtgatacctgcctccgtggttaagtggtggcgatctacagtcagttggagttgggttttaacttctaattcacattaaaagtttgagcaaatgcaaacagtggcgaatggtggcgattgtgcagtcagttggagttgggttttaattcgcattaaaagtttgaacaaatgcaattgtgcaaacacttcgtatcaccagtagcttctatgtataggaagtcagtggcttaatgccatgagcggagcctcaatttctacggtgtaagatagtagcaaacttatatgtagaattgtagacaaaaaggacatggctaatgatgtgaattcactgccaccaataccctttgcattgataccctgttctgattgactgggaaaccacttggtagcgctcgccatctaactagtgatattattttatgctgggaaaaaagcttattgatggattgttttgggggtaaggggattcagatgttctgtgtatatgacatttctgtagattgtggtaggaaggaaaggaacagaagttctgaccaatgaggctggtgaagtcacaaggtgagggaaagtacactgtaccctgctggtgaactcatgtggttatgacttcttttagataaaagaattttacatgcatgtgaattgtagtcatctgcagggcatgttgaaccgaactgttaggattctaaaagcaggaataaaacctgtg

SEQ ID NO: 5518 - DNA, 4156 bp, Oryza sativa
tagattcattaacacctaaatgaatgtaggcaaatgctagaaagtcttacattgtgaaacggaggaagtactgttgttgacaggaactaaatgctaaaatttcataccagttttgtgtttgatggtgagccacctgacatgaagaaaaaggaactggcaaaaaggtatactctgaatagtgcctttgctttgattgtttcttgtgagtgtcagtatttttatttcctatgtttaccactctttaggtctttgaagagagatggttcttccgaagatctaaatagagctattgaggtcatctgatcctaaccgtagtactattgcctccttcttattgtacctttttacttttggggtgatttatctgttattgcattgcacctctgaggcagcatttatgttacaggttggagatgaggatttaattgaaaaatttagcaaaaggactgtaaaggtaattacctacgtttgggggaagtgagccaatcaaaagtttttacagtaactttaggaaatacttcctccgtttcacaatgtaagtcattttagcatttttcacattcatattgatgttaatgaatttagatagatatatatgtctagatacattaacattaatatgaatatgggaaatgctagaatgacttacattgtgaaacggagggagtaatatgttaatggattttttataaagcagcatcacaaaatctgccatttcgagatttgtcttcacaactcaattagatcgtctataaaatcctgctgttgtccaaagcattaatcaccttttttttcttcacaggtcacaaaaaagcacaatgaagactgtaagaggctgttaagcttgatgggtgtccctgtagttcaggtacaattcgtgcttaatccatcagtttcttcctagtcttcgttttaccacaagatgatcagacgagacaatcaactttcctctttgatatgctttcccaactccctggagagttagcagaccatttggaaattcttataaccaaaagaaggaaattgcaccagcctcactcatagagttgctgcttgtgatccggtggtcttaaacttatgggtcaacatgtcataaagcttagattatcttacatagggttctattgcaatggcttcaggcaacagtaaactacgtaagaagtccagcttatgagaattctagatgttaaggcctgctcagcttttgcatgtgtagatgtttgtttggtattggcctaagttggacttgctgttatgcttgagcgctagctaggataacccggctttggtatacatgcagtattagattggtggaactttagcaatcaacaattggttcttatgttatagacatcaccacacgtgggacataattctatttctttttgctccatttgagcaacatgccatacctatgatctcagggcaaagatgcaagcatgatacttggctttaatgagttttcactgttatttctaatcaattcatggtatcacatatgcaggcaccaggggaggcagaagcacagtgcgcagcactctgtgaaaatcacaaggtctaacaagccgatgattttattacaaatttatgtcgatgccctcgtcacatgaccgaattatattttactctgagttgtgactgtcaggtctttgctatagcttcggaggatatggactctctaacttttggtgctagaaggtttcttcgccatttaaccgacctgagttttaagagatctcctgtaacagaattcgaagtgtcaaaggtaatgctttagtaaatttcatcatcaacatttttccgagcatcatggcaattatttgttggcttccaggttttggaggaacttggactcacaatggatcagttcattgatttgtgtatccttagtggctgtgactactgcgagaatattagaggttttatcacgttttttcttttttcacacacttaatattagattctaccaatgatatcatattaccatgctgtattcagaatttagaggttgcttcattactttctcatgtcatgggtgctttagacatagcattctccattgctaatgtatctataatagaaatgtggaagtgtgatatcctattcttgagttaaaaacttcaaattatattttctgcaattgcttttatagctcaacgctttgtgcttctgttggctaaatcttgaataaatgccactcaaagttctaagaagattgtagagatatcataatgctggagaattgaatgttgtgtatgctgcatccttccttgactatctttatcataaatttatacaagtccttgcattttattattacttcttgtcttgttttgaataggtattgggggacagagagctttgaaacttattcgtcagcatggttatatagaagaagtagtgcaaaatcttagccagacaaggtatgttttccatgggatttatgttaaattgatgacctggttcaactggcatttctttagtttgttgttccattttctgagtaatcttagtttctaggttttaccatatgcttcattttttttttgagaggtaccgtatactttcttgatctgtaggtatagtgtcccagaagactggccttaccaggaagttcgggcattgtttaaggaacctaacgtttgtacagatattccagacttcctgtggaccccaccagatgaggaggttatgcttggtagttgcccataccacacggcccctgttgtttatcatgctgacagttcttgttttctttgtccagggccttataaactttttggcagccgaaaataatttcagtcctgatcgagtagtaaaggcatgagtgcatcttttatttcacttatatattaataattccccttatgcatattattgtgaaacaattgaccctttcccttatattcattcaccagtctgtagaaaagataaaggctgctaatgataaattttcccttgggcggtaagcaacaacagttaacatgttatcttgtggagaaatatccatgcagttctgaagtggtgttttttaattgtttcagagggaagcttttggcaccagtagcgaacttaacaggatctacatcaactgcagggaaggtacagagctacttattgtttcatctctcttatttactttggctcactaacatattgcacgggctacacatgcaatcatgatatccagcctacaccctagctctctgaaaattggttctatcgcattattgcataacttactgttctttaggtttcagttaattgtggtgtgtattttctctatctgggctgaaatatatctgctgttccatgatttgaattctgatagccgtttgtagctccagaaggccagggtagtgttgttttctattttactttttttacatggattctttttttacccttaaagtatatttcttcatagcaacatgggtttaatttttcgttgagttaacggatgctacataccactgcaattcgtccaattgtaacttcatatatagttgattatcatcttttcgctcctactgttctattgatacgtgctcgtgttctttgttctttctttgttgttctttcttctgccatcttaccatgtcgggatacattttgtgtaacatatggaaaaagtaggattagtgtaacatggatccttacctagtccatcaattgtcttggataacaggaacccaaatgtatcctgggtggtccagggcaagtcatgaaggttaggtcacctctacaagtgtgcaagagctcaagcttgaacttcatacatgacaattcaaaagcgttcatgctgggcaggcgatcaggatttctcagaatatctacatatgcttccatctgaatctggagctgctctatttccatgagttggttggctgaagctttgactgacaccatctacagcttcatgaagaattagtgatttcttgaaatgcgttgagcctatgctattattgtagttcagccttttgccttgtaaaatcaagttgaatgcttgagctttctcacatttagcactggttctcgcttgagtgttgaacggtgaccatgaagaatttgatcaccttttggctataatctgaaattttgtcaaggtgccagaacgagcaggaaactggttgaggctgcttaactttcctggtgt

SEQ ID NO: 5519 - DNA, 2173 bp, Oryza sativa
ttaccttctttattactcttgacttcccctcttgaccattgtcattgagacatccacgcccatctcttcttgtacagtctctttcagttctctagctttccatgacggattagccttaattacactctcgtacttatcacaaattctacttgtagacaaccttttgttttttagatctgggcagcaactatgatttccattatatgtcacgatctgaaaccaatcactccttgagttgtaagaagcatgcagtaaccatgtacaacctttccgcatacaaacagccctaagtctgtctctgtcatttttgataaattttatatttaccttctttttcaacgcataccttgttattgcatccttcaattgcatctttcctctaaagcacatgtcgactgcattttgtggtaattcagcatggttatcaaatattggaaaccgacacttcctcctctctgcagaatccccactatcatcatcataggatgcatcatcctctgaatcaaagtatgcaatgccatctccctcgtcatttacctgtgttatggtgttggcatcaacactttgaggaagatccaactcaactggggtgtcaagtggaatttcttctctccttttcatttttttcttgaattgcttataattaattcttatctcatctgcttcatcatcttcatcctctgtaaaaccagtggcatcagaaccactatctgaatctaagccttcagtttgtatgttcgcgatactgctattgggattatcacattgtgtgttcgtaccgccctttgcaataactagagagtctggaaacatgctattattatcccgaaatagatcaaatacagcttcatcagaatgagcctctaccaatgtagaactgcaacccatatccaatttaactatttcagtgtaaatgtccacagctccagtagttccaacaattttcaccatctccaagcaggactgatcatctacaagcagcctcattccattatttagtgcatcaccaggtggtaaccagtacattctaacaggctgttgaaaggttgtgtgatccaacagatggccttcaagttctgggattcaaattttctcaatgtctatatgtgacaagccctcatccccattaatgtactgaacttttgacccatcaagaacgaaatgaccattgaaataaaatttaatagctaatagctcagaatctgccatctgctttcgttcctagacaaatctgctacacagtagtggtgaaaaatcaaaacatatccaaaaatttaatgcgatcgaacaagaaaaatgagaacttgcctctactggtgtgatccacgacttctgcaaactagcactccaactgatcgcttggcaaaaccccagagcagtgcataccatgacagagcttggcgaagcttcttggagccgtacgtcggcgttgccccgtgctgcggcgacgcggctgaacaggagcaatcgttgtgcagcgctgcgatgccgcgaccgccgttcgccagcgaccaaaccctatcagggtttagacggagaaaacaaacagtggagtaatgggccggccttttttttcttccttcctgttgtttcctttttttttccttttctttcttttttatatggtaagggtagaatggtcatttcatttgtattgttgcatgcaagaatgacttggcatgcttatgtggtatttttgtgggaccaaggactatgttaacccaaatgattaatttggaggacttatttggacgttttgaaacctcaaggactaaactgagcccgaagcgaaacttcagggaccatattagctattcttcccaaaaggaaccacattaggagtcactactagaaaaccaattttcccaagcggccaaaactaattttcgcagacgggagggaggttcgcctgcaacacaacgactgtaaaaatcgatgattttcgcagtcggggcaacggccctcctgcgaaaatgcaaaaaaacgaacaaaaaaaaaaatcgccgcaccgccgccgccacgcgactcgccgccgcccccctcccccggccggatctgagaggggaggggaggggagccgccgctgccgccgtcgtcgtcgtcgccgccgccggcctcccccctccctcctctggccagatctgcgagggagggagggaggggagaccccgcc

SEQ ID NO: 5520 - DNA, 38650 bp, Oryza sativa
ccagccagatctgggagggaaggggcgaggggagacgccgccggccgcgcgtcgtcgccgtcggccccgccgcgccgccagagatgaggggagaggagagtcagtgagggagaggagaggagaggagactgagtcagtggagggagagggagagagagagagagttgagtggtgggaggggtgggaggagaagataagggtgggttttttttttgggtaggtacgatttttgcagtcggaccacataaggttcacaagcgccgcttaagtaggccgcctgcgattttcgcaggcgccgcttaagtggtccgcctgcgaaaatagattttcgcaggtggacatcgaacttcaccccgatttatattttttgtaggcggtcatttagctataagagtcatgtccgcctgcgaaaaaaaagtccatacgttggggaaaatgcgttttctagtagtgagtttaatccttcagtgataatatatgatttggttttacgaaattgaatatttaaaactctgactaataattgaactaaaatttaatcttggatgtagtatcattatacttccttcccttcaaattggtaatacttgttgttttggataaaactatggtcaaatttttaaaactttaactataaataacatttaaaatatttatcttagaagtacggagagcatacatatggattagtcttaaaagtagtttaataaaatcatatatttattgatatttctatatatatattatattgtaataaaaattagtagttaaagttattttttggagaccatgttattgtccaaaacaataagaattaccaactcgaaaggtgtatttatatttaaatatattttcatatgatattaactttatagttgttgataatgcattatgaaaaaaaaatcaaaggtctaaagtaattattacgaatgaaatcaatggaaaaaaaatcattactactaccacagcaactaaagtatcataaagatgctctatagaagacaaattttacctgccctatacgggctaattggcaggcgtgccaattggcacgccaattttttagtttatctcttattcggaatgatttatcatcctttctctttggggttccgtaagaacttaactaaatgtgttgaaggctctcctccaaagagccaatagtcaacctcctatcccctggtggtggctctcccgttatactctctctagggaacaactcattactcatagattgggccggcgtatctcatcatcagagaattcttcttgacttctccgcatcctcgaggcaacatggaaaggcccacaatggatagggcagggtggctactttcatgctcgttcctccaggacctcgaggccacttcgcatagggcccacactgagctagagtgcgatggcaacccgccatgtctttgctgcatccgcgtaggcatgtgatgagcaggaatgactgcacccggttgggtgttagagcaaggctaataagctggtgattagccggtacatgtcatcttgatctgatgtggaaggaaaaattactccctccgtcccagaaagagacgaatcctggggggagagctttgtcccgaaaaaaaccgatttctggacagaaaacgagaaacttcccatctatctcatcctgtgtgggccataggtggaccgcgtatcctctcgttcacaccacgcaaaccttatcgcctcccagttttttttctgtcgcgtctctctctctcgttcctcctggatcgattccatcgccccgtcgcctctctctcgcgtttctctccatcgctccctcaccccctcccggatcgattccgtcgaagcggcggcgtccagatgagcgacccttcgaagcttccgactccctccctactgccgtcgtgctcctccccacacatctctccccgctccacgccgctccccctcacttccgcaactccctgcggagttccccatccaccaggatgcgggcgcttcgatacagcgggggagggttgcgagcggttagatccgatgccggaggcggctcctttcgaaggatttgcctcgatggcagagttcgaggcagcggcggaacagtttagggttttcattcaagagacgaaagccaaggcggaggaggcgtatcagcttgcggttttgatccaaaaggcggcggcgggagggggctcagatgtggcagcggccttggaggtttgcaagaaggcggcggaggcaacggcggcgggtggagccagttcagatgcggcagcgacatcggagatttgcaaggcggcagatgtgatggtcaaggaggtggcggcgcacgcggatctgatacaggaggggtcggcggaggaggaggcttaccgacctcctgttctgattccggtggcaacagctagggactttggcggcagtatgcgtggattgactcaaaggtatcttcaccttgttttccctacaaccaatctgttccccttatgcaatgagagatgctttcaatgacgtgtgtagatcagatgcactgggtgcggttgcatcccaaaatttttttgattgtactgcatagaatatcctaggttaatgttgttcggtgttttgtatctttataatcatccagctgttatatgtcggtcagtgttaccaatgttgaagtaatgcgggttagctgggttttacattttgttttctgcaaaatttggcatggagtgagaagggggttatgatgacatgtttcaaataaaataaattagtgttaacaaaaatccaagcagttttaaacctaaccaaagcattcctttctgttttgttgcccataggtatattctgaaattagaaatttttattgagtataggaaacaattataaactgtaagaaatttgatactgaacatgcgaattttatttctcaaagttttttttgactgctttattgctcaatcaagaggctgatgaaaaatccaaaattgtggtgacactgtaatgcatgaatattaatacctctgtttttaaatataaaacattattgacgtgtaggacatgatgcttgattgatcatcttgtttaaaaaaactaagtatatatggttaattattttgttctgacttgtttcaatatcagtaaagaaacttactcctgaatgcagctcgtcgtactcgctttgttggctgcagctacctagccagcgtatgttgcttgcttgacttgttcattttaacactgaaacctatcgttgagaagcttcaacttgctccaatagtacaactgcacccacagatagttaggctgtcattcatagctaattaaattaactaggtaaccttgatgttgttctacgagaattaccgtggatgctatactttgatttctgcaaatctttttcgattgttatacttctattattcactggatttgatcctttaactaggccacgcatatataaactgatgtactctacttttggctttcattgcgttcagtagtccatttggtctatacttcaatttagacattgcttatttacatgggtcagcactatctttttaaaaaaaatgtatcgaatatataatgtaatcgaagtacatttcagtttgattccatgatagattcatctttacatcccatcttgtattaactgtcactgtgttttatccgttacaggactatgttgggagatgatagcgaccacatggccatgttcgagaagaaggcaagcgtcacgcaaactgacatgaaggagaagaggggaaaagctaaagatgttagcatcgacgaggacaagtcaagcgatgatgatgttgatatggtcattgggggatatgcgcaagatccatacgatgatagcggcctagaagaactcctacaagaccaagacgcactggaaaaatcggtaaaaaaatttctagagtgttttaatagtaaaaaatttagatgaatgcttcaattatgtgttgattgtgtgcctgtttggtgattatgaatggtggcctaacaaagtacctcgaagtaggtacccttttggtattgtatgaaattatgtgtaattatggtagtactttagattaggtggttattgatagcagcctaagaaggtatgttaaagtaggcacccttttggtattgtatgaaattatgtgtaattgtggtagtactttagattaggtggttattgatagcagcctaagaaggtatgttaaagtaggcacccttttggtattgtatgaaattatgtgtaattgtggtagtactttagattaggtggttatgaatagcaacctaacaaggtatgttaaagtaggcacccttttggtattgtatgaaagcatgtgtaattgtggtactggatgagattaggggattatgatgatgcatgtaatgttgattttacattgtgacatatatataaaactccctcgttcccttttgatcagcgcataagtaaaactgaaatgttccaatttgatcaacgcattagcctaggacggtggccatgactcttagatttgcatgctgatttaatttttgcatgcatgcaaggagacgctggccattcatttcgcatactaggcactagttttaataaaaaaacggggtctctctctctctcttccgttttgcatgcaagtaactgaagtgctaattgtgccttttatgaggtgggctttaaatgataatgggagaaatttacttcaccttggtctcgctgcacgattgcaatacgtcgatcaaaagggaacggagggaggatgaaatttaggcaaaagctcaaaccatgataaaactttccacatgacatgatactcaaatgctgatactgcattgtcatatatacaatctgaaatgtagccaacaaaagctgaaaccatcataaaacttcatattacatattacaaaagctgaaaccatcatagaacttgccacattgcatgattagttgcatttacttgagtaatactgatattactttatcatatatacaacatcacatttaaccaaaagctgaaactacgatagaccttcccattttgcataatttactgcacttgattggctaatgctgatatgaccttttcatacagttcacgaccacaactaagggtattagggagaatgtccagacgctctagcctctctttacccatatgaggtattctgtatccatttccaccatcagcttccataacctctaacaagcaagattgtagtgttaggaacaccctatttagcttgttgtcatcataggcctgaaattcctgctcaacattatgtattagctcatccatattcctagatatccttctatatgttaatgattgtagcgatgcaaagaacccaagatctaatgcattcatatctggggaattaggaggctgatgcataaggcggatgtcaaaccctgtttgggatactgcataggcaaattgataatcatccactggcacatgagcaggagcattgtcttgctgaatccatatagtgctgtgtgcatcgtctcgaggccaacttgatataatacctggtagtactttagcaatcagaaacgaccttacggtgtctcgatcaaccttgattgtcttggtgactagagttccccttggcctgttttgacttgtcctttgtgctggttcctatgtatataacattaagtaagttagataagcaattaagtttcacatcacatcactaagtaaaaatgcatatattaagaggttataatacctttttggtgaaaggccacaagcctatcttgccgtcaaaagtgcagataccttcttcattgtatctaggcctagcaactgctgccaagaacatcactttatcaatagaattcttgttttgcacgggtctgtacggatcatcctcccaatggaccaggtaaaaagttcttgtctttttagtggtattgaaccatttttcatcgatgtgcacaatgttgcgcatatcaacaaacttcggttcatttggcaaagtatgccaatctaacatggaaatacaccattgcagccttgatcgtttgttctcttccttcaacaatggctttaatgtgtttgagtgacgtcttatcagcccttctttcaacatcctatgaagcgtgctttttggtatacccgcggctgatgcaaatgaccgtaatgtgccccttagttgcagggggacattagcaacatctgacaagtcaatttcattcttcttgcgaccagaattagttttctttctagaacttacattgactggaattccctgtgcacggcactgctttgctcttcgccaaatatcttgcactctaccccttttgatattgaacatttcagcaacttcagttgttgctttttttcttagtcttccattgatagttttcttaaccaatgcatcatatatctcttgcctttgtatgttggtaagatttttgtttggatgttcatcttcctcatctgaatcatccaactcctcttgttcaaaaacaatttccacatcaccagcatacacatcgtactcctgcatgtctacaacaacaattacaaggtgagtcgtctgtaccaatttagatggtggatattttattatcatggatcaacatggttgtaaacttatggctgattttagatttcagaaggacatagaaacattgacacaatttactttatgtgctgaaatgtcaaattgacatccataatttgcaactaatgcatccaatgttatgtttagattattctaggtagttcgcatgatgtcatattagtatcttctaattaaaaacatggtttcagttaattaatcttattcttcagtggtgctttatgtacaaccacattttattaattttactaagtttgttatccatgtcagctaaaagtgctttacctgcttgcatttgtagatgttcctcataggcatcagagttaacatcaaaaggaaagccatgttggttgtgacctccataaatttgcagaatttcatccatggcatcggcaccgtctacaataacaattaccatgtgagtaccaagtctaatatcaatattttgttaggtacaatactattgcagctattttattacattctacaataaaataattatgggccattatactcagatagctcacacattgcattattacaaccaatcattagtgctgatacttgctatttgacatgccatgcatattggcctaactggatatgtgtgactaaaagtaataatgcttatactactcttccaatgtagccaaatagttctatgaataactgatctgttatgctatatatataatggaaccaatgattaatataggttactttgtgcagtacaacatcagcaaaggagattatcatatctgaaaaccacaatcaaggtaccaattttatatccatctcaaatttagttttgttgtctacctattttgttattgtactcttcaccttgtttttcaatagaggtccatgtcagctgtaaataaactcatggaagtgctcatgtttctttttccctaacttgtgctattcatgattgtgattttatcaaaaggtgcttgtgctgtagtcaggagaaccattgggtattttgctgctttagttatattatggccatacttgaatgacttttctacattgtacaaactttggtgctgaagttcagggctttttgtgatctgtattgaaggtgcaatctaactttgatatatactaatactagctcaatatcagtggtactgtaaaggaaattatacatgtagaatctagcatatgaggattgattgtagacagaagataagcatcatgtgagcactatttgattagttatagctagatacatgtataacttgtgatattatggaagggaatgaacttcaatatgcccaactcattcacagaatcgagctggtaaagaacaaagagaaaaaaaccaagaacatagcagttccatcaatgcacatggtatcttttttaaaaaaaaatgccaaagatttagagtgatttatgcaagtcatatgtacaaagatcgatcgtttactattcttgcttgcaaggtcacctggatggttatggttggcacctccctgcacatcacctccaagttgatcctcctcttgaccaacatgcatttcaacttctgcaaccactggttcattaaggtcaggcacatcatgctcatctccctcatctgccactggttcattaaggtcaggcacagcttgctcatctccctcatctgctagttcatttagatctaaagccatgaaggtggtgtttttgcagactcatgaagtgataagttgggagggaaacttgtgagaatggttcattttgagcttttatagggtatcttgtgctggggtgtgctcaaatttgtatttcttgccgccaagcaatggtgttgtttgattcaaattagttggcgcgctggattagtggcctgtacagatatttggtgcccatgattggtgtactacttgtactactctactcaagttggctgcagatattcaacttgtattattattttatttgtaactaatgattggatgtacttgtattgagggcattgttgtcttttgtcacttgtcctaaagttgcattgggattctagggtttgtgattttgtgggacggagggagtaggtgtgagagaaagaagttggctcttctgcaaccgcctgctctgcacaagcgcctagacagactgacaacctaagcccacattcagcgaggggagaaagagtagaccccgggtccacaacaaatataaaagatttatttactaatacgtatagcgtctgcctttatttaggttggctattacatgtagcgcccgttccgtcgtggcgcctagcgggaaaactatctcttaaaaaccctatttgtgaaatccgtttctttgcttgttgtctagtgtccgtgccatctcagatctcaaatccccgatctatcgtcaagttcaatcccgaatccaaatccttcccaaatcaaatccctccgcaaagtctatttcgcctccctcgggttcgatgggccgaatccctctcggcccatctccccctccctccccggctctctctctctctccccgctctgtcgtaagccgcgccgagccctccctcccgctctcgcagccgcttcccgccgatgccgcccaaatcgccgcgccgcccgcgcgcgcgcgcgccgtggtggccgaccggccagtcgccgccgccgtcagcgcctgccgcgcctgccccgcgtctgccgcccgtgtcgccgctccactccaaaccgccccgccgtcatcgccatcgtcatcgactcggccccgcctctccccgcgcgtgcctccaagggacggatgcagacctcccccctctgccgcgtcgccctctctccctcccccttttccccaagcggcaaggaggcaagccccctttctctcccccccttttttctctttttcctcccgccggcgtcatccttccccccctcctgtcgccattttggccgcgagcgccgagcgccagctcgctcccttgaccgcccaaggtcggtttccaaaccgacatcgccgccctataaacccaagcgcttcccttcctctttcccctcccaatcttccccgtttctcgcccgcgccattgctgtctctctcgccggccgccgccatcgcgtgtgccggaggagccggtgcgcgttaggacgcggaaggggactccggacgcaccctctccttcctcttccccggcccgaggccggagagatcactcccgtgccgtcggcctcttgtcacagcgccccgcctcatctcggtagtgcattcccccgttctccctcctcgatccatctcctccccttagttttcggtagtagcatgtgtagccttcccgtagctagctggtgccgccccgaccgttgccgccgctcgctgtgtgctcgccgctgtcgccgcccgtgctccgtagcgcccgctcgtcgccggcctcgctcggcatagctcctcccaatccgacgctagtaacggattcccgtagccgcgtagatgctctcaccgctgggaatcggcccctcgtgacctcatcgccgtttcccccttctcccgccgtcggttgccgccgccgctgcaatccgccgccgtcgagcatcccccggcgaatccgagccattggctcgtctcccctcgtcctgtgcaacatcccggtgtgctcgccttcgcctgtatcaccatggttcgctccgccgctcgccgccgtcgtccgccgtccgttccggccggcgtcgtcgtctacctcccgccggcccgcgtggtagccacgtaggcgccacctcggccgcgaccgggtcaagcagaccccggtccgctgcttccctccgccctctcgcgcgcgcggtccaccgtgagccgtgaggctgcgcgtgggcccgccgcaccgcgtcctccacgaaccgcgcgcatgcgctgcgcctccctccccaaaccctagcacgccccgcgtgcacctcgctcacggtgagccaagtcgccgacaagcgggtcccacccaggatcacgcgggatggacccggcccaccggctctctctctcccctccccgcccgcgcgcgcgtcttgggccgccttcttgggccggccggcccattaagcttggacgagccgccccattctctcgggccgcgccctagccgcccgagggaagtctaatttccctccctccttcttttcttttcttttctttttcaaaaaggatttaaataaatccttttcctttagaccaaaaatccaataatcttagaaattcaatatcttcccaatcgtaagtccgtttgactccgttcaacttccaaaattcctcaaatctcgagatctatctaatggcacgcttagaggtcaataatagggctttattttcgccgtttgctgagttgtcccgtttcgcgtgtagtttcggagcccgaagacccgcagtgcgaggatttcgaggatcaagctcaagatctcgagtgaggcaagccacctttgaacatcttgagcctatatttgaacttaattatgttgcttaaaaaatattatgcattgataggattacacttaatctgcttgtcccgtttgcaaggcagattgacggacctacctaacttgttgcatttgacccttccattgtaattgttatatcatgttcccttgtaaccacctagttgcgcctcggtaatcgtgcactctgtacgagtatcgacggtcgccttcaaacttaaaatctgagaaacatcttgggtaaaacttgggttttacaaaagacttggaaaacccgacacctgggtcggtgcttgcgaacctaaatgaatttccaaaatcgcggaccggggaacgtaccgggtgtacggtttcccgctcttgcacttaaggaccgtttccttgaaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctggaacctaatctggtgttggtctgggacccctctcgttggtatatggtgaacctgtgtcggctttcgaaatgccttgtcattaaagccttaaggtctctagtcgtggccgttctgcacgggctggatgatccgggttagtaatgtcgtgtgggtaaagtgtaccccctctgcagaggttattaaactgttcgaacagccgtgcccacggtcatgggcggatatgaggtgattcctagcgtagttttgtttgactactgctttgtgaaatttgctgttgtggaatgggtttgatgtttggaaaatctgcggctgatgggatcagccaggcccgggtggccgtttgaaagctgttggccgggtgccaaccttgatcgattcaaaagactgatacattgcacatactccgaccggatgagacgcactgtctcatccgtgtcgtttgagaagcactcacttagttgtttcagaaaagagtttaaataaaatcaattgcaaaaacaacagcctttctttgaagcctacattaaacacttatttcccatggcttgctgagtactcccgtactcacccttgctctatataaataatcccccccaattgctgaagaagatgaagcggatcccgctgacgaggagttcttccaggagcaagccggctacgatgagttttaggatttcggcctagttcccaagtcgcgcctgtgatgtttggtccaagtcttggcttccgttcccctttttaatgcagttgtgagctcgggatctgtccgtagcccaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacaagagaggtgtaacatcctggcctagggcttaataggattaatagaatactcatatcaacaagttgtaacttttttttcggaagccaatctccaaagaactccagggttaagcgtgcttggcctggagcaatttgggatgtgtgaccgaccgggaaattcttcccgggtgcacacgagtgaggacaaagtgtacagaaaagacatgtgttggtctggacacatggacgtggccaagaaggacgttcctggcctggggttgatcaacgggggcgtcgatctctcttaagggggtgagggtgtaacattctggcctagggcttaataggattaatagaatactcatatcaacaagttgcaacttcttttccggaagtcttggcctggagcaatttaggatgggtgaccgaccgggaaattccaacttctttttcggaagctaatctccaaagaactccaggggcctgccaatctctaaagaactctagggttaagcgtgcttggcctggagcaatttaggatgggtgaccgaccggaaaattcttctcaggtgcacacgagtgaggacaaagtgtgcagaaaagacatgtgttgatctgtgaggacagtctataacctatgaaagctatcagatgtaagcggacccggtctgggagaggcggaacgttacattacatcagtgattagtcgactgcgggcttctctattatccatgctcttagcccccttgccattgcttggtgaaaatgcagtaaaaagtgtgggtcccagctggcgtgcggtagtcaaccgtgcgcccttggtttcctacgcccgtgtcagagcctacacggtggatcagtggatgtgatcaatggcagtggcaggagttgtcgtgctactagtactacctttcatgttgtgtgccgtcaagtagataaccatcacatctatcttaaaatgaagggatccttaagcggcaccaaggcccaaggaagcagaatggttccgctttcatgaagagttgtcctcgagatgtccgagaacaacaaatttctccgatcattcacaataaatggtcgcaaagcaaacaaccctagcaaaaaaaaaaaaaaaggttggtggaagggacatgtggcttcttgttggcgcgagccatttgctacggggatctttggttcatacttcattggtcaccgacactatgacactagtccctccgtctcattataaaccatgagttttcgcgtctaaatttgatcgtctatcttatttgaaatttttttataattagtatttttgttattataagatgataaaatatgaatagtactttactcgtgacttatatttttaatttttttttaaataagacggacgatcaaagttgggtgtgggaaaccatggctgcacttaaaatgggatggagggagtatatacctaaatatataaggtggttgtataaatatatgtgatccactagattagaaaatacgaataatctagcttaattctactactaataaaagatgatatgctaccaataccatcataaaacaccgtagtatttaattgtgaggactagaatattgctagatgataagtgtttctttttcaacaatggaatatgcaatatgtgagttctcatataattactactacattttttttcaagcaactagcaccattacatacatgctactagatgtgtttttgcctaccacacagttcttacaaccatccgcttcttctcaaccaagagatgaaattctatatcgaccataaaaacgaaaacagataagagcttgaacacaccccaattttcataaaatcccatgaccacaatcctcaacaataaacggaacagataaacccaataaaaaaccgtataataaaaatcgaaagaatccaaaactcccaagcccaaacgacaaacctcaggccgggaagcatccaaaccctaactcgatcaccaccgctcgtttcccttccatccatccatccatcgccgtcacgtgtcctcttccgccttcctcctcgcccctcgctggctgaatccccccaacccgcagtccgcaccaactcccgcaaaaaaaaagaaaaaaagaaaaaaaaaagagataagaattattttctttactaataaaagaggcggcgcctttcgattcgattctcgaatccgaattttactacgaccaggttgccgccgccgccgccaccgccgccgacgagctgggcgccgccatggcgctgctccccatccgcgcgcggctctccgcgctggacgacgacgacgacgacgccgccaccgtctcctcctcgcgctcctcctccgccgccacgtcgccgtcccgctcgccctcgccgctcgtcccgcgcgcctcggtcctcggggcaccgcgcgtcgcggcgcagctctcgtccaccgaggacgacaacggcggcggcgaggatgaggtgttcgacgaatccacggactacggggacgacgaggcggcgggggaggtgctggatgagttgtcgaacggcttcttccgcatcgccagggtgccgccgccgagcgaagactcgagcccgatctccggcggcgagccggtggtgagtgtctcctctccgaccgagagtgggtacttcggcgcggcggagggttctctgaaagaggagggcttcgtgggcgccaggaacttcgccgacgtgttcgacgctggctccagggtcgggtttgaggatgctaatggtgtcactgcgggtgccaagaatacaggcgtcgagagctcgttggaggggagcttccagagctcagggagcgtcgtcggcgtgttcgatgacactgacgtcaccacaataggtgatttggtgagtgcttcagatggttctccgctgaatgttgataagcagggggatcaggattctggtgctgaggttgtcaatgacgagcctgttgatgctgaggttgtcaatggtatagagcctgagcctttggtaggcgagtctgttgatgctgaggttgtcaatggtgtcgtgcctgagcctttggtaggcgaatctgggggctccgacggtggtggtatgcatgttgaggatgaattggagatggagggtggaaagtctgacaatgggattgctgaattgcctccagtggtgagtgctctagagaaacaagatactgatctcgagcttcgcaatgatgattctggtgcaaaagatggcgcggacaatcatgaggatgcaacgaattttgttgattccagtactggatatgttgccacaggagatggcgcatctgagcttttagaggttcctgccaatgttgacgacttgcattttgtcaccgatgacggtcataatgatgacgctgaggaaactgatggtggttatgaagcttctgatggttatgtgtcaatgccaacctttggaaacaacaatgctgttgaaattcctgtaaatgaatcagagcacaatgtacctgcttccaagggcaggcgctttggtctgggtgattcagatgatgagtttcatgatgatgatgtggaggaggaagagggtgaggtgaacggaaaggaaatagagtttttcgactatgcagctttagctgagcttctaagagctgccacacctggacaaggcatggccaaggttttcccaattgaatcatctgtgcccctgcaagtccctcctactacggtcagtgttcctaggaaaaatgtggcttctagccctgtgttggaagtggctcctaaccctgataatgagatgactgaagaggagaggaagttgtacagaaaggtggacgtggcacgaatcaagtatttgcgtcttattcatagactggggtatgacactgaacatcatatagctatacaagtgttgtatcggcttagtcttgttgaaggattcaggcgcataaaggtggcaaatcattcctctgagcttgagagtgcctggaagaaggctttgcaacttgaagcagagggaacagaggacttggaattctcatgcaatgtattggtccttgggaagacaggtgtggggaagagtgcaacaataaactccatatttggggaggacaaatccaaaacgagtgcttttcttcctgcaacaactgcagtgaaggagatttctggggttgttggtggtgttaagtttcgtgttgtcgacaccccgggacttgggactactcacatggatgaaaaatcaaacaggaaagtgcttaactcagttaagaagtatatcaagagatgccctcctgatgttgttttatatgttgatcggattgatacccagcgtcaggatgcaaacaacttatccttactgcaatgtattaccagtgtgctaggctcgtcaatatggtccaaaaccattattactctcacccactcagcagcagctccacctgaagggcctagtggcatcccgttgaattatgagatgtttgtcactcagcggactcatgcaattcagcaaagtatccggcaggcaactaatgatcctcggtttgagaacacatcagctcttgtggagaatcatcacctctgtcggaggaacacagagggtgaaaaggtgcttcctaatggccttatttggaggcgcctgctcctcctcctgtgctactcagtgaagacagttgagactaacagcctgtcagcccgggttgcttctcccgcaaacctctttagcctgcgttttcggatgcctccacttcctcacttcttgtcatcattgttgcaatctagagagcacccaaggtgtgctgctgaccaagatgttggagatattgatcctgatgagttgataaatgaggatgaagaagatgactacgatcaacttccaccctttaagccattaagtaaatcacaggttgcgaaactctccaaggagcaacagaaattgtactttgatgagtatgactaccgaaccaagcttcttgagaagaaacagttgaaggaacagctccgaagactaaaggaaatgaagatagagggaaataaccatgatgtacttggggacaatgataatcctgatgatgaatatgagacagaaagatctgtcatgccagattgggccttgccatcttcgtttgactctgatgatccagcataccgttatcggtgccttgaccctaagccaaactttctggtgcgtgctattaccaaccctgatggatgggatcatgattgtgggtttgatggtgtgagccttcaatatagccttgatgctgccaatgcgtttccagcttctctgtgggtccaagttaacaaggacaagagagaatccaccattcatttggtgtcctcaatatcagctaagcatagggaaaatgtttcaagccttgcaggcttcgacatccaaaccataatggaccagcttgcttacactcttagaggggagagcaaattcaagaactccaagaaaaacacaactaccggaggtttgtccatgactttcttgggagatactatggtgaccggagcgaagtttgaagacaagctatcagtaggtgatagattaacattgttagcaaacactggtgctgtgtccattagaagtgatacttcatatggagtgaatatggaggcaactctgcgagagaaagactatctgatgggtcaaagaccttgcaatttggggagcatccctggttagatggcataaagaatggagcatggctgcaaagttggattcccagttctctatgggaagagcttcaaacgtggctgttcatgttgatttgaccaacaaattaactggacgggtcagcataaaggctaatacatcagagcagttgaagattgccctattaggtgtctgttcaatgacaatgtatttatggaacaggatgcatccttttattgatcgtaattattaatagcactggttagtacaacaatttagaatttcttgaccattttatgcttttcttgccaattctgttgtgtttctgcttgttatttcaaacttccgttaaaattcctccagctctactgtcaactcatgttcgccttgtgttcttgtttattttgcacatgtataagtaaaaaaacaacataggagggctatgtttttttgttagagtactattgttgctgactagatttcctcctattcattactcatgtacactgtggcttttcattgtagaactgttttctacatgttctttcttttttaacaacaaagggactgtctatctgttatcctttgtattgtataattatccttggttccttccagccttccatatttaaatcattttgagaagaatttaggagctcatataatatactgtatatatattggaccattttttccagactggttggaaatagggattatgtgcataaaaatgtgatgggctaaattcaatttgtattggccaattgggctaaatggctttgagagaatgagggttacggggtcaaatgactaaaaaaggaacaaacttcagttgatggctacatttcaactaaattaacaaactctaattcccaagtgttttaaggtcaggttataaatctaattcccaagtgttttaaggtccagttataaattagtgttgtatgacaacccattagacaaaattcaaacagctatatgaatctactttcttctgctcaggttatttatatttcaaaactgaatttctcttggaaggtcatgtaaaggttctgtcctttcttggagtcctccattccaaggtaaaccatcatagtgcccaatctttttaagtcttttataattttagtagataaaagtcacttaagtgaaaatcagtgttttagctgataagttgctatatgggctagtaaaacttgtcagatgtgcaacgatcattagtctgtcggtaaagaagctgggaacttattgttggttacttaatggaaattgtgatggtgaactgtgttttacccaaatacttattagaagtagtgagtgaagctttgttatgtgaattttgctgatacatctagaaaatgatattgtgcccaagttcttatacatcattttcacccttaacttgtgattccataggtgcgttgggaagtgctcggaagcttcagagttcaggctcctactactcagctagggatataagttgaaccatcactttcagtcaagaatcaagacaagtgtagctgtgctgccatttgatgtttgcttccctccctccgatgtgcagttggtggacaactttaagagcagaagaagatctactcttgttttggagaaacttgtgatcagtagcagctgttaaaccataataccattgtaagttattaccatcttaccatctttttttttctctgtgttgcccctttcgatgaagcaactaaagttcgacaaatacaagaaatctagatgttgggtaaaacaagggccatcatattgtgctatgtcaatggttggtaaactttttgaactactatgcttatgccctttgtgctggacatctgataagcatgacacctgagaaattatagtttctgttagttgttgccttgtgttagacaatatatatgttgtcctgatctacacactgaaatcaaagcctatcacatcggttgtgccctttttttgtttggtaatatcaatgacaatttctttgtggatatccgaagataagataaggtgctggggaaagagagcaagaggattggcccactcggtgttggtttatcctttgcaagtgggaggggttttctttcatttcttgtcttttagaataggattctcaagtgattagtttatacaaaaggagaatcgaattcaaagtcttgccttctctctcttttctttctttgaagtgggggcttataacaaacatatatgatatcatcagattttattagggttgcaaattatgttcgaaaatatgaattcctgtgtttctggacttgcataagcgaaattattgcttccatatcaaaagaaacgacacataaaagaaacatttgcacaattagcatatcagaatgtccttcagagcaggatacatgcttcctgacatgtaacagccatcccagatcacaagaaatgaaaacgaaaaatggataatttggttgagaaagtattcacaaggaccgtctgttacgtgtaatactgaatatagcagatatagttttttagacgcaagattcggtcttccactgaatgaaaagcagaacttgtgataaacagcctgtcactaacccaagttcccatcttatttgcatgaaaacatgaacatgaaaagaacatgttctcatgatgagtattcatggctgagggttccaacagccatcagcttcccagatcaaaggacaaaacagaaagataataatttcatagttagaaagctcaccaaccacatagtatcatcagagtttttctgcataggtaatctgaacaagaacaacaggcaacaaagtgggacatggagtaggttttctcataactttgcacaagactctactagtccatactttcttgagttcatgttcatggctaaaaggttttaagctccagcaccacatgaacatctcaatatctcatcttgccaagaaaaacacgaactacatacctccttgttttccttttagattacacccacccatcatcactacctagttagtccttcatgcatgagttcatgttcatggcctcatactcccatcattcataattttacaagacttactcaatttccccccgttttcggttcagtttcttgcagatctgaccaatcaagacatggccatgcagcatgcccatgcatgtttctttagttcagatctaccttttcttttttatgtgtgaccccagggagccaagaacatgactctccttatggggtcctccgcggccgagccccggcagtcgtcgccgccgtggctcgggccgcggctgacggcggaggcggccggcctcgccgcgccggcggtgccataggcccgccggagcttgtcacggagggcctgtttgacctcgtgagcccaagaacctgaaccttccccggtaaagtgaggaggcttcatggcgagacagaagaaaaaaaatcctaatggcaactcacagagagctagaggtagacgaaggcaggtgaggtggtggtagtagttgtagaagagatttcattcacaggcttagcggaggggggctatttataggcgaaatgggagggtgcaaaggggaattccactagcaaaaacaaaaggtttggtggcttggtgtggtgctcacggaatcgggttccttctatggcagatagatgcaaattccaattcccaacccgattagtagtagacatgataattatcgtttggttgtggctttggtggcgttgtgatgttgatggaaatcgttaatcagggttccagttggtattgtgatgtttgtttaaaactgttgtcgtcaaattgctttttgataagcagctgtatagaaaagtgcgagtggatatttttttagtgagtgctaatacatagctactgtatgatctgcttttgtacctcttcgctcttccttatgatctgctgttcttgttccttttggtttgctgttcttgttcagtattgtataaccacaaaccatttctctgacgaatcttctaatttagagaggtctgtgtgttgagtgtggggttagctatacaagcaaaactagatgacacctcataagttgatggggggaaattgtatgaagcatgcagaaaattgtataaagcaaaatccaacagtttgagtaaataactagagtatgatagacaagaataaatagaaacattagtcgagtttctcgatgacgtggcctcacatatatttgtgggttgcaaacttgcaattgtatggaaggaaaatattggtattagtatagaagatgattacaattaattatgcagcatagttgtgagcttgatggtagagactgaggatgtaatacattttcattatctaaaaacttaattatgcaacactcaatactttaattgtgaaattgaagacttaattattattttccaattaatactaaatgaactgtgcgttgcataccgagatgtaataaatcgttgaacgaggcttatgtcagaattggtgtgtggtcgccttcctagagaaaatgacattaagcagacagagagtatccaacaataagaaccactattacagagatgttgatggtgattcaaaatgttggagatatgaccaaaaaagtgacagttgtatagtagcccagtaaaaacttgttagtaaaaatgttactgcgaaaatcgcctttaaataggtatattatggttgaaatccctaactatcctctgagcccataacaaaatgaaagaattctgatttatctgtggaagataaatcgattaaatttaaattcctctgcctaataccagataagtttgaagtttccaatgcgttcgtttgtgtgagatagggtgagaaaacaccttattttccgcgcgcacgcttcccaaattactaaacggtatttttttgcaaaaattttctataggaaagttgcttaaaaaatcatattaatctatttttgaaatttaaaatagtttatactcaattaattatgcgataatggctcacctcgttttacgtatctttccaatcctctcaatcccctaaccctcaaactcaccctaagtacatcgttgcgtaaccttaatattccgcgcctccataactgtaattccaatactccaatcgtttaccctcagcttataaactgcaaccaaaacttttaactttaaattttaattttgagatattttttcactatagtttattttttagtatttgtttttaaatttctaaaagcatatatataggttttgtatctaaattatatgctttcattgatgataaattgatttataattagcaaaacgaaacgatgacagtagcttagtgaagttatagagaagagagtaatagagaagattgcgataagatattaacgtataattaattaaatattaattttttaaacttaaaatggactaatatatttttttagagaaagtattttttaaagaaaaataaaccgtttagcagtgtgcgtgtgaaaaaggatgtctcttctcttttattcaactcttttttgccggaatcttctgttcagctctcaaaagcagttttaaacaaacaggtcatgggtgcatgatagatgcttgtcgatcaaacagctggatctgggttgaaaaggggattgattgggtcatggtgtatcatcaactcaaccgtattgcacttgggcgtttgggttggcttgtcgtggcgttgagagggcgaacaattggggtgtgtgtgtgtgggcttcaggattaggaggggagcgattaattggcgggcaattattgacttgtgttctgggtgtccaccatgcaggtggccagctggctatcatccactgccctgtactagactctagtaccggctgatggtagggcagccctaaggacacccataatgattatttataggctttttacaagagatccatgtcagcatatctttctacttgaaagagattaaatgaagagagagagcaaagttatctactaactataaaactcaggtgtatgcaggaaagcgtcacggtggacgcagggtttcgtgttgattcactatatgcaaaaacgcgctgagtttacagatatatatgcgtgcagatgtgttggttcggtgatcctaattacaagggattagagtcctatcctctatctatccgaaccaacatgcatccgtgcatatccatacagagaatgataagatatgataagatctaacactcctcctcaatcttaactctttctaggttaagattgttcttgaacatctccatttgtctcactggtatagcttttgtaaaaccatctgcaacctgatctttagtagatatatatgcaatttcaagcaactttctagctaccctttctctcacaaaatgaaagtcaacttctatatgctttgtacgagcatgaaagattggattagcagaaagatacttagctccaagattatcacaccatagcttggctgctcgaggcgattctactcctagttcttgcaacaaagtctgtacccacataatttctgctgttgcattagccagagctttatactcagcttcaatactagaccttgatactgtagcttgttttctagcactccatgatacaagatttgggcctaaaaacactgcaaaacctcctgttgatcttctgtcatctggagatcctgcccaatctgcatctgaaaaaccactaacaagcagagagggattcctacagaacttaagacctgtatcaactgtatatttaacatatcttaatatcctttttacagctgcccaatgagttgtagttggagcatgtaagaactgacacaccttatttatcgaaaaagaaatgtctggtcttgtcaaagttaaatactgtaaagcaccaactacactcctatactgagtagaatcctgaggtccaagcaatgttccctcatttactgatagtttttctgaggttgacagaggtgtactgaccggtttacactcatacataccaacccgtcgtagaagatctgatgcatacttctcttgactaagcatgagaccatccttcactttatggacctcgattcccaagaagtagtgcagatcaccaaggtccttaagagcaaagtccttgcttagttcctgcagaagtgttgaagttgcatctggtacagaactggccacaataatatcatcaacatatatcagaagaaatatagaaacctgtcctttcttatagaagaacagtgatgtgtctgcctttgaaggtacaaagcctaactcacttaacttagtacttaacctggagtaccaagctcgaggcgcctgtttaagtccataaagagctttatctaatttacagacatagttaggcatagacttcttttcataccctggtggttgcttcatatagacctcttcttctaggactccatgtaggaaggcatttttaacatccaattgtctaagactccaacctctagagacagcaagagacaaaactattctgatagtagcagctttaacaaccggactaaaagtatcttcataatcaatgccatacctttgcttgaatccttttgcaaccaaccgtgctttatacctgtctagactgccatctgctttccttttgaccttatacacccatttacaatctatgacatttcttcctttctgaggaggaaccaaatgccatgtcttgttttctatcagtgccatgtattcagcatccatggcctccttccagtgtttattattcactgcttcttccagactctgtggttcaccagaagaagtaaaatttagccatttaacagttccatcagtatataccttttctttcctgatcccgctttggagacgtgtttttggtctgatcggtgcaacagctgcttctggcatggcctgatcagtttgatcagactgatcagtagtcacatcatcatgcacgccagccgatgatgcaacagatggcgatgtggacgacgctgtttgtggggacgcctgcaccaggtgctcctcctggattggattgccatgctgctcagctgccgacgccatcgcatcatctgtcacaggcgaagagtgctccggcgacgcatcatatgccacaccatgcacgtcgtcctgtgcaccaccatttgctgctgctgctgcattttcatctgctgctgctgctgcattttcttcaccgtttgctacaatttcttcaccgatttctgcattttcttcaccaaactgatcagtaacattaggcggataattaagcacatggttattctgttctccccctaatgaagaaagatgcggaaccaaggatggtggaaggagagatatttccgctctaaggcgtgcgccggcatttgagtggagttcggagaaaggaaaaatgctttcatcaaaggttacatccctggagacatagactctgcctgtggcaatttctagacacttgaaccctttatgtaggttactatagcctagaaaaacacatctcttggaacggaaagctaatttgtgtttattgtaaggccgaaggttgggccaaacagcacacccgaatattctcaatgctgtatagtttggtttttccttgaacaattgttctaaaggacatgcaaagttgataaccttgctaggagtgcggttaataaggtatgccgcagcaagaacggcttcgtcccaaaatttaattggcatagatgcatgtgctagtaatgtgagtgcaacctcaatgagatgtctatgttttcgttcagctgaaccgttctgttggtgagcataaggacaggaaacatgatgagagatacctatcttagcaaagaaggtgttgagtttttgatactctcccccccaatctgtttgaacagcaagaattttgtgaccaaaaaatctctcaacaagagtttgaaactcctgaaacttttggaatacttccgacttatgcttaagaaggtaaacccaagtaaatttactataatcatcaataaaactgacataaaacttctttccaccaacagaaataggagcagggccccagacattagaaaaaataagttctagaggttgacttgacacacttgaagacttaggatagggaagctgatgactcttgcccttttgacaggcatcacaaattgagtctttatttgctacggtagaacaaggtaaattattcttgctaagaactctagtgactatgggcacggctgggtgtcccaaacgactatgccatcgggagaaggaaggagttgtggcggcatggacttgcttggcaggtgatgtaggaagggagtagaggcgacggcggcatctccccttaagaatcgtgttcctcgtggctcgatcctttatcaaaaaataattggaatgaacctcaaggaaagcaaaattatccatagctaaacgatgagcagagataaggttctttttcgcttgaggaacatgtaaaatatttttgagatgtaattcacgagtaggggtatgaatgacagaatcaccaatgtgcttaatttccatacctgcaccgcttgcggtgtgaatcttgtctcctcccttgtacttctcccgaacatctaacttgtcgagttcgttggtgatgtggtcggttgcccctgtgtcgaggtaccaattggtgtcgatgccatatgcagctgctgcagccgcactcctttcatcagggacataggtctcatcgtacctatgccaacactctgcagcgacgtgccccctcttcaggcacacttggcagatggggcggtcattaccaccccgagtctgatttcctccagtgccgcgcccacgtcctggagcagcaggattgctgcgcccacgtgtgccacggccgccgctgcgaccacgctgaaaaccaccacggccgcgttcgccgaagcatgagcttgccgaagagcttgcctgttctcaaagttaagaagctgagagtacacttccgccattgtggtcgactcattgcgtgccacaatagcagatacaacaggttcaaaatcatcatctagcccattcagaacataagcgactaaatcttcctcatcaaggggtttccctgaactagcgatttcatctgctagtgctttcatcttgccacaatactcagatatactcatgttacctttctgggtattggtgagagtaagccggacgttgagcgaccgggctttggtttgtgcagtgaacatggcgcacacctgctgccatgcctgcgccgccgtggatgccgtcgccacttgggtgagaatgtctcttgacagcgtggagagaaggaagcctaggacctgttggtccgaggcaaaccactcctggtaggcggggttgacgatcttctccgtcgtcttgtcgctcgccgtcttctcgatctccatggatggagcggcggtggcgccggtgatgtggccatcaagacgggcgccgcgtatcgcggccaggacttgcgccgaccagagcgcatagtttcctttggtcagtttctctgaaacttgaacgccaaagagaggattggtggaggcagtgcttgacgaggaacctgccatcacgccggactttgaggctctgataccatataaaactcaggtgtatgcaggaaagcgtcacggtggacgcagggtttcgtgttgattcactatatgcaaaaacgcgctgagtttacagatatatatgcgtgcagatgtgttggttcggtgatcctaattacaagggattagagtcctatcctctatctatccgaaccaacatgcatccgtgcatatccatacagagaatgataagatatgataagatctaacactaacctggaaatagtctagagaaaaacgaggcaatccattagagagctatacatacccatgtagacatactattgagatggtttactattaatctagtatattgctgagatgtacatgttttatagagagcactttactttaccattgtgggtgctctaatgggtggccatcgttctcgtgggccccacggctgactaggattcctattctttttctcccccgtgtgggccccacccatcactctcactagctcaggtcatcgtctgtttctgcctgcctcgtcgtgagtgtgagtgtgagtgtgagtgcgaggtctcactctgtctctctgtgtgtggccatgtttttgtgtttggaggcgtgtagccttcactgatgatgacgacgatacaaagcattcaaactgtatattgtgacttctgtaaacaaatcggtcctgtttactagaggctaagatcaaccacacaggaaatcattatagtctgatactctaatgatcaagtgataacatgatttagtttgcaaactggcgtagctctagttagattctagtggaacccaagttcaagtaccagacttaaacatatgctcatatttacggctaattattttttaaatagtaggcaactacccgtcaataatgaaacacatgtgataatctatgtgtcgtcgacttaatctctcagacatgattatagagataaagcattaaagcgtgcacatgtatatataaacattattgttcgcactatgttttatgttttaataaaaaaaaacatgatttaatttgggcatgggtggccgagtagatcattttgaaattggaaacaacaaatcaacagttttgaaattggccaatctattgctatggcatagaatattgggcctattcatattgaaagcccagcccaattattacaagtttcatttactgcaacacttattaaatcactatatttgctaaatttatttttaaaatataccccatccgtccaaaaaaaacccaatcctaactataaacctggacatatgcgtatccaggttcgtagctagggtttgtctttgtttaggacggagtagtattttttttatccctaatttattaatattgttacctctgcacgcaatccggcccatttgttgaattgaatactagtgtggcagaaatataacattgaatacatttttgatacattctcagtttttgttttgtattagaaatattattatattttagtaataaatttgactaacaaaaaattacaccgattttaataattttgggggtcaagatatctgtattgtggttaagggatacaaatcagacttggccactagttaagggagtcaaagtgacttactccactgaagctcctctgcaacaatccggcccatttgtatggcagaaaagctaggcccacttgaatctggtagattcctcctggttggttgctgggctcgccgccgtcttcctctccctcgccggagtatagtagtacaaggccgatgcaacactgacgtggccatcaatttgatcccgtcacgtctccgccctcttctcctcgcttcttctcgccgccgcgcccgcgcgctgctgctcttcgcttcttctcggcttccctccgatctgagagagcaagcatagcaggagatcgggagacctgtgttgcgcgccatggcggcgatggtggtgggagcgttgaggaggggaacggccaccgccggggggagctcgcggtccttcgcccgatcgctccctagacctgtaagcttcttcttccccttgtgcattcgattcgattaataagcggttggtggaggaatgtttcgagacgatttctcctttcgatttcatcggattcgtcgcttttgcgctcccacgattggctccgactgtgcctaaccgcgtacttgctctcatgccctgatgatgctaggtgagcacgctggtcgtagcggagcacgaaggtgggttcgtgaagccctcatctctgagcgcattggcggccgcagaagcaatcggcaaggatgataatagggtttctcttctgttgggcggatccgggccggggcttcacaaggctgccgagcatgctgcgtccagccatccattggtatccgaggtatggtcatgtgctacatcttgttcctatgtgttgttgtgcttgagcgattgaattctagaagcctattattgattcatttcagggatggagatgataattgataacctctgctcttcgatattgtgcttatcagttggcttgctttcgctgcaggttcttgttgctgattcagatgtctttgcgcatccattggctgagccttgggccgagctacttcgttctgttcagcacaaaggtggatactcacatgttatagcgtcatcaacctcgttcgggaagaatttgcttccacgtgctgctgcccttcttgatgtgtcccctgttacggatgtcacttcaatatctgagccacgagtctttgtgaggtttgtcgtcatacattcatactcctttccatgaagcttagcatttcaaggagaattgcccgtctgccattctgtgtagtgcacacctttcgcagatacccaaggttatagcacgaggttttgcaacacacgatgcatacatgttgtgtagtacatgaagcattttctatgcatttcacatgttttgcaacttagctacatgcaatctccagacaatctaaccactatttgatactgaatctgctaaatattattacaccactgtttttcccttttctaatgctgattaatagtggtttttccattttcccttttctttggacactgatcttattaatttatggtatcctatgggctaaagattaatcttatgagcccatttcccatgagtgcataatggcattctacatttctttctgcttgcaaccatgtgtttcttttgtggggatcattttatccgtatgaagaacaatggtatgcagggaaccttgggtggatgaaccattagccttgtgcgcgcagcattgcaatttgcacccccaagagttgttctctcttctaatccatatgtattgtatacctttatggtataataatatttatgcttctgaattcaggcccatttatgctggaaatgcgctttgtactgtgcgatatactggagaggatccatgtatgatgagcattaggtcaacatcattttccccaactgaggctatgtcagaagcaaaagttgcacctatcacccaggttgatctctctttcctcagtgaaggtttgtttggtttcttcactatattcttctattaagaaaacaacgttcttatccattatgttttgctctttttggatattgatattgaacatactgttgagtgttgagttctgcactgaactctggaaatcaacagataatactagatcgattttgttgtctatgtccttattgtgtttctgatgaagttgaaccttgctgcagggaaaataaactgttttgatccttaatatggacacttttctgacatcaaatataggtgtatacatgcttacttttttcttgtcaatgtacaggaagctctgggaaatctgcatgggtgaatctgaaatcccaagatacagaacggcccgatcttgcaaatgcacccgtagtagtaactggaggcagaggtttaaaaagtgctgagaatttcaaagtattggagcagcttgctgagaaacttggagcagcaggtttgagcctttttttttccctttgtccatctatacctactaggtagcacccatattctttgcggttggtatttgaacctatcaaggctcgtgaaattcatttcgctgtgcattcgttttctgacggattatgtttctcctctgtagtgggtgcgaccagagctgccgtagatgcaggatttgttcccaatgaacttcaggtaagctctacaaactgagctctatgccacgtcaggagataattaaatagatatgattggatacatgccatgtcagaagataattgaatggattcagctgatatgaaactgtaggttccagcatgtgctactacaagcgtagtgaagcttactgcattagcgccctaaaaaaaaggcttactgcatcagtgcattgccatcatgatagctgcaaatttacgcgcacttttatctctttcccttggtgcttaatttattacttatgttgcaatgtgttctatctcccctcaggttggtcagactgggaaaatagttgcgcctgagctctatatggcatttggagtatccggagcaatacaacacttggcaggaatgagagattccaaggttatcgtggctgtcaacaaagatgcagatgctcccatatttcaggtaaatcttgggtctacagagcttcatcaaagattttgttcttcatgtcctttgccagtaggctttcaaccttaggattttaagattcttataatcatgttggccaggttgcggactatggcattgttgctgatctattcgaagttcttgacgaactgttaaagaagctacctgacaagaaatgagcgtgctaacatgatgatccgtgtccatgtcatatttgttctagtgttcttaataatatgaagcgcccttgtaatgtgattctgcaaaaataagtgtcatttcatatgatcacacaagcacaaacaatagacgtgatgtcgcttcctgtgcaaatacacttggactagcaattaacaatcatcattttcactagcaggtgtcgctgaaagtacagtacaggacagcgaaacaggtacagataaatcacaggctaacaacataccatgaacatttcacatggaatttgccaaaagttcatagttacagtggcgggcccagctttttaaacttgggtattcgaaatgggaaggggtaaaaaaatgtccatacaccaaaaagccaaaaaataggcttgtatattatgatacactaataattataatttagagcgtatagaataaaattgatcattagttcacacagtgatagaattgatcatcactagaaattgtttaacttatagaaatactaataccaaacatatcaaagtgtcaaaatatggaatacaaaaatgatagagaataataagttaggaagaaaacttacaatttagatattaacttttcgacgcttgatattttggaaataattgatgatgtccttgtccttagcttgcaaaaagaattctctttcaatgaatgtaaccaaacaatcattcaaatactacaaatttgctaatatggtatgaactatgaactactgtccagtgtccaatatactcaattactcaaatactcaaataggcaactagtcaactacaatcctacaaactaaatgtctaaatcaagcaagcaagcaagcaagcaactacactaaaatactaaatgtctaaatcaatgaatttttgtgcttgtcccgttgtccggagtttagtcactcactgtgctaatgtgcttatccggaatttgcaggtcaggcagtcgccggcgagcaggatgccgcacggccgcagcggcagcgcgcagccgccggctgcctcgggcctcggcgcggaacggcggacgccgacttgcaggctgcagctgtgcagcgcctgctcctgctcggctgacggcctggagcagcctcctgcctggctgcctcctgggcccctgcaggctgccgcgccggctgccgcacgcggcacgccgtcgcccgtcggtcacggtgcgcctgccggtcacgggcttggcgccttggccttggcggctcaccgcctcaccggtcgccgtcgccgccgccgcgcccgcgccgttgcacgccgcggccgcgccacacgccgccacggctcccgccgccggccgccgcacgctgcacgcagcccccgccggccgccgcacgtcacgccgccgcacgcctcctcccgtcgccgtgctgtactgctgtgttgtggtctagggtttgcaggtttgggtggccaaggcgccaggcgggtggggaattgggggaaaattgcaaatgggctgagatgtggcccaattagaccacaggtagagaggaaagagggaggggagtggaaaattttggcccaatagagaagaaatggggaaacaaggcccaatataagcagtttaagttttctttttatttttttaatacctatatgaactatatagtatatataccttttttttttccaaaaatcttgggtatacatctgaatacccatgaatacatagtgggcccgcccctgcatagttagatttgacacgcaaacataatgtccaaagaatgcccacaaaaaggtgtatacaagcttttttacgacctaataagaattgaatgcgatacaaggatgagctaacaattttctatgagaatatcagataacgcttgccaaaacgccttattgttttgtcgccaaatgaacacgaatgccagaaaacgataaaaagaaaaaggaaaaggaaaagtgtagaagacattcaaaaagtttatacatgttacacgtatatgaatctgcgcgatccgtatgagattgtcgggtaaagatagataggtgatcaagactcggacttatcaggtggggttcccaccagccagccccacatgccactggaactttgcctttgctttgcctccaacgctgcttgctcagaggcagccttctgtcttcgaagcagctcaacctccctttccaatgcatccatactctggagcttctgccgtagctccgcaacatccacctagaaaagcattttggggaaaccaaagtgtgatcaggatatactcatcacatgtgctacacaataaccaaattgtttactactacttgttgaactcatttgtctgccacaaaacacacacacagtgcaatttcggaaagaaaggactaggaccctgtttagataagttttagttcctatcacatcggatgtttgaacactaattataaatattaaacgtagactattaataaaatccatctataatcttggactaattcgcgagacgaatctattgagcctaattaatcaatgattaccctatatgtgatgctacagtaaacattctctaattatggattaattaggcttaaaaaatttgtctcgcgaattagctttcatttatgtaattagttttataagtagtctatatttaatactctaaattagtgtctaaatacagagactaaagtgaagtccctggatacaaacaccacctaggtttatcatgttctcccttgggaaggtcgttcaggaggttatttcttatgcgggttaatccgagctattactgctggcaacgtagtaaaaatagcaaattttgttaatttgtacaatgtaagactccatacctcaagtttgaaacatcttgactgttcagcagcaagttggccacggacagtttgaagttcctacaaaatccaaaccaacaaaattgaggatatatcgttccaaagaagtgattcagatctccacatacaccaaaactcgtgaggtgtgcatagcactatgcacaccatgtaatccaaatgtacctttgcaaggtcaggtcacctacacggttcatcttacgttcctttgtggacatgtatgctaggcaaaatatgtagtgcaaaccacatctgtagtggaaacctgaaaactattattggatctaaaatggacaacggagatttgtccacgttaccaagaataaaaattttactcctagattcaaccatgactcatgacatggagaaatctcatgcgtccatttttttatccaacggtagtctacaggtttccactacctatgtggtttgcacttcatatttttcctatatgtcaggaccaagacatgttagaaacagcgataatacatactgctagcaatgaacatcacacactattcagtacagggtaagctcaatcctagtgcatgtgttaaatagtgccatagggtgttgtgtgtagtactcagactacaggttacaaagcagattataaaacaaatgaaaatgtaataataataagttacatgcagaagaatttgtaaaaataggttcattgcataattgaaagattatgcaggaggctcaccttcgtcagctctgcatttctagcctctgcttcagcaatctcttctttaagctgtatagtttgcacttgctccctgttaagtgctgcttctagttcctctttctcagctttaagagctactaaaagttcgtttgcgtcatccttcttctgaaaaacaacacagcatcaccagacagaacagctgagtgtcttaaagcatcattcctcatgggtaagacataatcagcatggtagcaacaaacaatactggaatgattattcacagaattttattttcacagacactaattttctacaaaaaacccatatttgcaaaaaagagtcaacacactttctgttcaatcgaagtgtactgcacaagagattaccaggtctgaatcagcactgtccatggcaatctcacggatcttcccatcatgagaaagttcaacctcgggttccagaacgctggatgtaccatctgatgcatgctcttttgtttttgactgcaaatctgatttgagggtaagtttaagagcaaagacctgtccatcaggaaaaaccttgttacaaattacctccacacatagatactaaaaataaatctaaaatcctaaagaaaagccagttacctcattgctgtatcgtccattgtatcctccaaaagaaatgagataatcatctccattgtaattgctatgcactaaagtcatgccctaaaagaataacagatcaaaacattaccaactgaaacaaaaccattctaagcactgcgtaatactcaagagtcgtacctcactggcaaggggaacacgaccttctacagagctaacaactgaccatgttaaagttgacatattaagcacaagtgtttcagagacacctgcaaagaataaagtataagctaaatacattctaactgtaaataaagtatatatataatttaaaattgatgaacctacagcaagtgtacaaaaaatacaatcaatttgttactatttaagaactccatgtggcattagaatgaaagtaaccttaatcttcctagtttcaaggtacaatttgcatatcaagatggcaaggatagttgtactggctttgtgggttttactggatatagtttctaggttaagtgatgcagattgtaccagacagtgaacattgatctaaaaaagcttcctgcatataaggcaccaagttgacaagttgcatagacaaataataaattctaccactatctaagtgttggatcagggctgaggtgctatacacagacaaggattggcaaaaaaaaaggtggcttccaaactctttgcagtgcagcaattgacaaggtacaataataagtgtaggaattatctaaggaggtgaaaaaggccagcagtagtatgaagacatctttgcattgcaattagtaagaaaatatttttcacactgcaagtgtacgcactaaaaagcataccacttttgttattgccaccaccaactatgtaccagttttccccaacggttgcacctgcatggccagctcgtgggcttggagccagaccctgttgtttgggtcttgaccactccatctgtaattccatcgataaaattagaaatcatgccacattgtatagatgccaatgtttgtgaattccagcaagctaacagttcttactgtttgcaaatcgaggacatgcaagtcattgaaacatgttgcatgagaccctccaccaaaaattaaaagatagcgatcagcatggcaagcagcagcatgatctgatcttggaggaggggtgcctttacaaaaagccaaaaaatat

SEQ ID NO: 5521 - DNA, 8116 bp, Oryza sativa
  unsure (1)..(8116): unsure at all n locations
atattacctaggaataagcattccattccataaacttaacaaggagagaaaagaagcaaaatatgatgattatcccaaatgcttagttgtatgaaacaacaagacttgtaaatcccttgcttctaaaaaattagaatcaaacatagcaggtatccagtctccatacgattctgaagccctcattttactgcacactatactatcattaaataaatcaaactcttagttcgaacaaagcatatttagctgagcccattgtgcataagcactctccacaaacttttaaagtatttacgttacacgtagcaaactgtgttcaaacaaacaaactccgctaaaatcaagcaaagtacacagaattttcctttttaagacgggtttactaattaaagcacagtgaaacaaagaataggtagttgattacatttaaaggtctttgttcagagcttgctaggttgaagaaataattaccggtggttttccataagtcttgacaatagaccatgtacaagtatgcggatcaaattccttcactagcataaaatacaagaagaaaaataatagcttagaagaaaaaaaatgacagcaatggggacacaattggatcacagtactgtgttaaccaaaaagtgagttttagcaaacctgtaatgttctcagacggatcttttgtgtgcccagcaacagagaaaaatttgttgccccaagatatctacaaaatagcatcagaggacatcaagctaagcatcatctgaaacatagatagtgacatttgttccaaaatttaccaacgaatgtccagcacaagaagagacttgtgctgatttagatgaatcagtggatcctgcttgaaattttgcatcaatcttcgaccaagtcaaactcttcagatccaaagcctgtgctcaatatagatagtgaaagaaatatgcattaggtcaatgttacttaatgatacaaagttatttaaatatagcggatgaattgccatttttttgggtagattcaagttattttcatcatacatgtcttcaaactactctttctgaatattatgcaatatgagcctcccattctgcctaattgagtcaacttcatgcaggaaatgcttacatcataaatcatccatagtttcatttgtaatcccttttaggaatatttgttgttatcttctcgtttcaaaaccatctatgagtcatactgtaaattttgcataagcatgaaaggctggtacagattacaagttacacatggttgaacatcacaccacgattacaacatatcaggcttcttatcatgaacataaatgggcctttatccagatagcatatccaataaatacaaacacttcaggacaattctatgacaaacagcagaatggcaactgctcatatgtctccaagtccaagacaaaaaatacttaggaggtccacatgcaacctgcttgactgttatatttagcttcacatacctgaaggtcgctaaggtaacgcccattgtggtttcccccaaatatatacatcttatcttgcaccacagttgcgccatgctgcaggaataaaagttcatattaatgctatgaacagaggaaggggagaactgggataacagttcacaacttaaaaaataaaaataaaataggcaaggtagccaaggccccaggtgcatatggcatacctcgtaacgaggtttgggccgctgcccattaacagataatggagtccattcttcgtgaacactgacagcactaagaccttccagaataacaactttgtcctgtgtctccactgaacttccattctcagatatggttttaggttctggaaccgatgttccatttgttgaagccagaataaccttgggatcttcctttggtttcttgtaaacagaaatgcagtaagcaaaatgttaagtttatttcacaaacaatttattaatcagggcattgagatgaaactacagctgatagaccaatactttcaaagattagagtgaattctaaatagataggcaaaaaaacataagaaatatacttttgacaggaaacaacccatgcgtacccactgcatttatgaggttacagaatgcaacttacatgcatttcaatatctacaacaggctcagggttgaactcaggaacccttgagtaccatccaggatcttcctcctaccaaaataccagcgcattaaatcgttgtgcacagggtgaagaatacaatgtaaatagtcatacctctaagattttaacaaacagccgcatcgcctctgccgatggcatacttccaagcccatgccagctgaaaatacaaatgtgtaaagagacgatcatgctttaaagacatgcagtatcaacatttgattgaaggtctatggatattcctgccaccggtcagctctctagcttatcagtccaaaatttaaattacacaagacagaaatcctcttctaacttctgggcatgtgatagcattccgttctaatactggcccaatgataagcaataaaataaggcagcagcacaagacagatagcgacatcatcttatattaactaataactagcatgtgaagtttcaacctccaattcgatcaccaatgtttccgtttctccataaatttaaccagaactatcaagttcgctaatacggagacaacttcatgcaggatcgcactgtaggtgatactaaccttgtccatttgctctgctccacagggttccatgccctgggtttcggcacattgcaaggccccactgttgcctacaccaaaacgaacgcaaaaattcattccgacagccaaagcaaatcctccctcccaaaagccagtgatcaacaaactaacgctataattcaaccctgcgcatcatcaattccacctagatccactccacgcatttcccaaccccccatccaaccgagacaaatcgcgtcacctgctggtagaggccgtagaggaggagggcgacgtcgttctggaagcgggagatggcggacgaggaggtggccccgccggccccgaatccggcgtaggccgccgcggcgtagaaacggtcggggtaggcgagtccggagctcgccatggccgcgcgcccgcaacgcaagccctagatctctccccgcccacccactcggatgagatctcgcgcccactgcccgcgaggcggagagcactagcgttcgcccctcctcctcctcctcctcctcgccgcggcggaaatggaaatctgcagcgattggagacgagagaattcgagatctgggaggcttcgctcgctcgaccgacgctcgcttcgcgggcgatgaatgatggatggctttaacgctcgttctccgaggtggcgcgggggtgtccacgtgtcggtgacatggtgggggcgagtgacgtggtaggagagtcgtcgcggtcgccacgacgacggttaatatgaaccgggtctacggcgcgggtcaccgtcaccgtgaaccgcgtctagtctacgtagaggagggtaggcgcgggtgctggagtaacgaacgtgtgggaagaactaggaaggttgtcgtggtgttggtgggagatccatcctcattcctcgcaccgcggtaccactagcaaaaaaagcgctaggcggctttatacactgcaaatactgtattcaaatatgctaaaggtctcaaacaaaacaaacttctctgtgtttgatgattgcaagctgatgtgggatgggtttggtacaatttctattgagcactgtaatagaaactccaatcaggtggctcatgaattggccaggttagcgtttaggacaaaaaaattttgtacttgggtcgatgaatcccctggctgtgttctgaaccatctggtaaacgatgtaacaattttatcctatcaataaagctagccgaatggcattccccaaaaaaaaaaacttctcacgtacttcatccgtcccaaaatataagcatttttagcatagtgttaggtcaaacatttttaactttaactattaatagaaaaaaagttaaagagatcaataatgtaatattgttactagatttttcattaaacaaattatcataatatgcaattctttttatttaaaacatcttatttttatatatattgttggtcaaattagcatctcgaagactgtgtcgaagtctaaaaatgcttatattttcggcgggggagtataatttacactttacattactcaggtttgatagtgctagatttttaggttaattagatccatgttatgtcattgcaaatttatctattcaaaaaaatgtcattataattcatttattcgcagtcatgctaccaaaaatttacaaaattaggatcatgccaccgccatcacatttttcatccatctccttccctttctgtcttctactttctttctcccgtcttcttccctcccttctcctctttgctcagctccttcgatgaccttatgcttcacctccgttttgggcactataacgaatagcacaccattctttagctcggcgcggaccttgctcttgtcgcccacattggggagcacgagccgcatgttgtaggagctcatgctgcgctccttccaccacccatcgtcggagccccccgttccttctcctccttactgtgctccccgcggatgacaagcatgttgtcctccaccatcaccttcacatcttcccgtgacaggcccagcatgtcgaaccgtatttcacctcgtttgtcatcatccatgatgtcccgaagcatatccgcaccttccctgtcgccggcgatctccacagcgcgacggggaaccccagcgtgacattgttgaacattcagtctatcatgtccagcatctatcgtatcaaccgcatcggtgatcagatccacgagggcgaatggggatatgttgttcaatgccgagcgcgcgctgcacgacattcccctgctggttcccaccgttctattacctgacgtgctcctccaggcggcgcggatggggaggcacgccacaggtgagacccgggtgacgagagcaaatggaccaaccgttgcactaccaaatagagaggaaatcaaaagcattgagatggagatcgttggagaggtcgcgtccaccatggcctttactgtgccaagcatagaggaaaggagaggaaagaagataggagaaagaaggaagaagatgggaaaaaaggagatggatggaaaatgtgacgacagtgacacgatcctaattttataaaattccaacggcacggttacggatagtcgaattgtaataacatttttctaaatagacaaatttacagtggcatatatccaactaaccctagatttttagacatatgtttggctatgacctcatcaattttattttcaaatatataaaagtataagctatgcttaaagttcctttaatgtaaaagaaattacaatacaaataaacaatagctatgcaataaaataaattacatatgtttaaaatataatggtgtcatatattaaaacagaaagagaataatttttccataaggcttggtaaggttaacttgcacctatatgaattaaaaacattgttttatagcaatactaaacggatgcgaattaggtgtgtttagttcgcgaaaagaaattttttgggtgtcatatcggacgtttgatcggatgtcgaaaggggttttcggacacgaatgaaaaaactaatttcataactcgcctggaaaccgcgcgacggatttattaagcctaattaatccgtcatagcacatgtgggttactgtaacacatatggctaatcatggattaattaggctcaaaagattcgtatcgcgattttcatacacactgtgcaattagttttttattttatttatatttaatatatactttatacatatgtccaaagattcgatgtgatgtttttgggattttttttcttttttttttactaaaacatgctagggggagtcagctagagggccttgggcgggcagaaaaacaccaaaaaagctggagaccgaacaaaaccgagcggaccgaaccaaagtatcgatttattcggttgtcggattatgcttaaccaaaccggctttactctttgaccaaaccggcccaccccctctcgctccacctgactgcgtgtgcgtgaggttgaggtatccccaaatttccttccgccgccgtgctgctggtcaccgccgtggcgaggcgaggcgatcaagagctgagctaccgtggaggcgtggattgagagtctgagagagagcaatgacgccgcagctgcagccgaagcagatgcactgggcgagggccgactcctccgacttcggaggccaaatccccgcccctcggaggtaatcctctcgatccaatccacctcaaatccccgccgccgctgccgccacctgaaaccatgtgaattttcgtgcctctgcagcgggcacacggcggtgagcatcggcaagtccaaggtggtcgtcttcggcggattcgccgacaagcgcttcctctccgacatcgccgtctacgacgttggtaataagccccaccgcttgcttcgcctgattgcaagtgccacgattcagacgattgattctgtttagataagagcgctgaaccttattagctgtgtgaacttccggatgcaactcgtgtttgcagagaataggatttggtacacacctgaatgcaatgggagtggctcggatggacaggcaggccccagtccaagggcctttcacgtagctatcgtcattgactgcaacatgttcatctttggcggccgatcaggcggcaagaggtctgcgattcatacggctatttgctgggatttgaaaagcaccctataaagaattgccttatttgttgtttataacatgatgttcattgcgcagattaggtgacttttggatgctcgatactggtaaacttctatactttctcaagcattttaagaccccttccttaatttgtttgggcgtatagtggaggttcccgtgattactaataaccgtcatgttgcctctttcatattccagacatatggcaatggtcagagttaaccggctttggtgatctaccatcacctcgagagtttgctgctgcttcagccataggaaacagaaaaattgttatgtaagcattccatctaatgcaagtttccctttcatttctgggtaccatcgcttatgagttatgaagaacatttggttcatcctgattcaggtatggcggttgggatggcaaaaaatggttgtcggatgtatacatcatggacacaagtaagttaacttcctgttcttattcaatcagggttgagtatttaatttattttgttcaggatggcaataaaaaaatcaatcaattaataactacactctctattggacagtgtcacttgagtggacagaattatcagttactggatcagtgccacctccaagatgcggacattctgccacaatgatcgagaagaggttgcttgtatttggtggcaggggtaacttacatttcttgacttgacttgtatttgctgatgatttttaattattaatgaatcaatgcataacttttggccatcaacatatatttctgattatttcatatatttttttcaataggtggagctgggcccataatgggtgatttatgggctttaaagggtgtcactgaagaaggtacatcttcctagttgcttgtaaatctacttatattgagagggaaggagggtgggatactaactgctatttaaaactggaaaactcaactatttgcctgggagggagggggagaagaagaggagtggccgaatggggaggtctcaggccatcctaactgctatttacaacatctgacacacaatagttggtggtttaaccatttgcctctcaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5522 - DNA, 15021 bp, Oryza sativa
  unsure (1)..(15021): unsure at all n locations
acgcccatagtggtgagtactcaaggttgtttgactatgctcttgagctgatgcgaagtaaccctggaagtagtgtgcatgttgcccttgatcctgatgaaaatgagcatgtttttcagcgattttatgtttgtttagatgcttgtcgaaggggattcttggatggatgtcggagagttatcggatttgatggttgttttcttaaaggtgttgtcaaaggagagttattgtcagctgtaggaagggatgctaacaatcagatttatcctatagcatgggctgttgtggagtatgagaatgcaagttcatggaattggtttcttggtcatcttcagaaagatcttaatattccttatggtggtgatggttgggttttcctcacagaccaacaaaaggtattttgcagctcgttgctctgttgtagttcacttgtagtttatgacacttcacagtttacatgattaacttgttgtttctatctacaggggcttctaagtgtcattgaacatctatttccaaaggctgagcatagaatgtgtgcaagacacatttatgctaattggagaaaaaggcaccgtcttcaagagtatcaaaagagattttggaagattgcaaggtcatcaaatgctgtgttgtttaaccattacaaaagtaagttagctaataaaacacctatgggatgggaggatttagagaagaccaatcctatacattggtgtagggcttggttcaagcttggatctaactgtgattctgttgaaaataacatatgcgagtcattcaacaattggattatagaagcacgattcaaacctatcataaccatgctagaggacatacggatgaaggtgactcgaaggattcaagagaataagaccaacagtgagagatggaccatgggaatttgtcctaatattctcaaaaaaataaacaagataagacatgcaacccaattttgtcatgttttatggaatggttcttctggatttgaagtcagggaaaagaagtggaggttcactgttgatctctcagccaatacatgctcctgtagatattggcaaatatctggaattccttgccaacatgcatgtgctgcctacttcaagatggcagaggagccaaacaaccacgtaaatatgtgcttctctatcgatcaatacagaaatacatatcaagatgtcctccagccagttgagcatgagtccgtgtggcctttatcaactaatcctagaccattgcctccgagggttaaaaagatgcctggtagcccaaagagagcgaggagaaaagaccctacggaagctgctggatcgagcactaaatcatcgaagagaggtggttctgtgaaatgcgggttttgccatgagaagggccataactctagggggtgcaaaaagaaaatggtatcaatacaattacctttaaatattccttacttttcacttgatcacacaagatagtaacttttgttggtatcacaggaacactcatcctcacattacccatcacatccagatcaagctgcaccttctggagaagccaatgattcctcggttgctcatagaaggggaaagaccttgctctctcaaagccaaggaagtgccgtgcaattggcaattggagccacacgatctaggcaatccaggggaaaacaacctgctatttcatctaatagcaagacgactaaaaagggaaaaatgcctgaaggttatggattgtactatagtgaaaggaccggttccacatttcttcaggttagtaaagcgatcatgctaataattcaatctgcttgcattattcaattatagagatgtacactactttaatcgggtaaactaattttctttttgcagtctggacataaaaaaagattggtgtcttttccaagtcgagatcaatagctcaagcttcagctacctatggcgtggcgcatcagacgagcatcaacaagatgttggatggcaacagaattatttgttcttttttttaagacgagtccagggtacctgtgtgaacctttgcttaattatgtcatgcatgttggctataacttttatattgcaatttgagttgattgggtaaaatatagttgctacttttacctacttacacgattttgttatttctaggattttgataattccgtgcggtacagagttgaattgttctatatttgtttgcgtgcacgtttaactactcacaataaataaataacatatatcattagatacaatacatgcaaaagaagataaatggttcacacattataatcggggtttagatggagaaaacaaacagatagactgagagagtaatggtccggcctttttttcgttcctccatgttgtttcctttttttttcctttatttttttcttttctttctttttaatatggtaagggtagaatggtcatttcatttgtattgttgcatgcaagaatgacttggatgctcatgtggcattttttttgggtcgaaggactatgttaacccaaataattaatttgaaggacttgtttggacgttttgaaacctcaaggactaaactgagcccgaagcgaaacttcagtgaccatattagctattctcccttccttttgaaagtgactgtttaccatattatcactgtggattgtttatttaattaacgggataaattaaaatttaaagaaaatctaattcataaatagattacacatgtggtcaaacaaatgcattagaagaaagttgttttacaaaatgtattttcagaagcatgtagcaaataacccgtttcaaaaaatatggaaaacaaatctaacaagaaatggcctagttagtgccctactctctccacaatttgttatgacgaatttgaacaaacatctgtccagatttattctcataagttatttttttccgatatggagggtgtatatgcatactccgtaggtaaagagcaaatgaatcaataaatgacagtacattgctcgtactggtaccaggcaagtatatgtagctgcacctttccctctgcgtgtagccgtggatcaacaagtgacttttgttttggaatttgcaacacacatgagcccgcaaggctcttcgtaggtgattttttttttcttcagtaaatccacttttataacaactccacgtggcagaattttggagatttttagctaaatttttgggctgccacgtggtcctatgacaaggttaattcttaaccttttccggctggagggagtagcatatttattcagaatgattctggcccactggcccatgtatctttaagcagagcaatgaaatactctatatgcttatccagctgtaaaagataactgtgtgtgtgtatatatagccaagtattggtccttaaccgcaagtttttaatcaaatcatgaagcattgttggattggtggatcagaagaacatcttaaggtgggaaaaacaaggctaaagcactcaagtcaatccacttgttggtggtatgagaaatatggtgtgaacgaaataggagggtgttccaaaatcaagataagaccataccgcaactcctcaccaaaatacaagacaaaatcaagctatggagcatgtgtggggcaaaaaatattgcgagaatatccgcttagattttcatttcatttagtgtgtgtttcttttctatttttcttcatgtttctttttttctctctttcacctcccatggtgatattgtaaatactttctattctccttaatataactccagcttagcctggctacggtttcaaaaaaaaaatcctgctcatcaatatgctgaagtcattttacagattaatggtctgcgcctctagctacatagtgttgttgattgcgcttttgcatgaactgcacattttatattagctatttttctagatgatacattttcagagtccatggtatgttgtatagtataccttcatttaaatttgacgaaagcccttccttgaattacacacaacattacaagttaataagccacgcaaccacgcttaattaggctaactatttcttaccagaatacaaaacataacaatctctgtcaatcattcttacttagggcttgggctcttcagtttacttaggctcacacagattcatacttcctgtttgcagaaggccacacaattgatattgttagttactgcctccgtttcacaatgtaagtcattctagcatttctcacatttatattgatgctaatgaatctagacatatatatctatctagattcattaacataaatataaatgtgaaaaatgttagaatgacttacattgtgaaacggagaaagtaattatattactcatgtatagatgcatagaccgaccaggatggtcatcatgatacaacaaaataattctcatagctgaaattgcaacacatttccttagaaatttccgtggtgttttaatctgcaaattatattaatcacattttatctatttgctatagtaattggaatcatggtttgtaaatgtgatggatgattggatgcatagtagaaacaacttgttatttgttcgttctgggatctggaggactggggaggagctgaggagcttgtcggtggcaatacaacatctacagattggaaaaacatgtatatatattaagcttgtaattaagcatatgctaacaaactacaatagctcgatcacacatgatgatcagtcacaacttaatcaattgagtcaaatatggtgccatttattaatttccaagctgttagcaaattaaatgaagtggtggatgcatgcatgatgcatgtacataccagtttacataattatattggagaactcatacaggcgtcctcgactggagaagatgatcagtccgatctcagcatcgcagagtaaggcgagctcgtaggccttcttcagtagatcgttcctatgcttgccggatgtcacctgacggcttgtcatgctcttgattctccctatgtcgatcagtcgatctcccttcacaaacatatacacaaccgcaccctcctctattagcagttcattacagaagagcagcccgacgccgctgaagcttggaggagatattcatcagctcgcggcaacaggacgcctgacaacgacgctgtccgtcactgcggcagctggttcagtcgccaagcagtcccatgcgccattgtcaccacgcacatggcggtaaaccctggggattcatgctcgcgtgtgccgatctcgtccgtcgatagtggagggacggctgcggagagggtcgcgtgggaggagagggcctcgccgtcatcggagctagtcactgctgcccacctcctcccccctccccacgcgcagccatcgagcttattatcatccccatccagcgacgaggagggggcagcggcaggctggatctgcaccgcatctgcttaaggagccccgtcgccgtgctgccaccgagcttgatctaggagaggggacgtcgtcatcagatgtcgtcgctgccagtgacaacaaattttgaattcttgaggcgtggaagagaattcttctctctatattatcaggtagcattactaaagttgtgaaagcactgatggtctgatggatactcatccgggaagcactaccagcaatctgggcttcagatggaaggatatagatggacgcgtggcagaaatttggaggtgtctaacttaaatttttagggcgccacgtggcccaataggagacttgattcttgaccctataatcggttatagagatttgtaagatccttgtaagaagatataggaatccacaccacataagtagaatactatacctcggggtgacccgaacctatatagttttgtggtcgttcattctccattggtacgcgaggggcacaattattggtctcaagtgcacttggctccccgaccggactcacgaaaaggggacctagtcggatccccgtgatcgggagctctagcccacaacacataggcgtgtcatagatgttggaatagtcaagttcaaacatgtgaatatcacatttattttgtctattgcatattaaaatttataagatatttttggtttatatatccataacaaagcacgtgcatttttgaaaaaaatttcttactctattgtccaaaaagatagtcaagttcaaacatgtgaatatcacatttattttgtttattacttattaaaatttataagatatttttgtttatatatccataacagaacacatgcatttttgttagttctccaaagagaacacaaaggatataaaatattagttaaaacaaaacttttcttactcttattgtccaaaaagaacacaaggatataatactcccattctccaaaaggttgaagcaaatttttttcttactctattgtcaaaaagaacaataaaaagtacgaattacccccctgaactattgcggtcgaccgaattaccccctaaacccgaaaatcagacattgttcaccccgaactttcaataccggacgaattacccctctcaatccaatccggagcggttttatcctacgtggcgtacacgtggcaattcagtcagcattttcttttttaaaaagttgtgggacccatctgtcgtacatccccatcccctcttcctctctctctctctctctcacggggtgcgcagggggggaggtgggcggcggcccgagcggtggcggcgggcgcggctgggtggcgagcggcggcggcgacgccacctcctcaccatagccgctccaccccttcccttccccttcttcctccaggtccggcggtgacggcgcggaggagccgccgcgggggcgttgtcctccgtgtcgcagccggcgttcgtgcacaacgcgcgcgtggcggccgcggcggcgttcctgctcgacctcgggggcctcctggtgttcgtcgtgctgcattggccatgcttgtgcgtgctattgggggattgattggttttggtttggaacgattcgggcgccatgatccagaggaggattcagtgaacttccctcgcggttgttccgaccaannnnnnnnnnnnnnnnnnnnnnnncggtggatggttttcgtgtcatggggagttgcagcgaatggatgcgatgtagccacgcgtgattcttgcgaggtcgaagggcagagtgatggatttagtaaaagaagtgagagttttcctatctgattatctcgtcctccatatgttgtgctaattctggttaaagtgagtgccgacggttaaagttcttttcattcatactttagcaaagcacaccagtaatgcaaacagtcttagagtcttatgtgatgataccttcaatgcaaaagttattctgaagactgacaagccggcggcgagaggaggaagaaggggagaggccggcagctggccaaggcgagctcctcctcgtcgtcggtcgtcctccgtggcctcgtcgacggcgtcgtgggccagcggctccaccgtcatggactgggtgagccctgagacaccgtctcacgccgctgcccactgcccggcccgcgcgccgccgtctgccgctccctcgtctcgcgccgccgcctcacctcgcgcccccgcctgcccctccgcgccgcgaaggtgaggtcggagcggtcgcagccgcggtcgacggagaccaccaccttggcaccgaggtgcttcacgaggcggacggccacggcgttgccgagaagaagaacgccacgtcggcggcgatgagcgtggcctggtctctgcggccaccgcggctggcgtcgcgcatggcgacgagctcctgccggttcccctcctcgtttcgcgtcgtcgccgccgcacaccgccgtgcccgtgcgcgcctgcggccacgcgagagagagattgggaatagctgaataagtgaagagtaggtatgacatgtgggtcccactttttttttaatgaaaaatactgactggattgccacgcggatgcagcgtaggacaaaacagctctagattgagttgaggggggtaattcttctggtactaaaagtttagggtgatcaatatttggttttctagttcagagagataattcggtcgactacgatagttcaggggtatttcgtacttttttttcaaaagaacacagggataaaatactccaattctccaaaaagataaaacaaaaaaaattccgttgccgggactcgaacccgggtctctcgggtgagagccgagtatcctaaccagctagaccacaacggattctgatgggggagcactcattaattatttgtctgtgtatgacgttatcaggcgattacagaaacccgcagtgtataggatatagagggcgcgtgttacaaacaattaaacggcctgatcttgctatgattaagatgaagagcaaagattggctaatgcgaattattatcggagaaaaggtggctgagccgtgtttgttaatttgacggctcatctcgatctggggcggccgtgacactcggaatactgagacgggattgagagtttgagatcccctgataattttaggggttaataacaaacacaagtaaaatgtagatttatttacacacaagtagtataagatgtagtaatcggacggacgtggtagagggagacgagagagaaaatggaaggttcggaaacgggatcccgaggctgacatgtggggccacagttcccgtccgttctcgcccgcgtgaggtgtaagcagaaagacgatcaattcaattcgggtcggtttcgcctcgtctctctcattcagatcgtctctctctctgggggggcttcaaggagacgacgcgacggcggccagagagatgaacatcctcccatggcaatggcaagggcaagcgcaagcgccccgaacagccggcgccggaggaggaggcggaggcggaggcggagctcaactcgatcttgctccgcaagatggggtgcacaaatatgttgtcgccgtcgcagctctcgaaaataaagacgatgttgcagtcgaggcccgatatctgcaagaggaacagccacctcaagttctgctacagcctccgcaaccgcaatgtgttcgtctccaaaacccacaagccacggctaggccctctccagtacaagaaagggtaatctcatcccatctcatctcctccttttccttcgcaatttcatttcctcgcatacaaatgtgaaatactacaaatttgtatcagggggttgctataggattaagttgatgataggaatctggatcggggtccccttcctccaaacatgccctaatgttttttcttttactttgttcggccgatatagcattatccattttacaatcaaatatacactaaatgtttcactatgttcagtttaacatgatgttttttttttgaattagattggtgtaatgcaatcaagacttgattacctataaacatgtgaatggtcagcaaattgattaagctctctgcagtccacatcgatatgcatgcaatgcgcaaaatccagtttaggcattagttccattgaacatgatgtactcttcattattggaacacctgtaaacaagatgttgcatatttagagcattttgaaagatatttcgttgttcctgattataaatggcaacccaggagcatttttgttgtacaagtgttgttttagagctgttgcagttatcaacagcgtttgacaatctggttggtaatccaattgtctgtgcacttgttgactaacgtttgaactgtttttcatttcttaatatagttggtttgtagctcaaaaagaaaagaaaaactgaatcgctctgaatatagttttccttatggcagctatttatcaacaattaactgatgactatgctgtctttgctctacttccttgcaggaaggaacctgtgtatgatgggtcatggcagaccccaacatgtgcaaaggttgctctagaacactataacagatcaaatgaggtgtctgcttaaacacttttcatgtttattctctatattatttgtgccataggagtacccacttatgttggtgaatatgttggcaggatgaatatgagatggttaaagcactggacagtgtttcttccttcttcaatggtgtgtgggtgcatgtaaatttccttgctaaactcaaaggggccacccaatgtcctgaccttgttcccaagttctttgctgaagtgaaatccgattttgatggaaggtcatgtgtctcttgtgttaagattgacacaggtatgttaagttacaaaccacgagattgttgttgtattggtaacatttctatatgaatgatggtctacttctttctctttctactgctgcatatttcaagtttagtttggttcattgtaatcataggttctgttaagtcataggttgacccaaaaaataatttgataagtatgcatgcaacacttgtgaggttttactatgctaacaaaaaaatgcgaagcagataaggcttgttagtgaaaaataaaccatcgcatccacgttttgataaaagaaaacaagagatcattttcgctcgttgtttcatctctagtttgacagtattagtttttggactcaaatattattatcatattctgattggtgcaaatcattcacataaattaagttctaattctgacttatttcttgcaggtaatccagaggcaacaccaattcgcggttgtgggatttgccaaaataatgagatctaccatcctgctgttggagggcaccgaggagacaggaagagtgcatcataatgtacgaagggatgtaagcgggccgaccggataatctacttatatgttaaataagtggctaatccgcaggtttccgcatcatagcccgatttaccacacctagaaatgtaagtgggtcaattcataaacccatccataggttaaattagtaggtaatccgcgtgtcaatccgcggcctgagttacccactaattttgcctataaacggcttcacgggttagctcgcttgtatccctttaggctttaaccatagttcttttagacagaagacagctgcccagctttggattgcaagcataacagttggtacagagcttcttttttccccattaactacaagattacagattagggcgaactccgattgagttgtgtatatacagtgatcaatacaatactctgatgaagatgaacttcattaattcacaaacatcagaatttacagaaaataatcaattcaactctcttctcattaattacagatcgatcgagaagagaagcaatgcatatgcataacctgctgcaattcgatcggaaaaaaaatcactccgaatctttgatgaagatatttcattttagtcacaaaagggcgtgatatcacactttacagaaagaatcagttcaactcttctcattaattacaggtcaatcgatcgtatcttcacgcatctcagttgcaaggcacggatcaaacaaacacctaattgattgatccatgcatgtctaactaaacccgctcttcgatgaaaaacactacattactgagtgctagagccgctcactatggatcaatcaaactcatggcagttaggtttatccgggcactaaaaatttttctacaccggccgctgatttcagtacatttttggttccttctctgaaagtttagcatttttctctgatgatgaaacgtaactaccatgcgttgcatgaggcaaacaacgatgtttccaacagccggagctggagttgggacgtcgtcagtttcagaggggttcagagattgaaactccgaacaatctctatacaggaaaaatcatttttttaaaaatcttgttccttctctgaaattaatttcaggatttttctggttatgaagagtgaacataagtagcacgtgcgttgcatgtgaggcggcaaacatgtttgaagccggagctggagagtggagaccattcagttccagagagggttcggagattaaaactcccaacccctttgatccttcctttttcaggctatcttcttcttcttcaggtttaggacatagatcgtcccatttagatcggataacaaccatttagatatgcatgcaatgcacaaaatccagtttacacattcaaggtcagtggcagttagttccaggaacacgatgtatcatgtatgcatttttggaacacctgtaaacaagatgttgcataattagagcctcttgaaagatattccgttgctcctcattataaatggcaacccaagagcattttcttgtgcaagccatccactacatttacttctcaaagttctcactaatctatccaagtacaattgatacaattccatcaatactggaattcttttatccataatctcttacctactactatatgcatgtcagcatgtgtcttctgtttgcacccatgaatagcaatctttgatatactttcatcaaacattcatttttgcacaatataatatccatggggcaaagtatgacacaatcaagcaataaccgttgtctcagaagcagtggaagcaagaacaacatcagattcagaccaaccgtcccatatctcgggcaatgcttccttgatgttatgaatgctttcaagagcgtgatcagcacctggaaccagcgttggcctcccaacctgcagcaaattcgtaatattttattttaacacgattacacgaacaaagaaaggtaggagttttcaggttttgaactgtttatgcagtcttacaatcacagtgtgaaagcctgcagcttttcctgacgctatgtttcgaacgctgtcatcaaagaagatctgaaaatacaagttcaagaagtcagatttccgccgcttgatacggaagattttgggccatgtaacttaagaaaagattctcactgttttctcaggatcaacattcgcaatccgaatcgcagcttccatggcttcaatagagggtttgcagagaattggtgatttaggtctgaagccatcagattcatccaggtcatccaaatcagaagatagttcatcagagatagaacttaggggcttgtgtagaccatggcatgttggggttggtggattcagtgtctcgaagcatattatgccttcgaagcagtcctgtatacccaccctgcacagaacctcctctgcatgagctttatcagagtttgtgaatatctgcagcaagcaaatcaaagattataaaaaacctgccagcaaggatcttccaaaaggcaaaactatagggaagtatcatactatttttctctgtggaatagaaagtagaagggtcctcaaaacagggtcgaaatgcagattgtcatatggcagtgtaccatggacatttgcatgaaattcatcgttatcaaactcgtaacctaatgcctgcagtaacagttgcatgattagaaaagaataaaaaggcaaaaataatattggcaaaatcaagttttttttttctttatgcaaaatcagagaggtttaccttaagaccagccatcgtggtgccatattccttgtacagttccaggcacatatctgcaatttggctttcttcaattcgcagatggcgacgcatgtaatctggcagtcaaaattaccaaattgcagtctctcccaacatttgtgagaataaaagtgctttataaacaggaagatacggaacatgattagtattactacacaccttgtatatttttgcgacaagctagattgatgccagagctgaaggggtacagggtatcatccaaatctgaagatgccatagcaaacagattcattggactgtgcagttatattgaacaaacagtgtcctctggttttataaggaatggaattgtggaacataccaaacagcaagcactcatacttcgatccttcaactatagcctccattcttgatgatcaaagctgaaagggtgatttctaaatgaaatcacaccaatttgagagcctgaaattacatgaggaacttatagaatgacaatatgatctcaagagcaaaaattggaagggactctgcaacatgcctggtaaaacaagtaacacggatttcaagtacagaaccaatcaaactgaagctgccagacctgaacttcagcgattcacagtcatgttatattgtttccaggggcatataatcgtttttttttccccgagaaactcgggaggctgtggtaggaaatatatttacagggctgagcttttggcaggacactcttggctttgagtcctgacaaccccagcaaaatatttttgtggttagaatttggtgtgagcatgtgatatagacgatgtaaatcaaatccaccattgtttttactgagagggcatattctgacattagctaagtttaagtgtatttttaaagttcaatcaagtatcatcatctcacaactgttcaagatagaaccaataataggacacaacgtcctctgcaaaaacaaaaagggacaataataccaaaataaagccaaacaatggagagcacaacgagagagttgctcacctcaaaacagtgaaggcttgaaggctcctgatgaatggtgttgaagctagcactctacttatagcattccaactccccaaggctccacgtacagaagagatgcccactgcatttgaaggctgacatagacatgaagaacaggatatccagccaatttgttgcccgtcactgtagctgtacatcaaggcaaggatgcctcttaacaagagaacagatctagtgttcaactttgaaggctggcatatgctcccaactcccaagtaagatctgcatgccaggttcctacaaagtggcaggggaatatatggcaacaattgaaagaatcaaagaatacagagtacatcatctgttttgaataccgtggaattttgcgtagatgaagaatattggagcactttgaataccgtggaaatttgcgtagatgaagaatattggagcactttggtagcagttggatgtaccattcgtctattccaagtgctgttgtttatccagcaccctctgttgaagtcataaaggatgagaaagaataagaatataaaatggatatattgcgaatcagaattcagaagcttccaa

SEQ ID NO: 5523 - DNA, 1111 bp, Oryza sativa
tttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctga

SEQ ID NO: 5524 - DNA, 9260 bp, Oryza sativa
ggcttcgccgctccccttctcttcctcctcacccctccctctttctctttttctggattttgagtgaatataatgaaaattctgagagggggaaggggttttatactcggaggggtaaaaatcgccctccctaagggcggcaagggggccgcctgcaaaattccaggccgcctcgccgcccttttgcaggcggccccccggacacccatagagcggccttcgggagggcggcaagggggccgcctgcaaaaaaccaggccgcccttttgcaggcggccccccgcaccgtagtaaaccgccctccgtaagggcggcgagggggcctcctgcaaaatggcagcccccctatagacggccgttaggcgtgcgctaacggtggtcagccacgtcacgaaaatcgccctctgggaagaaaaaatcgccctcccagacggcggcgggcgactacttttgtaaaattttgaaacacaaaattacttttgtaaatcttttaataaaaaaaattaaaaataaaaaaaatttctccacccgggttggttcatcggtacatgaagaagcccatcggcccagcatcagtttaggcccaaatgatcaggcggcccatcaaatatgtgcacatgtgctcttcagtggtagcatagggtatagattatttgactgtacgattggaggggacaactcctcttttttatattactatatagaatatagattattttgtgaagtcactcgcataaatacattaaatattataaagctaataaataactttgaaaaagaagctatttaaaccatgcttaaaaagtttgagaaaacatactttcggaagcgtgctacctacattagctgtttaaaacgccaccgaagtgatataagacgaggacgtcctaacaaattcagttttaatttcctcgtctttgcatatatggaaggaaccgaagaacttcacctcaaaaaaaaaaaaagaaactctgctcttaacagattaaatcttgttaaactaggattagcttcggtttaagctgagactgcgtttggtgaacattgctacctacccatccattagcaatttaggtctcattttttcttgagttgcagcggtttgggactttgggagtggtaggtgtatctgacagtctcgaatgtgccacatctcttttcttctctcctgtctccttctccaacctaacccctgcctgcctgcatcaaccatatatgttgtccttcaccaataaaacacattgccctactcctcacgctctttcgatcttcctcctctcctctctatttctctcatcaacaattaccgcatcacaaggagcaaaagcagtttcagtttcggctccattgcttattaatttacctctacagaagaagtaagttgatctctctttcttgcttcaatctgattgtttccttgctagttgaaaactactattatatactctgtctttcgtccatcttgagtgatatcatgaattgatacacattctcatgaatgaatgtatcaaattccatctgaaactctggtagtagctgcacacacatttcagaattcagactttgcactagctttgtgcattgagatagagaaattaccaaagtagatgtaagcatgtaagagttgttgaaatatgcttacatacaaaaattgtataaaaaatatgattatgaatgtactagtgaatagtgattacaagatttaaactcctaatcaattaagtttgcatcattgatgcaagttcagtgggcacagagatggccaccgtggaggtggagggcatcccatttcctcaggagatcaccgtcagtaagccgttatcactgctagcccatggtaattaattaatctattaatgatttataagtactccatttgactaataccagattatgagtacaacacaagcctctaaatgcatttgaaacaacaaattgcaggcattacagacattgagattcatttccttcagatcaaatacaacgccatcggggtgtatcttgaaaaggacaatgtactagggcatttggagagttggaagggcaagaaggcagaggagcttgtgcaggatgatggcttctttcaggccctagtttctggtaactaaaatgactccaccattcaggttttgcatttcagaaatatgtaaaacggatttggaattgcttgtctatagtatatcaataccattctcccatttccagttacagatcacaaatagtagtattatctctgtagagtttatagaacaatgttctatcctacaaaataaaacagagtaaggttcagtctgccgctcctgcataactgcaagaaaaaaatgtttcattttttcatttgagtcatgctgattgatgctgtgcatgtacgctagctcctgtggagaaactattcaggatcgtggtgatcaaggagatcaaaggatcacagtacggcgtgcagctggagagctcagtgcgcgaccgtctcgtgtcagtggacaagtacgaggatgaggaggaagagtctctggagaaggtgactgaattctttcagtccaagtatttcaagcccaactccgtcctcaccttccactttcctaacacccctggaattgcagaggtataatcttgtagagtactccttatattcagctgggtttggttaagatatcaagtgatcaaatctttgttcttgcaaacctaattgaagcatgcatatatgtgtgcagatatcatttgtgacagaaggcaagggcgaggcgaagctgacagtggagaacaagaatgtggccgagatgattcagaagtggtacctgggtggagaatctgcagtttctccgacgactgtgaagagcctggcagatcaattcgcagcactgctctctgcatgaggcatggagtaataaactactgtagtaatgttgcctgtttcccattcatttttaactcgatcatgctttgatttgtccagctgctctcatgtgcatgctacaattgataatggtattggtttccctactacttcaaatgcatgatttacttgctccaaagcagaggaaacatactcaaatgtatatgtttcaactttacctgtgtatctggtgcaagcaacctaagacagtgatagaagtgaaggtaggaatctgtccctgtactgctcatgtgttggaattaagtccaccagtggttccaacttccaacttgtgtattgggcttgcaaaatgaagctggaaaaagacaccagaatatctttgagagcaacatcatgacacaaattcatgaatagtactgtactgctatagtttggtgtgcagtcttcagtattgtacatcctttaaaacctcctttcagtgttgtactcattttggaatcaaccaacccatacaagttacctactccaacaaataaataaattagagatgttctgctttaacttcttctaaggatgatctaaaaaaaagattcttctaaggggaagttaggatgcatgttgccaacaaaacgtagatactagtccacagtcaagtcagttcttcattttgttttacaaagaatatagtactatatttggatagcaatggagataagatagacaccacttcgaataaaggaacaaattaagggaggaatctcataggatcaaaatcacagtggattttttatcacatatatatccattgaaaatttgaaattgttgggtttagtcccccattcgtaattgttaatggaggggtacaatttaaaaggtaaggacggtcgttacttatcagactagtcttttaggttatgtaggcccaggagctaaagttgtggcaccaattgagtttgtggtggagcagacccaatgtgaccacggttggtgggccgggctgcacactctataacaagtggtatcaaagcccacgtatgaaaacccaaaacattttttataggtcacatggtgggggagctccagtaatgtggcgggaaatattgttgggcctcggctacttcagtggaggcggcagatattgtttggccgtggcctgcacatcgagatccaaacattaagaaacgtcatagaatatctaaacgtgatgacgacaccaagatataatatttgttaacgagattcagccgaatcctatatctccggacactgattatgaacactcgtactagatgtagcataattacagcgtatcagaggtacaacaaacttccgtcggacaccgtcgacagccattccctctcgcctatgctaagtcgttatgtggttaattataataagtttgcctctctatttaagaagagctgatagagtttgattctaactctatcctacccctattaaacttcaagttctaaactgaaatcgactttatatacatattcacacaaactctaacaagaagaaaagataatcaattagaaacctatattgaatggcttaatatatccgtagagaattttagaggaatccaaacatatataagatttgacatcaccgaagacgtattactatgtgccaccccaggcaccctctccccaaaatcctacgttattttttttgaagcattatttgaacagaacaattgaacattttctgagtttttactccaatgcttgtgccataaatcgagcgcagaacgctggcatggagcgatcttattctgctactagtactagttggcaacgtgaagaaaagggaattgaaaaggaaaaaggtctcaggcatgggaggtgattagatgctggacaacaccaatttgagaaaaggacttgccacttgggggaaagtttggccaaaataccaatgcaattcctccaaaagaaaagaccaattcaattaatgctttctctccttaatttggttttgctggtgagtggtgacaaaattatgcccagaacaaacgaacagcgaatctggggtaaaaaaatcatgtgctagcacacaaattaaaggagaaaactcatagaaacagctaaacagataatccaagtgagaagtgacagtgacactgcaaacattgtgtccaaccccttgcatttacgcaatcccaatttatattctattcacattgtagacctcttctgttcgagaaattacatacaaaagaattaattatattactagctatgtttggccgccggtgactccggcatggacggagagaatggagtcccggcaagtagggcaggacgtgtgcgcggcgagccacgtgtcgatgcagccgacgtggaagccgtggtggcacctggggagcacgcgcaccttgtcgccgtcggcgaagtcgcccaggcagatggcgcactcggcgtcggggacgccggcctgcttggcgccgtacacctccaccgtaatcctcctcagctccttcttcttcagcccgcccgtggtggtggcagctgccggcgtcgccatggcgggtgagggtgagaggccgcgggcgcagtggagcgcgcagcggatgagggagctgaggccgagggagcagatgacgacgcagagcagcgcggcgaggacgatgaccatgttggcgtccaaggcgccggagctcccgccggcctgctgcatggaggccgtggccgcccatgccggcgtcagcaccagcgccggcgcctccacgacgtcaaccagccgccgcatggctggctggtacctctagttaagctagtatagctcaagcatatgcaggaggaggagacaaattataagatgttctttttaattttgttgtacattgaatttcctttggatttggtgattggattgggtgcaccagcagagtgagattattctggttcgtcgctgcagccaaaccacacattggattgagctctctcaaaaagtggactctgaaagctagctagcggcagcgctacatatgtctctatttgttaaattagttttccctgtttcgttttcgtgtaagaaataatgtcgtatttatatttgtgccactttcgaggatgaacaacaatgcccttaccagtatctggcgcacaatacaggctatgtttggcaccccttttcccaacctcctctctcgtttttcgcgcgcacattttttaaactgctaaacggtgtgttttttacaaaaagtttctatacgaaagttgtttgaaaaaaatcaaattaattcatttttttttaaaaaattagctaatacttaattaatcacgcgctaatggaccgctccgtttttcgtgcgtactgttagtgttgggaacagggctgccgaacacagcctatatatggtttagagaagtccacattaattaatttaatcatcaactattgcaatattgttccaactttgatcatttaactctatgaaaccgtttatttttgtctcccaacacacttatagatgcccaatttcgttccttggtctaaatttcatccttggggtctattccaggatgattttcgattacgtggagttgcagagggtataggtttcatgcccaagtctatttccaatcagccaacgacaactttttacaatctatatatgaaaaggaaattaatggatctaccatttcaagcaatagatagtgcgcttatctattcattagctcatgtcgatcaaattaattttaggtttagacttgtagatagggattgggctccctatcattgtcgaatattcacaatgtgaacatttaaattatactttaaaagacagtgtcaatgtgaatatgggtgacaatgtgaattcttaatgtgtgaatgtaaatgtattgccacactagtggagaacccatttctaacaccagttgggaaccgtttttagtatcggatgtagaaccggtactaacaaatcgagactaaatatctcgatctttagtaccggttgaaataactggtactaaagatgcatacgaaataaaaaaaatgtgtaggatatgtgattcgaactcaagatctctcacctcagccctcacgcgtgtaaccatccaccaactccacccatcagacatggatatggatgctttctttttaaactaaccctgtagacatctttagtaccggttgtaacaccaaccggaattaaagatgtttttgtacttggacttttagaaccggtacttaaaaatatctctagtacccgttctaaatctaaccgaaatgggtatcccgataaaatatcagttgtgtagtagtgccattttgtacgactgtgcatagtgtggtgcatcttttttgacatactacgataatgatacatgaagttgtcttaaggaaccgctcgtaaaaaacgattttcacatacgggtctattaagacaaccggctgcactaattgtttttagagtgggcttgttttatgcctgtaaaataatagagatgattttctatatatagcaagatcacattaaacaattttgttgcgtatcacaacgagggagtactactactgcagatttcctcagcaagaagctggagtagctagtagctaggaccaagacatttggacaacatgcaattcataaaacgtataggattacacgtacgcacagatcgtgtacatactgaagaaaattaagatagaacatgcacacagggagcgtgcaacataaagtatacagctgatacagagagagaatggagcgctgcatgtctgccgcagctgttattttaattactttgttcatatatgctgtagcaagtacgtgcttaattactagctgatcaactccgattgagctagcatgttaagctcgatcgatcgatccaagcaggattgatttaactgaccctgcaccaaagaaaaaaatgcacatatatagaaagttagttattttatgggaaaatgtttcatatctcgagaaatatctcattgttgctttcatgccccccacctaaatagccattaaaaagtaaaacaaaatgataagctagattaatattaatatacatgtccgtaaatatacatgtttaaatttaacttgtacttgcaacaaaaataacggatataatagcgaaaatacgttaagtagtgttagtttagtttgttgtttttctaattaacttgtataagttgaatttaatcttttatgtctatgaagtgagatatatctcacatatgataatctattttaacttgtaaaagtttttattaactattactccgtttcaggttataagacgttttgactttagtcaaagtcgaactattataagtttgactgattttgtagaaaaaaagtagtaacatttttaacccaagacaagtatattatgaaaaattattcaattatagatttaatgaaactatgctggtattgtaaatattattacttttctatagaattagttcaacttagagtagtttgactttaaccaaagttaaaacgtcatataacctgaaacggaggagtatttagatagcactaaaaaataaagagatatatgtgtgtatatatatagagagagaggggggggacgtcataataaagagagatgatatacttgttgcagtcggtggagaggctgatggggaagccaacgttgacgccgcatttgccggggacgccggcgacggtgccgaggttgagcgacttgatgctgccggcgaggctcttgaggcagcggcaggccgcctggcggtcggcggtggtgcgggcggcgttgttcagccccttgacgccgttgcagcatccctgcgtcagcccgctcctccccgtcacgtacgagatgcacggcgcgatcgccgatcccacctgaccgcacgtgatcgccgccgacgctcccggcgccgccaccaccatcgccaccaccatcaccgccaccaccaccttaccgttcaaagccgccatattcaagattactgatttgatcgtcggatgatcgatgatctgatgatcgagtagctaagctagatagctaatcgtcgccgccggtgatggatcgtcggtcgatgggtggagggtataaataggaagctgctggcaacgagctgagatgcggacgatggaatcatacatccattgatggcagtcgctgctaggtcgttgggagttggactcagatcgacctaggtactctactagagtctgaatgatgtacgtactacatcacatgtgttccgtgttctccagtactacctccgtcctaaaatgtttgacgccgttgacttttttaaacatgtttgactgttcgtcttatttaaaaacttttgtgaaatatgtaaaactatatgtatacataaaagtatatttaacaatgaattaaatggtaagaaaagaattaataatggtttaatttttttaataagacgaacggtcaaacat

SEQ ID NO: 5525 - DNA, 6743 bp, Oryza sativa
cgtcaaacatttagggatggagggagtatatttttatgtatacatataattttacatatttcataaaagcaaatatatttaaaaaagttaacagcgtcaaatatttagagacggagggagtagtagctatcagtatcaggtgatttaattacatcatgggcgatcgagttggaattaatattttgcaatcgatctctcctctatcgagcgaattcatcttcaacaattaatattgatgaatattgctccagtcttctgaatatcaacgttaagcccctgtttctttcagcttaggattattataatccagattattaggagtaagctgaaagaaacagacaacttattagagtagcttattataatctggagtccagcttattataatctgataagctcatttatgtgagctttttctagattattaggtgaaaaattacccaccatgccaccacacttcctctttagacttgcaaacctaataatctagactctaataattaaaaaagaaacaactaaccgcttattctactacagattataacaatctagcaatctgactcaataatccagattataataattttaagctgaaagaaacagagcctaagtcttctgaatctgatcaacgacatttgtacaacatgcatgtgttccgttatatagttctatcagtatcaggtgatataatcatggtcatgggcgagtaggaatcattattacttgcgtttagctcttctagcgaaatcatcttctaattacggcaatgaattatttggaacaccagaatcaatattccgataagctttaatttcggtactactgaattttacgttactatatgtgtacgtgcctagcaaaattaagttactagtactactctctctattttcttactcatgacatggtttacttttaaacgttatgtgttgaccgtttgcctcatttaaaaattaagtagtgcatgtaaatatgtaaatacgtaagttatgtttaaattttctatatataacaataaaaacaagtggcaacaaaataaatatacatagctagttttaaataagatgaacagctaaacatcaaattcaaaaaatatcaatatatcacatatttggaaacagagggcagtacaatgcaacgtgtacatgtggatgctactgtgtgtgatgttattgtctagctactggttccctcagggcggcgtacctctacagccagcagaaatggattattcatctggtgtctgctcatgcgacgactcatctgcagtcaacacgatgtaggacaatgcaatatatgcatgccaagcaaataggagtaattgccatttgcccccgctgcgtgcatgcatgatataagagtagcttttgtgtgtgtatagtatttttaattaccggcgtcgatggatggttatccagcctgttacaaccaatcaaaaatctggccagcaggtctttactatagctgttattcaatcaaagcaggtacaatagactataagctagttataaacttattttaagaagataaaagataagaaataagagcagcgggctacagaattataaccagttgtaacacatactccaagatacatatgtatacgataggttggaccagatattaattatatagtacatacttataggtaattattgtatgaattggctattaaattgactatagatgattttgagccaataattggctataccattaaacttgctcgtttcacttcattaaatatatcgctaatagtgatagctttaaattttttgttgaaaagtcattgtttgtagtaataatgtagccctgcttagggatgaaaacggagtggatgatactcataccgtattcgttttcatatttttgccagatacgagagcaaatacggatagctcgaatatggaaacaaatacggattatctcgaatatgaataagaatcgaatatgatcggacatgaatatggaaacaattttttatcgaaacacgaaaaccaactcaaattctaataggaacaaatatcaacatatataattacctcattttatataaaatgtagtataatttataatttttttttaattttaaataatattaatattgtggactagtgttaagagatgaactactattaaaatctaaaaaggtatattgaaagttatagaattataaagaaatgaggtatgtctcatgacttctgtggatatctgaatagcactgttcaccggatatccgaattattatccgtatccgacggaaaccccgataccatatctgtatccgtatccgggaggaaatatccgtatccaaactatccgatccgaaaggtatccgtattcgtttttctctggagtggacggaaactatccgcttcgtttttatccctagccccgctagctcctagcacgatcgttgagcacgcgtaagtaacgtacgtatttggagaaaattacatttgtagtttttcaaaaataattaagctaataccaattatttttgtgaaaatactactccctccatctcattgaataagacacgcatgtattctaatattcatttgtttaaatatctgacccataactatttcattataaattaaattttatttgatgaaaatagtattatattggattgatattttaatttgctttcttataattattattttgttactataaatattatattatatgagaaatttaaagtcaaagattaattttgtaggtcatgccaagtttgattgtgcattgttcagtaacggagcgggtaagatatttagcatcacataggtgccatgtattggatttgtatcactttcaattaatttcctggttagtgataatatatttagaaattttagttatattaaagtttaacactggaaactgtaaattgaaggctgtacaccttatatctttttcagcaggatagtgctaacactataatagtagcagaacatattaaagagtcaaaaattttctcacaaagtcacaaagtgatgcattaatatttgctctgatcaatcgataatgaccagccaaatcttctcagccgtgcaacaatgcaacacatatattagttgcttcaattaataccaactgtacacgtatctcgcgtagggatggcaatttacccggtaggggcggggacccgtaggggacgggtccctgcccctatggggctggggtcgggactggtttcgtacccacggggcgaccggggcagggccccgactttgttcggggccgggggaagaattccacccgcgggtccccatgggcccccgaaaatatagccaatgaatacccatgtctatactagtaatatgtccgtgctaacgctacgtgacatctcacaacagcatcacaatgatactttgacaggaaaaaaattctgtacaaaatatcatgcttgattccattgttcaattttcttttgtataacagaacaccatacgaataagcccgagtacggtctgatataggttaacatgtattgcctccgttttttaatagatgacagccgttgactttttctcacatgtttgaccattcatctttttcaaaaaatttacgtaattataattcattttgttatgagttgttttatcactcatagtactttaagtgtgatttttttttgcggggaaaaagagaataaattactcaggaatcaaatcgtttcttacaagatttgatacaaaggtgcaatcacttccgcaccaaaccttgttgaggttctcacatctacctttatttgctaagtagtgactaactgaattttggcttctgtgagtcttcctgagtagaattttggctaagtgtgatttatatcttatacatttgtataaaatttttgaataagatgaatgatcaaacatgtgagaaaaagtcaacggcgtcatctattaaaaaacagagggagtactttacgaacaggaaatttaatatacacagtttgaaatttgaaacagtagtgatgtatatgtctcgactttttagaatatacacagaatttatatgtctcgacttttagaatatacacagaatttgcgtagtattttatgcaacgattattggttagatgttgctctgaagaaaaataagcatatttaattataaataaattgaatagaccatgcaatcccatctctgtagagcaggtcatcaaggcatacaaatacaaaaatatgaattagtattcattcattaatatgaattaaagtctgattattgtgtctgcttggtgcggtggtgcctatgctttcttgcgctgcaatgtcatcatgtccctcttctctaccttgatgatgacaaaatccatttgttcctccatgaaaaataataaacaaggtcatgataaaaaggaacatgatcacaactgccagtaaacagatgaacagaaataaaaaagatcatgcaaaacttacatctccaactgtatagctgtatcacctatgaagcacttaatgtctttcttaacagcacgtacaagatggattccagtgttacattggatatgctataccattcttctatgaatcaatgatagttgcaacctggctgtgtgtgttagtagcagatctatgcaagtagtctacaagaattacattattaggtggcaggacaagaagcactgttatatgtcgaggatattcacattcatttgaagagtttccacatttacctaaaacaggaaatgaaaccattgtatcgtatacccagccatacctttaacctcttccaagccccacagcgttgatggagctgttcgattaaccagccagcacaagcacatcttattgatatgtttgtcttcgactccaaactttaacttcaatgttttccgttagcacacaattcaaactactaaatggcgagttttttttaaaaaaattatatagaagatatttgaaaaatcaaataaatctattttaaagtttataatagttaattcttaattaattatgtgctaatgagctttcttgctttacgtgcgcgaaaaatctttcttcaaactcaccaaaagaacgcaaccttatctcaacagatccaactgagcctatatggtctgattcaccgtgcacccaaattaagaaatattaaccgaatatgtggtcaatatacatccacgaaaacactaaatatcttaaactaaacagatatactatcccgcattccattaacaaatcacaaaggtgtcattttcataatgcatagagaaacaaaacttatggagtgaagtcgtaccaatttaccatcagagtttataaaatgattataaatattccaccataacttgagctaccaaaatagcatgtacagttatcaacaggttaagtgacagtgagtcagtgacatgccatacgaatgatcatggtagcacatcctgcaattaggaaaaattgtagatttataacaaggattgcagcgtttaatataaagattcatagggagtatattaatgcaattcggaaaaatctgaacagatatacagttgaaaaaaagaacttttttgcaagattaatccagctcttgttcatcgcagccggcggcaaaccgaatagactggcgtgccagtgaacatgcgcatatcagcaagagtagcgactatatgtaccttagcagttagctagacacatatgatgtgatgaatagacaatgtttgtttaatttcacctttcaacctgaaatttatcggttcagaaaagtaagaacactaatattagccatgaaacaagatttccaatatggcgcatgaatatatatatatatatatatatatatatatatatatatatatatatatatatatatatatatatatatatatataatgtcaatgtaattctgcagttctactgataagaaactatggagatggacacttaaagcactgatttatacagagggggctgcgaggacggtggcgtggtggagatgtgttcggaaacttattaaaatagggcactagtgacagtattgcaaacattttctgtggaaggaagtgaaatgatcaaaccgaatatccgacatgcatcaggaaaggaaactattttaccaaatgcagagctctgttctctccggtaggcattgaaccaaatgctcaaaatatgcaaccgccatacaacaaacattttgacaattagcaagctgacatgaaaaaaatcaaaacaatgttatcttaacaatttgtgcataacaattagcttaaacttcaacttctagtcttctctagccaatagacatcagagaaccaagagagaaatgaataatttaaagcttgtgggttccataagcatactaagaccctgaaattacactctaataaaataggggtgggacccaaatttttcaccaggccacctctcaagcatcagaatatggcaatatttaatagtaaaattagtcaaacctctcttgaagccacctctcaagcataatttacccgtgctaacactacggcgatgtttaggaaatatgcacatgaaatccatgttaaaaagttcatttcctacttaaaaaatattttactattttgaggtccagatttatttaaattttattattacaaacaggagtagcctttagttataaaagttccaagtctcaatcaagagtaatttgttcactattaccatgttgatgtgtaatagttgatctgactactttataagatggttcttatttttctacatgcataaacaaatactccctccgtttcaaaatgtttgacaccg

SEQ ID NO: 5526 - DNA, 2510 bp, Oryza sativa
aaaagtcaacggtgtcaaacatttcgaaacggagggagtatcaattaaaggttttctattgtttcatcaataatcaccatttgtatcacaatcctctgtccagaatttaagaaaggtttaaaaaatatgtatggccatttttggaaagaccatatttgaaagagaaaccagcaatccgttgcaacacatgatacacatctttggcgacaccaatttctcatagtatgccatagtatgccaaaagaaaatccaaatctcattctgttggacatacctggtccaaatcgaatttctagaaactaatctagccaacaatgagcatttgtttcttttgcaaggaccgctgaacaacttacagaaagggcatatcaaccattaaagtatccaagtaagaattgttttagactgagagagctttgatagccacccatcaaaggttcaaggcacttttatgaattaagaaggcatgaaacttataaaacaagatgcacatctatattacatccaaaccaaggtctctaaaatactactacgtagttattagccaatgcatatccacaaggaaaaaataacgtgaacagtgatttgacaaactgatatttgcactcaaatatgatagacaaggttcagcaaaagatattattaaaccctgatcaatctagtttgtgaaattatctgaattctgaagcgctttacgcaaggagcagatcaatgatgatatatgccatattcaagtcactacttacagtgcttctcccctacttacatactcacacagaactcaacacttgttgaacactgcagagatcacaattcatgtttcacaattctgaacattaccgatcgatttgacactcttgccggaaccatcatatagtttgtacttcctccgtttcacaatataagttattttagcattttccacattaatattaatattaatgaatctagatagatatatatgtctagattcattagcatcaatatgaatatggaaaatgctagaatgacttagattgtgaaacggagggagtagaagtgatattagcaaatatagacaagcacggtataattaagctagcacatcaaatggtttggtctaagagattttaccatgtcccagcaacagagcagcacctcgccatggttcgtgtggaaggctggaagcccacctggttgtctgccgccgatttggacggggatgctgctcccgtcggcagtggcgatgctgctggtccggttggaggggcgcggtccgcggtggccgtggacagaggtgtgacccacgcgatttggcgcgagatgctatgaggcgaccagggcaaggaggcagagcgtcacggcgtcgatctggcgagggcacagggctaggcggcggcggcggctactggttgaggactacgtgagggcggcttcgactggggatcggcagcgttctcgatgacgactgcaacggcgacgagccacgacgcttgaggcggtggattcgacggggattgacggaggaagacagcgcggttagggattagggagggagcgcgtgaatacggggagggggaaggacgtgactgcagtttgcgctgggtcctggcggcggagcgaatcggcggcgggaaggcctgtgcgacgacgacttggtggagggcagagtgcgaagggcggcgcgggatgggggtctgactgtgcgagggccgcggttgacgattcgacggagggcggagggccggcgtgcgaaggaaaagggagtgcaaaccgagcggtgatcccgcatgcgcgatttttcgccgggtgaccccatgtgctacgtggctggttgtaatgcgttagatgtaagcgagataatccggaccgttgagcgaggaatgaaaggtgagtgatgagtgatgagttaaatcatttgttgaactatagggtagattagcatcctattaaagcgtgaaaaaagggcaacccatcacactaaagcccatctaactacttacggatcgatacaatcaaagaaaccctaattcccacgctacacatcgatccgccgccaccccaactgcgctctttccgccgctcgccatgctacacatcgatccgccgccaccccaactccgttctttccgccgctcgagtccgtgtactgattccacgcgcggaggtcgcggcaacctttctgattagcgccgccatatcccactccggtcttcctctctgccctagccgcttgcttttccttctctagcgttgtccatgcttttcctcatctagtgctgctcatcccctcgcctgtagaggagaaacaaccatatcttactagtcggcgccgctgctaacccgggggtgcggggacccggaaggtgtgcgggggcgggtcttgttttgcacccgatctgtgcttcgggggcgggaacgggggtgagagtcagggagcgggagcaggggcgggggcccaggttcacaccattctcctgcctcagcctcccaaagtagctgggactacaggcacctacaaccatgcctgg

SEQ ID NO: 5527 - DNA, 8621 bp, Oryza sativa
gggggcgttcttgaccaacccggccctgccccgccccgttgccatccctaatctcgcggctgcatttgtttgtttcagagctactaaaaaagatttcacgcgctacgccgcgtggatacagaagcaggttagcaggctgactatgcttatgtttatggacttatcagccaaaatttaaatttgaagtttttttctttaagaattacacagtacaacacaaacactcacaacacatactcacccttatgaacgcacgcacgtaaaccctacccctatgagcatcctcacacctatgaacgcatacacgtaaaccctacccctatgagcatcttcgaagactgtgctggcaaatccatcttggagattgacaaagtcaccacgggcgcctcgttgtcgactgttacgttgcctaccactgaaagcacaaagccgttaaatcctggaaaattcgcttccacggggagtcgaacccagaatctaaggtgctactaaggctcttataaccactagattttggacttatcagccaaaaattaaatttggagtttggttttgggatttttttttaacgaagtttatttttttcagcctttgtttttaaatcgctaagaacacacatataaaagttttattcataaattattttttatgcaaatataccgtttggcttatttgaggaataagccagatatggtgagaacggacaaggattttctacacctaggtgctatggcacccatcattcgcatgcgacttaaatagttgtagaaaaaaattaaaaaaatagtaagattgtttgtgatgatataagtatatacacaaacatgcaggactaaatttgatctacaactaaagaaacaaaaataataaaattaaacactgaatagtgcccgtatagtgcagataaaatttgttatttttgtgtcttcatatattgattgaatttagacttgtatgtttgtgtagtgtcttatattatcatagtctatcttatcaaattttatgaaatttttatacaactgtttaagttacatgcatacacctaggtgccatggcacctaggtgtaagaaagtggtacctagatgtagaaaatactttccgtggtgagaactaattggagtgaaaagatttgttagtggcacacaactgaaaattgcataaagcaaggatagcctcatccgctggaaccacactggaactactagcgtggagtaaatttgcaaagcaaaattagccactggaaaatatagggacctttaaatataaaactacaagttacgggttctgcagaaaaagaacaatttgtactatcctgcttttttttttagaatatttgtactatcctgctagcatgggttggaatcttggaatcataagaaagctagcgtcatctaattaatcatttcgctggtagtggccggttttaattaaccaagtttggactaaccaagtttgcagagtaatactaagtgttttgtatgttattgcatctatttgtatccacccgtaaactcattcacgatgagtgcaatttactcgatcaagaattaatttgtaatatttaagagtagtgtccatatatagcaggaattctgggaaaatataacgtactgataatttaagaagatatgtgttaatcctatcttactataaagttaatgtcccctaactcctaaagctcaacatgcaaacatgtcacccactagtaataattacatatttaatctcatgcaaacatacaaaatcatttataatttatttaattctacaaatcaacatgcaagtatatctctaatcgttattcctcacatcatttccataatattttaacaaatatatctatcatttataatatttaacatatacatgttccatgttaaatcgtgggtatcatttgtttgttttatgataagtcctgctaaaccctcacgttttattatttttttttctttttaatactagctcgataatcgaaaaaaatattgaaaattaattagtaattcccgcagcaaaacgcgaggatcacctagtattttagaaacgagagtattttatcagctttatgttttgacgttgggaggtatttggatccagggactaaactttagtccatgtcatatcggatgtttggacactaatttgaagtattaaacatcgactacttacaaaactaattacataattgagagctaatttgcgtgataaattttttaaacctaattaatccataattagcacatgttttactgtagcatcacataagctaatcatggattaattaggctcaatagattcgtctcacgaattagtccagagttatggattgtattttagcaatagtctatatttaatacttctaattagtgtctaaacatccgaccagggtttagtcccatccaaaccaattaattccgttttatcccttacctgaactgggatcgttatcgatgacgtggtgtcaacatatacagagtcaagagtagtgatgacatcaggataacaatcaatataaatagatagaagcaaaataaagaaataaaatactacaacctacgtgtcaaccttacttcattttcacatggtgaggactcagtataatgtacatatatacatcaacacagtaacaatataacatatatatatatatatatatatatatatatatatatatatacatgcatgatctccattttggtgtgcatggcagcagcatccgtgagatgcacaagcgaaatagacagaagttgagatggtgagttaagatcaaggttaattgacgtcctgaatttgcgtgggttgagctaatttaccgttttcatgggcagatagtcggctagtgagctggtgggctgaaaattcggattatttgctaaacggttcatcgaatgatatgttcgaaataccgcgaataacttatatccaccgatttttttgcaataccacatctgatccacacctgcaccatacaattcgcatccgagggatttaaacaaacatataccatatcttgctccaaccaaattctgagagtatcggatcagaagctatcacatcagttttcaccgctaatatctagacggaggagtatatataaccactaaataagcacatactatgtatactccttagaattagtgaacactagttttaaacatatatatatatatatatatatatatatatatatatagtactcccttcgtattttaatgtatgatgccgttgactttttaatcaacgtttgaccattcgtcttattcaaaaaatttatgttattatcatttattttatcgtgacttgatttatcatcaaatgttctttaaacatgatataaatatttttatatttacacaaaaaatttggataagacaaatattcaaacgttaattaaaaagtcaacggcgtcatatattaaaatatggagggagcagtactttaacgaccctggtgagtttgggtgtacaacgaccgaacctactatccatccagtcataacccagctgctttcttatgaaagtgctactagctagtagacatagatcttgttatcaccattttgaacagttggatcaggctataatatctcacaccatccgttggagatgtgtgattccgacgatagaaaatgatttattatctgtttttatgttcattcttctccctttatcaattttaatatataatatttttcacatttccgtagaatcaatttcagggtatcattcttccttgtgaacaatcaagtaatagaatggccacgagtattacacagatgcggataggatttcaatatgactttagtgacatcagggatgtgctgttggttttcgtctcttggaacatgtgttagaggacgcattcgcggaggtacgagtgtggtgttgtttgtatagtggtgtgtatgtgtgtaaagctgtcatgtaaattaaaaataataataaagtgcagagctagggagcatgatatgcatttaccaatttttgcatatgacatactctccgtccaaaaaaacgaacataagactggatgtgacatattctagtacaataaatctaaatatacgtatgtacgtattgtagtaatagaatatatgtgtcatatttagtatattaggtttattttttatgggacggagggagtagaggggacaggggaataatgtaacaaggaaattactacagattgcctcagcaacaagaagctggagtacgtagctagctaggtccaagtctggacaagatgcaattcatcaacgtaggattacacgtacacagagcagtgtacagactcaagaaaattaagatagcatgctgatgcacgcacggagcgtgcaacataaagtatacagagatacagagagagatgaccagcgctgaatgatatgccccagctgttatttttactgtagctattattttggctagttgatcaactgcgagccagcatcgatcgatatatcgatcggtcggtctacgcaggattaatcgatctagctgaccctgcaccaatgaaataatcatgcatatatacagtggattagtcagtaaattaagttgaattaacctgaaaaaagtaacatgcatggatgatagtatatatttttacttgctgcagtcagtggagaggctgatggggaagccgacgttgacgccgcacttgccggggatgccggcggcggcgccgaggttgagagacttgatggtgccggcgagggtcttgaggcaccggcaggcggcctggcggtcagcggtggtgcgggcggcgttgttcagccccttgacgccgttgcagcatccctgggtgaggccacccctccccgtcacgtaagagatgcacggcgcgatcgccgaccccacctgcccgcacgttatcgccgccgacgcccccggcgccgccaccaccatcgccatcaccatcacggcggccaccgccttgaagttcaaagccgccatatctatctagactgatggatgatcgatcgagtagctaggtaagcttcgttcagtcagcgtctcctcgtcgccggcgatggatggatcgtcggtcgatgggtggagggtacgtataaataggaaaggcaacaggagatgcggccacgtgctatgatagaatcatccattgatggcagtcgctctgctaagtcgttgggagttggactccatcgagctagtagctagtactagagtcttctcaatctcaatgacgtactacaacaacatgtgttccgttagattaagtttgataatagtgtggctaaatgctagcttaaaaatcctatatctaatctaatagcatcattaaagtgttggaatggtaattaaggtgttgtttttttaaaagaaaataagactgtccatcatcttttcttggagtgtctctatacaaaattctttggagagcattgcaattttcttctggttcatccattccacatagtatatcatattttttaaaaatagctcgtggaggttgataaaaaaactcattcttataagagcatctgttttatgttgagcctatgatacggttgagcaaaaatgatatggtttttaataacactatctagatcatatttacatgtgcttttcagcgtaacatattggctctgatcatgtaatgaagacactaagttaataaaagttgcacattgcaaactggagtcaacgtttatgcaacttttcacaaattttggttggaagttcacaaacaatattcaataagtttgtactttattttttttcaattggtgttagtgccggtgtgtggctatgtcagtttggatgtgtcccttatgtctttatgtattcttttgaggtgtgattgtgtttggaatttttttaaataattagctctatgagcaaagaccgggattctattctattatcttaaaataatagcatcattaatacttgatctattgctcatatgcacgtaatatcttaaaacccgtgttaaagcttactataaatttgtaggaggattttcttctttttttttaatacgtgcttatagtttgcttataaattgttattgtacttgctctcagtgttctatcagtatcggaagatttattaatcatgggcgagtagtaatcactgctactatacttgcttctaactctatagcgcattcattttctaattgaggcaattaattattttttgaacattatttttttttccgctaataattaatatatcgagctttcttttggttcaactgataattgttgagctacaattatatatatttagctaggaaaattaagttgctgggatagtctctcggttttgtaatataaggttttattgacttttaaatattatgtttgattgttttatttaaaaatttagtgtgaatatgaataaataaatccataataaagtaacctttagtgtaaaagtttttttaaaagtaaatgatgataatatataaaggtttttcaggaaacaaatgtctaacaatattttcaaaagttaaccgtaccatatatttaattaaaaatggagattagtagtactcccttctcaaattgatcatcatacaatggaatttaaaatttctcaaattgatcatcatataaccgcatgaacacggatttcattataatataattaatgcagcatatgagaatgtgtgcatgttaaggtgtaattggcatggtgttaaatcaatgtgtgcattgtgagagaatgtgtacatggtgtcttgattgatgctatttaaattatactatttgatcttgctatataaacatatactccctccattccaaaatatacgacataatcacccctaacccaaagatcaagaaataattattatcatcttatagtttggatcatcctaataaatacaatacatgcatccaatagaattagaggacatgagagtggaggatttaaaaaaagtaataatttaatggagaatggtcatagttaattggctatatgcatgcatgccttatattatggaacatctaaaaaaagtggttgcgtcttatacttcctccgttctaaaatataaggcacaactacccttaacccaaagaccaagaaataattattattatttcctagtttgaatcaccctaataaatatgatgcatacatccaataaaattagagatcttgagggtggaggatttaaaaaagtaataatttaatggagaagaggtcctaattaattatatgcatgtatgcatgtcttatattatggagcatctaaaaaaagtagttgtgtcattatggaagggagggagtattatataatggagggagtatgatgattatttttgtaagaagggagtacactgcaacgtgtatggaagcgatcgtgtgtgtgcggttactctgccggttccctcagggtgctgtacctctacagccatcagaaatggactgtcgatctgtcttctcatgcgacgactcatgatcagtcaacacgatgtctgcgtgccaagcaaaatttgccccactgcaatcatgataaatagtttgtgtctaggatttaggattttaccggcgtcgatcgacggttatcctgttacagccaatcaacaatctggccagcaggtcttcagctgatcttcaatcacttcattaaatatcgctaatagtgatagctttaattttttctgttgaaaagtcattgttgtaataatgtagccccgctcgatcgctcctcgcgagatcgtacgttgaacacgtatttggagaagtaacatttgtagttttccaaaaataattataagctgatactatttttttttcaaaaatactatatatatttagggtcatatagcaggtggcatgtattggatttgtattactttcaattaattgatttcgtggttagtgacaatatatttaaaaattttaattattaaagttggaatttcaaatttggaaactgtatcaaaaggctatatacacaccttctatctttttcagcgcggaggaaaaatgtacatagttttcgtagtagcaggacatttcactagtacagaacctttcatctgtgacggcctctaacatgtttggaattagcgaccgtcacaaggaagccatctcaatcgggccgaaaaagcgcccgattgagataactcaggcccgtcacggatgacacatattagtgacatgagttttatgcccatctaacatgtctgtgcgaccatatctcaacaactaggcccgattgagatgacttagtattttttttttcattttacatatgaaatgtttatatttgtaagttgacatagcaaagtaattaaatgcagtataataatttattttatttgtcaaaataatttttcgggtagtaaatgatttcaaatggaaaaattttcaacaacaaagttgtataacttatcgatatttacaatttttattttggtcatttttctatataactttttttaactgtttgaatttgaatttgaaaatataacaacttcaaataatattttcaaatactaaatgatttcaaatggaaaagtcatcaacaataaagttgtataactcatcaagatctataacttttattttggtcatttttctatataactttttttaacggtttgaatttgaatttaaaaatatgattacttcaaaacaac

SEQ ID NO: 5528 - DNA, 3427 bp, Oryza sativa
gattttgatgaattatacaactttgttgttgatgactttttcagttgaaatcatttaatatttgaaaatattgtttgaagttattataatttgaaattcaaattcaaactattcaataaatgttatatagagaaatgaccaaaataaaaattgtaaatcttgataagttatacaattttgttgttgatgacttttctatttgaaatcatttaatatttgaaattattgtttgaagttgtcatattttcaaatttgaattcaaactgttcaaaaaaaatgttatatagaaaaatgaccaaaacaaaagttatagatcttgatgggttatacaactttattgttgacaatttttccatttgaaatcatttactactcgaaaaattatttgaatttcttatattttaaaattcaaattttatatcgtgcaatcaaacccggatggagaaatgaccaaaataaaattggtagatctcaatgagttctacaactttgtttttggtagttttttcatatgagttcatttagtatcataaaattcaattcaaaatttatttttgcctagaagtctgatttgcctcctcatcatgttaatacttgctaaatatatatttgatccaattaactcggtttttctagtgaaacatgtgaaatatgtgaatggatgtgaaatatgtgatcaaaatgaatgttatgtgaatgtggttgtgttaaatatattgatggttgtgtatgtgaataaatgtataacttcttctccggaaaccgatcaccaaagaactttgaggttaagcgctcttagggtggagcaattttgggatgagtgaccgatcgggaagaaaagaccggcccgcggtcaccaaagaactttgaggttaagcgctcttagggtggagcaatttcgggatgagtgaccgatcgggaagaaaagaccggcccgcggtcgtgcctagtaaaggcttgagaatagctaaaaaaagaccaaaatttatttatcttttttggattatactcatccgtgacgggctataatttaggcccgattgagatgagagtcatccgtggcgggctataatttaggcccgattgagatgagaggcatccgtgacgtgctatagtttaggcccgattgagatgatagtcatccgtgacgggctatagtgttggcccgattgagatgtatgtcatccgtgacggccgcatgcccgattgagatattttctcatattagtgacatttgcttagtgacgggggcactacccgatagagatgaggctttaggcccgttacagatgaccgaacctgttccagtgttttaaaggtaaacattaattctcaccattaatatttgttctgatcgatcgataatgacccgccaaatcttctcaaccatgcaacagtgcaacacatatatatagcttcaattaattccaactgtacgcatatctctgctgcatttgtttgtttcagagttatataaattataccatgacctttcaattaattcaagctacgaccaagcaagaataaatatagataaattacacttatgatatacaaaattatatggtggatataaataaatatagcaacttataaatttaaacattcatttatgtacaatataataacatgtttagtccatgcaaacatatgtagattcaaacatatagctcgtagaggactcacatgtttattttgagatagagaaagtacgtgccgcgctagaaatttgtagtattttttgtagaaaaagaaaaattccaatcttgcatctcccattactctgcctttctgacttgtcatagggtagcacaaactaattgcatgaagagcaaaatcgtgatcaccggctggaacagtggaaccacactggaaatttgtattttgtagacaaaaaaaattcaatcttgcctctcccattactgggtcgtccttacttgtcataaaggaagatgcacttatagcagtgcagtggcaagggttagtgcgtggtttcaatcctgaaatctagagttcaatccccaatatgctcataatattttcttaaaataatgtttagaatgatgtctctttctctaaatctcctttcttttgtacttgtcacaatagaagcccagattgattgcatgaagagcaaagttgcggtcactggtggaaaccacactggaactgctaggctgctagctagcatggagccatggagttttacttggcaactaattttccacacctaatcttaaggaagtcataattttaatagatagtgtttggttcctgccacaactctactttatcctcaaccctagttaaaaatgtatgacaacattagtcctcgagcccaaattctccgatcaaaaatagccattgaaaaatacagggaccttaaatacttagataaagttacattgcaactttgcaagttacgggtttttttttctgcaaaataacaattaattagtactatcctgctagcatgggttggaacgtacaagcgtgttatagagagcgtcttgtaagatcatattcacttgagtggtcggtttaaactaagttagtacggactaagcaagttgtcacatcgcagaaagtgtttcgttgcacttatttgtatccaccttaagtttaattttactcaaggaagaattaatgtgttttaattgctggaaaatataacaggcagataaacataagaaggtgtccatcttaaagaaacaagagtacttgatcaactttgtttttttaaaaaagcatatataaatgctaattaaggcactgttaacttgaattaaacatctacagctataggatagtgctatcacacaagcaaagctcggcagctctaagtggtagcattcatcagtgggccaatataattataatttgcagtgggccatggaccatattttatatcggcttcaatcctattaccaatattggacgggccaatcctagcccatcaaaagccaatcctagttttcaaaaggaataagttcacctaccttcccttaactttacatcgattttatgacatcctcaatccccaataccagaaatgtctaccccttaaatatttgaaaccgtgcaaaataggttccatggcagtatatatgggtggtttcgctgacgtggcttcctaattagcaaagagggaataaaaattgtagggcccatatatcatcctcactccaattctcttctctgtatcctctatcagccaggagcagggcaagcggggtggtgtcgggcggagcagccatgcatgaagcaggcaggaggaacgacgatagccggagaagacagcgggcggagcggggtggcggcggtggggtatagaggagacccgggcaacacgccttctaccatggtgagctcgaaacgcaggcagcatagctccttgaaggagcggagcacctccgaggatgatggc

SEQ ID NO: 5529 - DNA, 11833 bp, Oryza sativa
tcttttattccagaatacagatatgatactactagtactggatacagaattcggctccacacatcgacccaggcagaatctactaggtggcaaccggcgcgctgctgtatatatatgatccgtctctgatcgatggctcagctcaccctgcacacacgcacatatatatagattagatgacatgtatatagtactccatcatgcaaagccatgcgtaattatatatatttaacggaattagatgtatatatagagagagagatgatgagatgattaactaattacctggagcagtcgatggaagcgctgatggtgtaggggacgctgacgccgcacttggaggggatgctggcggcgttgccggcgttgagccccttgatgccgcgggccgcgttcttgaggcagttgcaggcggtgcgccggtctgcggtcgtgcttgctgccgccttgaggctcctcacgccgctgcagcaggccgccgacggcccggcgccgccgcgggcgtaggtcaggcagggcccgacggcggagttgacctggccgcaggtgatggccacggcggcgtgcggggcggcgaggagcagagctgccaccagggcgaccaacaccaactgtgcacgggccatgcttcctagctagtactgttgatctagttgctggatcgatcgatcgatcggtgcgaattggttgctgatgatgagatggatgatggatggatgaggagaatacgcgggaatgcaggggcttaaataggtacatttgctagtgtggatgcatgcacagatgcgcagctgcaagagatcgagcaattaacaaagcaaggatgggtttgtggtgtttagacggtgcatgtgtccatacgttcattcaatacgattgggagctagcttagcagctggtggttggctgttgggaaaaccagagcttattcccctccatctacagtcgactgtatttgcgaattgtattgatgtaaatgtgtagaaagagtaaatatatttatattaattttagggaacgagggaacatgtcctcaaggttttccactaggaggaaggttgaggttttccacaggaggatgggtatatgagaaatgcgagtagttgacagttaaccttaaaaagaatagttggcaaatgatcaagacaaaactaagtttaatttgttcacacctgcagaataagaatattgtttggtttactattattccgagggatcactacttaaaaaagagacatatatattagcactataggtgctgtacgtgctaatactggcacctatatataatatttttcccacctcaactggatgaaaacataaaaaaccgacaccttttaaataactataggtgttggttctaaagaaaaatcgacacttatactatgagtgtcggtttttaagaaataaccggcatctgtaatatattataggtgtcggttaattaaaaaccaagacctataatatattataagtgccgttttttttaaccgacacctatctgccgaaccgaccgagccgagctgagccaccctatctacccccatccttatctcttcctcccctctctctctcgaactctatctcccgcacccacagtccacttcctcctctcttcttcttccctctttctctccatttcttccttctcctctctcctcctcctccatccaccatggcggggccctccactccgccagatccgatgggaggggaggcggtggtccggcggcagcacggctgcgtgctcccctatgccagagccgacgggaggagaggcagcggcccgaaagcggcggcaccctcccctccgccagatccagtgggaagggaggcggcaacatggcagggccctcccctccgccagatctagcaggaggggagacggtgacccggtggcggtccggaggggtggcccagcggcgggaggtggcatgcggcagtgggagagagctggctagaggtgcgacggtgttggcggccgtggatccatctcttctcctccctctttgtgatttgttcatgttgatgtgatctagatgtgtattatttgatctagatgcattgtttttctagggatttttttactatagttcatctgttcatggatttgacgcaatttagttcacgtgttcatggatttgacgcaattttgggatttggttattatttgggatcagcttgacggctcgatacatcaaaccgtttttttttttggctcgtgtatgcctcaaagatgtcggttttgacccgagtaatcaatgccgcttccgtggtgctggttggaaaaaccgacacctaaggaggtttctcaactggcaccgattagtgcttctgtagtagtggataagtaagctaggatgtatgggccatgaagccctttcccttgtatatactccccatatccaaataaaacttatcttagtttaaattttgtccaaaaaaaatcaacttctatcatcttaactactctcagcacacaaaacgagaagttttatcccttaaataccttttacctacctatcactactactaccttttccaacaataagaggtattttggtcatttttactcttcactattttcttcttgggattggaattgatatttcgtggtacggagggagtatgatccaaatgaataaatatttatgcatgacatagcttcttttccatatttgagattaatttgacgtgtatttgggccaagggcttcttcgccaggagaaatgaaacaaggccggcctgcggtgcatccgattcaaatgaagcacatgaaactttaggaactatatgtattagtacaccggcctgcctgtatatcgtccatccatcttttcaaacattatattatatcaaaagaacaagagtaaattgaagaagttatcatattcactctaaaggtctagaaaaataagtatcctttttattatgggaaaagtcacatactaactttttcttactaaattcttactaacactgacatatcatgctatgagtgcatctagattttttataactttcatctacttgaatcaaacagttgagacgattgttagtacaaatttagtaagaaaaatttagtacgtgtagcagtactcagcaaataggataatcattctcacactctgcgagcctataaaatgtgtgaggtaagttataactagacatatcttttttttttgcggggtagacatataaagcttggtcagatgattgcaagatatctgttggctatctaattaatacaatactccaacattgtattcgttgaacaacttaattatgtgttctcatagttttacccctttcaatagtctttcaaagtgcggctttgactatattaataattccatccaaaaatataagtattattggacttcgatatggtcttcacgatgctactttgactaacaatatttgtaaaagtaaggctgctttcaacagcatgtgaaagagagaaagtttgtttcgttagcggtgtgtttttttacactactaaatggtgtgtttttacaaaaaaaaatctatatgaaatttgctttgaaaaatcatatcaatccatttttgaagtttaaaatagttaatactcaattaatcatgcgctaatggtacacctcgttttgcgtatcttctcaatcttctcttttcttctcctctgaaactcagcatattttaaataaaaagagttgcatattgtgacagtttgtttaatgataaatctagtaatatcaattttacattattgattttttttgctattaataaccaaagttaaaaatatttgacttgacgctattttaaaaatgcttatatatttcgagatgaagggagtaatttattaatttattattagagtatatatatttcaagacaaattaacacagtactgtttttttacccaagtttgtatatatgtgtaatgccaggaagatggagtaatcggtgtagaacatgtatttgtatacgaaaaagagctatatatctatgtataatccacaacgtacacgcacgtagtacaagtagtactccatgtacatgcagaagtacatatgcatatggtacaaaaactgatctctagctctcaggtacgtatagtcgatcgacgaataaattaaggaaacagatagcgtagtgaccggccgggcgatcaaccatgtatgcatggcgatggatcgacctagctagctagctctcattttattcagcataaacacagataacacaagatacaaagcgtgagacgacagctgcatctcggccggcgctgcatgtcatcctccggtagcgatcgatcggattagttcacgctgcacgtatgtacacgcacaaattaatttatatgtacttaattaattagatgatcatatgcaaaacgatagtataaatttatcatattgatggatgattacctggagcagtcgatggaggggctgatggtgtaggggatgctgacgccgcacttggaggggatgctggcggcattgccggcgttgaggccgctgatgctgccggccacgttcttgaggcagttgcaggcggtgcggcggtcggcggtggtggtggcggcggagttgaggctcctgacgccgctgcagcaggccgccgacgggccggagccgccgcgggcgtagctgaggcagggcgacacggcggagttgacctggccgcagctgatggcggccatggtggtgtgtgggcccgccaggagcagagctgccacgagggcgaccaacaccagctgtgcacgggccatctcgatcttggtcgtgtgtgctgacgatcgatcgactttgctgctgctgctggtgtgtggtgctcgtttgctgctgcaggtgagatcgatcgatgagaattcccgggaatgtagggggctttaaatagctatgatttcatctgtgccgatgcatcgaccaagtcaaatgtagttactacgtggaatatatagtccacctataattagagaacatatcctatacacacaagctttacttatgtacacactatacatatcaattagcaaatgtcataaaaaattttagaaaaaattggacacatacttccaatagttttacacctacatgtgaaatcttatcttcaatttcattatattttagccataaaaaagacaaaatcctgatatttttacccttaaaactgtcgggttttttttcactttttgttacagctaaaattcgggtttttttcactttttgttacagctaaaatatattgaatttgaatatgagactttgcacatatgtataatactattaggagtaaatatctaatttgtttatagaatgtttcgtgacattttttaattggtgtacgcatagtgtaattaagcttggagtgctagtgtttaggcaccgttcttagtcgtcggtgcgtctaatgttattcaattcaattcaattgaatcagggtggttggttgttagggctggtttagctagctagtcacacagtgttagtattagtgatgagaaaatgattagcagcggcctaacggagctagtcgtttgtagcagctagcatgcatgttgtacatttggaacatgcaagtagttgagcgcattcatgatgtttggatccaagtgtccatcatatcagcagtaacatccaacgatccttccagtattcttctttcaaccacaaggacaacttatgcacacgcgtacgcttcacctggttacactatagcccaataatgcgctcggctattgctaagaaatataagaatcttacaagctaaaaagactaattaaaattgctcagctgctacaaaataaactatgaatgccaaccaacaacgacgatatgatgagtattttcaggagttggtacaaacacagtgaaatatctcaatagcacatcacattttagtacacaagagattgatatataattgggataaaagaataaaagtcatattaagaaactaatccaaatatattactatatgataaaattcggataacgtatttaatagtatttattcatgttcaggacgtgtattgtatcaaccatgcatgcatgtatttaagaggttaaaccgaaacttcatgtttcttatcacaagaatgtactagctggcctggcatgtgctccacaatgcaaagctctcagcagatcgatcaattaaatctaagaattttcagttactaaggtggtgtttgaaggtggtgtttggttggagggactaaagtggactaaagggacttatatttttgtgagagggactaaatttagtcctaatttctaaacacctcctaagtttaacgtagtttttaatcaatcagctgtatgctattttgcaatccaattaagctctagataagaccacgtacactatggagtagtagaattttatctttctttttcacaagaccaagctgctagctactccagttagtaggagtatttatttatcgttgacgtaggttatccctcccggccgggacggctgtcggtcgccagcaggtggcttccaaattgaagccgacgatccattatgttcatgtcattctcgtatcgatctacctgccaaccgttactcctcctcctaggtattaatgcatatcatgatgccacgtacagcaacccgtggccaactttctatgtagacgttagacaaattaaagagggctacgatcggttcatcttggcccgtgttagtttcaaaatatttcttcaaatttttaattttttcatcacatcaaaattttcctgcatacacaaacttctaatttttccgccacatcgttccaattttaaccaaacttttaattttggtgtgaactaaacacagccttggtgttttcgtcaggcttgtatgatagagcactattccctttgaaataagggtgtgcttacttcacaccaaaattgaaattttgattgaaattggaacgatgtgatggaaaagttaaaagtttatgtgtgtaggaaagttttgatgtaatggaaaagttgaaagtttgaagaaaaagttgggaactaaactaggcctaatatagagagtttgaaaaaaaagaattggacgtcacacgctcactagcatatgataaataagattagaggcctaactcacataacttcggtgggcacacgttttactgttgaacgtatctgtatatgtatatgtatacgtaggtagagtatatatatattctctcaagagattaaatctaaaagaaacaagcatatgtgcctatactatggcttgaatcaagataaaaaggttctaccacaagagaaagagcgttatcataaagtctggacaactaataatgttttccggtggtcgaccaatttttcgtgacatcgatggctatttgcagtggagatgtcaacgacggagcctgggcagccacccgaacacaaggacctttaccagtttgtagagtttacaacattatcatcgcgcgtttgcaaattggcttatcaaccaaatcaaaaatttgaattttcaaccataattctagagttgattttcaggtttcctctatcttggtttgtttttcgccattgtgttttaaattgccaacatagatatacaagttttatcctgtaaattattttagttgctctgttcttttttttacggctatattagctacatatcaaacgatgagagttgaaattatgatttgaggtgcaccagtaaattgaaataaattcttgggatgtccttacgaatatatgggctagggttttttttccatcccaaacaagtcctttaatctttttattgggtcgaaactcaataaatatatgatagatttattacaaaatgctagctagctagctaggacccaggtcaatgaatagaacacaagtagataagaaaaataaggggagaaataaaaaaaagcgataagttttattttagcggtaaataacgcattgagcctcatagttgcccacctatccctcttccctccctttccctcgtgatgtaaaaaaaaatatactctcacaagcattggttttgtcctagactctcacaactccccttggacccgtcctgtccctctcgttcctaccctcctctttggcactccctaacctcctgacgaaaaaaaaagattactctcaacctttctagagtataaaaatttatcttgtaactccccttccccacacccgctctttttttttgagaggccaccccatcctcttacgatgaaaaaagaagtatcccttgtttatgaacataaaaagaatataaatcttggtgacaaaaatattctttcacattaagaggaaagagtggggcatagttattatgaccggaccggaccggaccggcggtccgaccgggaaaaaccggaaccatggcctcgatcggtctggtccccttaaaagatcgactgttcgattgaactggggaaaacccattgaatcgtgcagtttttatataaaccgagctttgaaccggagtggtcagacctcggccggtccagtccccttaaaagatcagctatgcaattgaaccgggcggtttttatataaaccgggctttgaattggagtggtcagacagggtaacaagctactaggcttttgttgatgggctgaggcgaggcccaatgagcaaactccatcaaaagccttagcccactgagcaaactccatcaaaaattgactttgggtcgcatggctaagaagagtacgcactacccaacccactatctcttcacttttgttggtaccaaatatttacgtcatattgtacattgaactgcggttggactggcctaaccaatggtcgaaccaccatactagtgaaccgagagctctaccagttaattcttcggtccggtcttaataactatggagtagggggtggaggggacaaatgaagagcctgctatatagaactaatgtgtcacataaaggtgagagtagttttttttcatcataattaaggtgagagcaggggagcgggtatacacacttatatgaggactactacttagaataaacatcccattgaactgtgtacagtagttatttgttttgttcttttcttcttcttttttttcccattttaccccttattttctgattaactaattaaattttgtatggcatgggcctggcaaaaggaggtaaaaggatatagagcattctccctttggattgtttggtgggctaggatccaagaaatgaattgatgggccatatatgaagaaagagagcaggctagtctgcattacgttttttttttctttcagttttgaggcatggtgtgctgccggcccataaaaaacgtttgtacggaagtacgttcatcactacgtggtcgcatggagcctcgtcactgatccgtcattaattatattccagaattccatttggcatttcttcaaattaataacagctcatatcattccatccatatactattacttattgaagtaaaaaaacggggcacagcaagttcaagtgtgtgtacgcttgtatcagtacaacattattattattagattattatatatatgaaaaatatataagtagtgtacatagtacactacatgtaaacattgaaacgcattattacattatatagtgcacgtacgcatgcagcaagaaaataaacaaagctagcagtgaacagtcactctctagatcttcccatacatatcgatctcagctggagatgatcaagctagtaattagttgatcctgcataaaaaaggaaagaggaaattagcttaattaggccaacacatggatggagcaaatgcagatagagagagagaaaatgtagaatacttggagcagtcgacggaggtgctgatggggaaggcgacggagacgccacatttgctggggatggaggcggcgttgcccatgttgaggttcctgaaggaggaggccatgttcttgaggcagctgcaggcggtgcggcggtcggcggaggaggaggccttgccgttgagggtcctcaccccgctgcagcacgacgacgacggcgagctctccctccccatcacgtacgacaggcacggcgcgatcgacgacgtcacgtcgccgcagctcaccgccgccgacgccctctccgccaccaccgccgccgccaccaccgccaccaacgcaaccagcgccatcgtcctgcgagcacccgccattgtctcgatcgagatctagctctagctaactagcaacaatgtacactggtagtgagctgtaagctagagcttgtggtggagtactggagtgagcaaagctgtcgaggaggggtggtataaatagctagcgatagatggaggtggagaagaaagaaattaaggccgggttaattaggttagcttagctggttagcgataggaaacttccagatcggccggccggccggagatgggagatgatctactgtgtttagctaatagtatagagcgtgcatgcatatgcatatgtaccagccggtggttgcgtattgggaccctcgggatctgtcgatacgtgcgtgaatgcacgcatgtgatccatccatctttgtttgcatgctcaggaacaaccttcttaattgccaccattgttatcttgcgtcttttcactccgcgaatggacttcaccatttttttttgacaaattgatctttttgaaaaacttatttcgaaactagccactgccaaaaacttcaactatttccgtcggctcagcgctgaggttgtaaatagcagcgccactggacctgacgctgacctcgtgccagcgtggcagctgagccgacccccctgccgacgtggcaagaacctcagcgccaatcgcttcggtgctgtgttgcccaaccttagcgccaaccgcttcggcgctgagatgcccacccttagtgccaacgatcccgcaaagattctctacaagcatcgaactccataattaagaaagtccagttccctccgataaccatatgtagaaatcaagttcaattcttggataattcatctagtcggtcttatttgcacgtttgtcactaaaaatttgcatattactatgtcttgcatgtaggattgacatacagaaggaaaaacaagaagaccaccgatttgactgcttatcatcagacacacatcgatcgatggaaccagttcgaagccaaccgcatgccggataaagcaatgcacaacaggcaagagtttgacgcgtacttagcctggctcacgaggaactaccgcctcgccctacgtctgtcttggacgctagccaacatagcggacgacccaactggggtggaggagcagaacaagtacgatacaagtacccgtagaggtagcacggtcggggcgggtccagtttgagatagagtggtgagtatgggttctagttactcgttttcccatttccgtacttcgtgcttataacttctcctacaggcacgggagctgatcaggacagtcaacgatgcgggcgtggcacttggcatgccccccggctcgcaacaagagagcagcgttcttcgaaatgcattacaggtagatttgtaaaatttgtgcaccgtacacataattggaactaactccttccttctgttggtactagactctacgacagtgatgcagaagttggcggcacgtgtaggatgcagggccgatgatgccgtcgaaccaccttgacgggctgagcgggggagaagtcgaggagtggctcaagagggtgaacaagagggagaggaggaggaagaggaggagcaagtggagttcggtccctcccagctgcaggacgctccacaatcgttgcaggggccatctcgaccacagcgcaagagagcttatgtttccgactgaaggtacactcctgatcagcctcgcgctccaaggggta

SEQ ID NO: 5530 - DNA, 1422 bp, Oryza sativa
cacaaatgcagaacccagagatacagaggaccagctgtagagttatttcatacaagggacttgagcatctgcaaacttcagtaacctcagtggacacctggaaccaattcttcatacatactgagggacaactatacatgcaaaatcctttaaagtgtttcaaagatattcttcatgagcacagaacaagccttaaatttgccttttttttgagacggagtcttgctctgttgcccaggctgcagtgcagttgtgcaatcttggctcactgcaagttccgccttccaggttcacaccattctcctgcctcagcctcccaagtagctgggactacaggcacctacaaccatgcctggctaattttttgtacttttagtagagacggggtttcacgatgttagccaggatggtctagatctcctgaccttgtgatccacctgcctcagcctcccaaagtgctgggattacaggtatgagccaccgcgcttggcctaaatttgactttttaaaaaaactttactgtgtaatgcaatttagcatacttatagagactttattggacaacaggtaagtaaaattatccttattttacatatgagaaaactgaatatgccagctactatttttgcattgaacacccagaaatgtggtgatgtaaagcaaccattttattaagttcacagattgttagtattggaattttggatagggtatagaaagaaaatcttgtctgtgctccacattttctagagcctcatttgggaagactcaaaggcaaggaatgactcagagggaagaatcatctggaggcatgttcatcagcatggctagagggtgatgttggctgtcagctaggacctgagcaggtctgtaggctggattgcctccatgtgccccctctgtgtgacctggcttcctccacagcagggcagcctcaggagagtggggcttctcacatgcagtccagagtttcagggatccacgtagaagttgcatcattttttgtgatctatccttgaaagttgcacagcatcattttattaccaaaatgccagaggtttggtctaagtcctgctgttcactccacagaaagccaatcactgagacaacaagtattgccagggaagaaggctttaatcaggtgctgctgttgaggatatgggagatcagtctcaaattcacttccctaactgactaccattaggggtttctaaagcagggaagaaatgtaaccatgtgcggggaaacaggaattagggagaggtagggaagaggagttcaccaacagaaagctggtgcttatttaagcagtcatgatgggtgaggactctggcatcccattgtctagatgccatgatctggtaagtttcacttccttgatactatctgggaagcctggggatcctctagagtcgactgcag

SEQ ID NO: 5531 - DNA, 4425 bp, Oryza sativa
gtacagtagctcatcacaactatagaccatgtacgaggcacccaataaaaggaaaacgtacctgtatgcaatcttgcattagcatcaaagcatatgttccgatatcaatactactttgccaagtatatgttactgtctggtgtgtgtccaccatgtctagtatcagcaagcaagtcatccacatcgttgctcatacttgttgttcacggacctgtttaagctacactatgtgcggatggagctaatatcaaactgttaattatggcaataatagccatcaaacgcgtacatggtctattctttgatgtgccaaaacatgccttttcaacctttgtttatacctaattactagaattactgtcgtgcacagatgcacttggtagatcacgaattttcaagacaaaggtgaacaataaaaatagaaaagaagtcaaacaaaaaaaaatcagaaaacaagcagtttattgctttatttcaatccaattcttaactggaacccttagccactgtgaggtgtacatctgacaaatcaatactgaaaactgcatagaaaattgaggtttatttatttaatatcgttcatgtaatatgtgatacgtttactaccttggcatcatgttctttaggagccaaacacatgttccaatggtgcataacatgctcactgctacttggtctatgaaggagtgctctttatggctcaaccctaggaattggcatggctttagataggcaatatgggattctctgattttgttgtgacttatgtacaatacttgaaaaagaattattgcttgcgcctttagtcctctgcgagcactggtctctctctctctctctctctctctgtgtgtgtgtgtgtgtgtgtgtgtgtgtgtgtgtgttgaatcatccgacatcgtgctattaaaaactacaactttaacctttttctttctgtaaagcacaggtctttccatttggatctgttccgttgaaaacttatcttcctgatggagatattgatttgactgcctttggccattcaagtgatgaaattttagcaaaacaagtacaggctgttttagaatcagaagaggcaaggaaagacgctgaatttgaagtcaaggatgtccaatatattcatgcagaggtttttctcttgatgctctttgttttttagtttatatattagttagtgtctaattcatatgcgtttatgtttctggtagtggtgtctacttatgtgtgcttatctattgtgtttattatataagatcacatgaaaccatccatgtgattcattaatacatgaattcttttcttttttcttttactccccttcttatagttgcaatcaaacatttcgcagtattcttatcctactataaaacgggaaacaacaatagagaaatccatcgtattcacatgacatcaatgaagcctgtgcatatctcaatatttcactgctagcaataaaaataaatagtcaatagtgatcaagtaaactttccaccactgtgctctattgtcatttaacaactaatgcatgcttcaacatagatttacatgttctcgcacattgttaatgtttctgatggcatcatgtttgtctaaaataagtctttctgatggcaggtcaagttggtgaaatgcattgttcaaaacatcattgtagacatctcattcaatcagtttggtggactgtgtaccctttgttttctcgagaaggtaatgtttgaaaagttgcaacaaatatgcagttgccagttctcttccttaaactgcagatctatctcggtctgatttatcacaagctaggtccgttgtacttccttgtggttcaacagttggtagatgatttctttaaggtcagactgctcaggggaaaatatatctataaccattacattttgcaggttgatcaaaaatttgaaaaaaaccaccttttcaagagaagtataatgctgataaaagcttggtgttattatgaaagccgcattcttggtgctcaccatggattaatttctacctatgcattggagatattggtgttatatattttccatctcttccatggaacattggatggtccactagctgtaagttctgacttccaactattctgcagcatttgtaaagttcttgtttctgacaccctacatacgttgccataaattactctatgttttctgcaggttctctataggtttctggactactatagcaaatttgactgggacaataagggtataagcttgtatggccctatttccttgtcttccctgcctgagctagttagtaagtggatgtggtctgatatgttacctcttttttttgtgattggaagttttcttttttcattggtcatgcaaactttattttttttcacagctgactctccagacacggttaatgatgattttactatgcgagaggactttctcaaggaatgtgcacagtggtttactgtactccctagaaactctgagaaaaatactcaggtctttccccgaaaatttttcaacatagtggacccattgaagcagagtaacaatctagggcgcagtgtcagcaaaggtttgtttcttacatctagatcatgcgttttgatggtaggattggatgattagtcttggaaatatcacaactatagtcaattttggaaaaattgatgtgtcaacttgtttgttgtaacttcacagttgttttcaaattcatcttcatcccatgattggtcactcagggaaaaatgcttgtttacttgtcaaattttagtacttatgctccagatagcttagtttttgggcatttactgtgcgtgcaaaagggataaattgtcgctgcgccccctagttcacaagctatttatccatgggccaagagattttagaacaattaagcacaaaagaaactctacgccacttaactaagcagtaacacttagtacattggatatttgcatgccagtgtatgcaacgtgcccctggaccaccttactttaataccatacatgccgcttactgacatgctgtaagttagtgattcaattgttgtttgttatatgggtatttgctcacatgcataacttccttttgctatactgcacaattgcttatgtgcattaagctgttgcagtgctatttgtttacctggcctgatcccgttgtgcaaagcacaggtaacttcctccggatacgcagtgcatttgattttggtgcccggaagcttgggaagattcttcaagtgcctgacaattttactgtggatgaagtgaatcaattcttcaggaacacattgaagagacactgcagtagggtaaggcctgatgtgcaagaaatagctctggacttcaatggtgaaagagccgacaacgatagttcgcctttatacagtaataattcctttggtgatctatctgatgagttcaataacatcagcatttcagattccagcaaccatgggtcgctaaggcaaaatggatggaattatgtggctgagaacaaggaaaggaagtctgtttctggtggctggctggcaagcaaagcaacaaatcctgcagctactaattcaactggtatgacgaatggcagtgactcttgtgagcctgcatcaccatcaattaccggagcacatagcttgccatctgaggaaggtcatgacgcactggatctctttaatgagtcagaaagtggtacgaaggctggcataaagtatgacacaaacccatcacaccatggaatgtcaacagtgagttacgcaggcagatcccaccagtcctttgaagaggtggataatgatgatagaggtaccattgatagcaattggtcagatctcaccggagactacacaacaaattttaataatcttctctatgctcaagggttccaccaagattatccaatgaaccaatattatccatttggtccagtgtactatcaaatgccttccccaccacctgcacgatatcagaataggcgatcatcaaatggtcatagcagaaataatgtgtatggatatgctggtacaaatggaataggccctgctccttgtccaccaggttatttaattatgaggacatatagtcaaatagatgattcacatcgagctcgtggaactggcacatacttccctaacccagtatgttcctcctttcacgatcttatgttcatactattaagcgtattatgcacatagaattccctgagctttgtgaaccatttaagagtctaggtttggcacaagtggtagataatccaccttctatataactcaaattgctaaggaagatgcacatttgtgaatagtattgtccttattcttttaacaagtacaactttaaacttcattttgtgtgaacttttggcactttttttcacatactatgcatatcaatgcatgaatcaataatttactattccctctgtccgaaatatagcaactttt

SEQ ID NO: 5532 - DNA, 14078 bp, Oryza sativa
atattttgtgacagaggtactttttagtagaatttttcattgttggatttggccatatcatctatagaattggtatagagcatacccccattagttttatgtttcttgctgcagagcttttttcattttgcagggttagccattatatttgtgtcattttgaggtgctatcttgtgttttgctgactttgttcaccttgttcgatttgtagaacttgtccaaagacaggtcaccttctggacgaggcggaaggggaaaaactcatttcctgtcacataaccatcaaagaccacaccactacggtagagctgatatgtcagcagatttgactccttcggaggaattgagacatatttatgatcctgatgcaaatgacttgggaatcccctcttcactgcacatatcaataccttctccatcttcggaatctccaagggaaattgtgcatggcaatggttttattcagcctccagctaagaaacttgagtttgggaccttgggagcattgcctttggaagttacatcccaagagcttggtattaacagattgaatactgcttctgacagccaaccttctgcatctgcaagccctatgtctctggcacataatcctggaattagttctaatcaaatgaggtaagtatgtttcgtttttttagctgtcagtcagcaacgtgtcaacgccaagtgtttatcagagtcatgccataactaataatttcctaaagagaaattgcggtccacatgcattttccaaaaaaatatggtatggcaatcatcagtattttcaatctaaacatgaaaagcatatttaccgaaaatgaaaatgctgttttcccctcttttccttcatattacctcattcaccttgtaacttaacctattcagttctaatgaatttttaagaaattatgttgcataattcctcattaaacaatttacaggaatgctcagccatatcatctcaaggacaacggtgatttcccaccgctatctagttgatgccatatagttcattgcatatcagaggcaacttggtccaagaaaagatactgataaatggtgcgagcacttggtgcaacaatagcaggggttattccacaagacaaacatcatccatcatgtacatcctatcattaacttcacattctcctatcttcaattcacccttgctgttgctttccaaaaaagaaagaaaaaaaaacagaaggctgatgcatcgcagcttgctctgccataacattccctgcaaaggaaatatggaggaaagatagaagcacaatgtagatacttatgttctctttacctttgtccccttgaagagggaacaagtgtggtaaagtcaaaaaatgctagaaagagggtgagctgtgtcttgctctgttgttttgacctcatgagcattccagttactggagggctcattgagtgtgctctgttttggtttggagaggccttctgttgaaaggccccattgtttgaagtaacatttgctgcctcaagcaatgggtagttataggggatagatatgtacgaaactttcactagatttactgtcttcatagaagcagtttagttagtctatactagctcagagtaaaaatgatccttttactttgcctgttgtgcttcacatgtctttttttttgtaactaatttgacttgtaacatagttttgctctgctgttgttagctcggctccaggttaagagaaagtggtatgattttgagtaacacaagcatgatttctatttacgttttgattagcatagttttgctcttctgttaaatcggggtagtcatttagcaagtttttcatagctccatgtcagtaagatcctaatgtagtgttgagatggccaagtcttgagatgttcagtcgccacgtaagcaaaccaaggtggttttggtttgaatggggtataaaatggacatcttgagaagtttgaggtcgtgaaatgtacgcttttgtagtttaaggtcgatttctaatctttttcaagagcttaggtagtaaagcagactaaagttgaagtcatgtcgctttcaagatgggaaacttcaaactctcgatggaactacaattagacgaatcatgaaccccatcttgataaaagataagactgtcaaagcagagcagtactcaaggacatgtttggagtttttcattggatgattagccgaaaaaattaattaccgctagtcactgactctatttctgttatatgatttcacactagatgccactctacgtcgtagcaatcttacaattatttctataaaatatttctgatggtagcattaaactacatgaattattgtattgatacccaattatgtcacttcttatattttgctttggtggctgggaaataaatagatttggcagatcaattattgtagtcaacttcagaaagctgaagaagtcaaagctcagctcgctaatgtgtatggtccttcgttcttactttagggtattaatttaggttgacaaatgctcctactagagtttaagggtaggttacttaccctttgtctaactctgaggggctgaagaaaaatgagcctaagatgtatattttgtctctggactaattgacggtataaataattctcgtttcggagtacaattctcggtaaaatcaagaaattgtggcacacgtgtttgttttccagctcttacattagctttttataagtacgaggacaaaagtaaaaaaaaatcaggttcatttccacgagaaatacttgtgatattatgaaatttatgtactgcccttttgtttaaaaaaagttagtctcatgaacaattgaacgtaagttcacaaaatccatagaagaatgaaccattcacaaaatccatagaagaatgaaccagtcaattcttatcctggcgactgatgatgtatcattctctaggagtccttttccttttctctgaaaaacgcaccaaaattgcatttaaaaaatgtataattgaatcgttgactttgtgctaaatctgtcgcagcattctgctagtggataataccttttgatctttagatcggatctttctgaattattgagagacaagctgattgtcatcggccatcattgggacccagatccattttgcctgttctcattctaaaccactcgtatgctgagtttttgtccaagtgtcatgagagctgggatagaatttttctaaagttgaaatggcatagctcctgcccgcttcctaaaaagaaagagagaatttttctaaagttccaaatggttgcagcaagataacttgtcagtttttgttagcatgagtgttttgacatgcataatagactcctttctcccaaatcatgcgctttcctatgtgtataaaggttaacatagtttgaaggttcgtattgttcctttttaagagaaacaaatatgagtatatataagcttagtctcttttcttttctttctttttgttttgttgttcctttagttgtggactacttgagtctatgtattcctgtaatccattatctaaaaagaaaaaacctaacaagtactccttaagtagtctgaagatgcttacttgttaatactactatttaattagttaatcaggtgtcaatcttaggagaagcgtgtgttccggttgaagccggtggtggtgttactagcaccctggcctacaagggaggttggacatgacaaggactccaggaaggagaacctgaaacccaaaatgaagatagaaaaaggaaaagagaaatgatcgtttgtctgagttcaagatacaatattcagtctagtcaaggaaaggaatactaccatttataacaatttattaggcatgctctaaaatttgtgaatactcaaaggagttttttttttcaaaataagagtatataagatacccctgacattgcttaagctaagataaaacgtgaaaacaatatgtcagattttttacgaaaaaaataagcaaagtcaaatacggatcatgtgaacatattctgaaaattcagttgtggttggtcttgtgctgttccaacgtaaccaacctttcctcctcttccctctgcacatctgaattgtcaagcaaccacaactctttccatcctctccaatcttaagcaggataacacaacgaattcttccttcccattcccattcacaatccttccttattcaacaatttgtctgatacttgcatgcccacaggcagctcaaaaagctagctacttgtttctgacttgtatcatttctacatagatagctcaaagcctctcaaaatcctgcatttcttgctcaaatggatttttcaaggcatagattcttcaaattcagatcagcagctgtctccttcctctccatgtaactaatttcaagctctcaagatcagcaagttcagcaatcaccagactagctaggctcactccttccacatatagtcacagctgctctcatcaatcaatctatctttccagcttccaggtgacaatcgagacctgaatttctgaacttttttttccctctcgtcacttcgtcagtagaaatccaaggtttatattcctctgtactactacacaacagagtgagcgtagtacgtgtctcatcagcatcaaaaagtgacatactgcaagcacgccacaattgaggccgattgatagaatcgaattccactcaaatttgcacggtggaagagaatcccctgcgtgcttgatttgatcaggatttatattggaggcatccaattccatcactcaaccggagctgtctgtctgtagctatcgccctatttctgctagctcgtggcgtgctagtttaatttcttccaaaattctccggcctcacctcgcgtcgtgtcgtgtcgcgtcgcttgcgttaggaggtgcctaagtactggcttgtcggcgtcagatgagtgcagggccgtgctgctcagaggcgcccatggcgtggatcgactgctccctcctcgcctggctcctcttccgcgtcgtcttcttctcctgccacgccaagcagttcagcatcttctaacactcgatctcagctaggctgaaaccacatatactccagcatatatacacagcaactgattaagtaagctgttgctcgccgacggtggccgagcatgtccggtgcacggcggtgcggtgaccggaggtcggagagaagttcggtggtgggcgacaacaggaatggatacgtcgagactgacccaactggtcgctatggccgggtaatttatttacttcttcttcttgcaatctgaacttgctcactttcttattccaaagagaaatttgacttgtttcctttcaaagttcaatattatcatgattgccaaatgatcagcaagcaattccgagctattcagggtcaattcagttcattgcttttttttttcgttcaaaagaaaagaaaaatcagttggttgcttttgattctacttgaacatggattgtgcctatcatgcacgagtttagttgttcagttctatcatgttctttagatgtgggctggtaattagtaattacatttcaatacacgttgtaagcatcagttaaaacatgttggcttcattctctttcagaaaagcatgtaggctttatgttctttagcataattttctagagtagattccatgttgatgtacacatcggagctaacacctctaaactatgcaagacacaattattgtgtcttcagtactttcatcggatccatttggcttttgctgctatctatgggctgcataggacaattgaatactccatccggttttattttaattgacgtttcggacaacgacacggtctacaaaatatatctttaaccttatttttctattataatatacaaaataaataaatgcatgtttactttattatagtgctttgaaagacaaatctatatatgttgttctagtttttttaaactaaatatttttaaagtgattgatggtcaaagttataaaagtttgacctcagccttatccaaaacgtcaattattatagaaccggagggagtattgcacattgaaacatatcaggtttgaggcttcgttattaatcctaagccattgctgtactgaaagatgacatcgtttttttctatatttggtcaaataacggaagtgcatcataaatttgagatgatgagcgagaattcaattatgatttctcttccaatccaatcagggaaggtataaggtgttccttatcaaacaagctagagttgttgtttggttggcatttgaagtttcctaatatgttggatttgatctgaatagataagcatgttccatgtgtcaatatgccaataatcagatgttgaaaaagtttcaagagtggagtatatgccctatctggtcatgctcatgcccaacgatttgatacgatcctctcacctttttcttagtgggttgaagacgtattggcaactttattagttcatctttttttcagtagtttctctagggttagaggtgtacttaccggcaacttatttgtagttatgcgagctttgcaaaagtgtcttacttttataaatttgacaactatccactactttgagttaactttttatatgtatagtaattttaacttttgatcagaagtactggttctttagtgctaaattagggagagtagttaattgaggtgctaaattggttctcgtaactcaaaagtgttgattttatttgactagagattttctaggcattactgtagcaaaacccgtttggaatctgcatttttcacttcagaacattatgaaaagaaaacttatataagattttgaaatcccatgtaaaattaaattttaaaagatgactataaatgcgcactacaataaataaataaataaataaaatttatcgcattctcttgaagaaaagcaattcattaattgcactttctagtgtagtagtacagtacacaagaatattgttttctgaccatgtgctcatgatctataagtatatattttctctacatatgcaagcatgtttgtttcaaaaactttttaaagtgcacgaagtataaaatatttagaatttagtgaaaggaagcatttcgaatcaaaattaaacttgtcaattcagaataaagtagtctggcttgcttgacaatatatagataaattatttcgctacgtgttagcatgcatatttctgacatttcagaaatatcagaattttcggatcaatatttcgctttgcactttctgctactatttcagaaacttgaggaatttcgcccccgcccccccccccaatttgaaattaatttggctgaaaagaaaaacatttattaattaagcaaattttaattaaaaactttaacgaaaatatgttgaaatttcaaccttttcggccttcgatttcctaaaatttccgaaatttcggttctatcgaaatttgttcaaattttgtactgtatacaatatgtgtgcagttgtcggaggtgctggggaagggtgcgatgaagacggtgtaccgagggttcgacgagctgcggggggtggaggtggcgtggaaccaggccaccatctccgacgtcctccgcaccccggacgccctccaccgcatgtacgcggaggtgagcctcctcgccgacctccgccacgacgccatcatcgccttccacgcctcctgggtccacccctcccgccgcaccttcaacttcatcaccgagctcttctcctccggcaccctccgctcctaccgcctccgctacccgcgcgtcagccgccgcgccgtcgccgcctgggcgcgcgccatcctccgcggcctcgcctacctccactcccgcggcgtcatccaccgcgacctcaagtgcgacaacatcttcgtcaacggccacctcggccaggtcaagatcggcgacctcggcctcgccgccgttctccgcggtgcacctccgcccgcagcgtcatcggcacgccggagttcatggcccccgagatgtacgacgagtgctacggcgtcggcgtcgacgtctactccttcggcatgtgcatgctcgagatgctcaccaacgagtacccctacagcgagtgcgacaacccagcgcagatctacaagaaggtcaccgccggcaagctccccgacgccttctacctcctcaccgacgccgacgcccgccgcttcatcggccggtgccttgtcgacgccgcccaccgcccctctgccgaggagctcctgctcgaccccttcctctccccgcctcagaaccacgacgatcacaataccattgctcatgccactgcgccgccaccgccattgccattggcgtgcagtaattccagtgaggagcaagaggaggaggaggcgccggcagcaaagacgacgggcatggcgatcaccgggaagctgaacaaggagcacgacaccatcttcctcaaggtgcagatcggcggcggcggcaacgtgcggaacatctacttcccgttcgacgtggcgaacgacacggcgatggaggtggcgacggagatggtgaaggagctggacatcgccgaccgggagcccacggagatcgccgccatgatcgagcaggagatcgtgaggttggtaccagggtacaagcagcacgagtattcgtacgcggatgacgacgacgatgatgacgtcaacggacaacctaatcccttctactacctctcctcttcgccgacctcctctcagggatctctctgcggagtggggcccacatcgtcagaggggtttcctggcccacatggaaaagttgactggtcaagaggtataacaaagtgttttcatcttactttccaatatatcaaaaataacgtgctattctaatctaaatatggttctagctatagaagataaaaagttgggttttctacaaatcacttgagaaggtagaagaaacttgcataaacatttttacatgcagtttggaaatgataaacatttgttcagaaaaaaaaaagaaatggtaaacatgacgtagtagcatgcatgcagatgataatattgtggcaccaacttccaaatgcatgtatacaaacatgtagcttttgttcatttgcccaactgcttttgttcctagctaggcaagaaattaaatttcctagtcaccatatatatgaacagagaaattggaagtcagacgtgcaaactactagaggtagttagctagcaaggtggttgatatatctttgtccatttgtcgttgctattcgtgccaatcctgtgacaccaatacatgcgtcagcgttatatcgatcgttttgttcctagtactagctagtggcagcttacagacagccatgcattaggttcgtgctgcttaattgtggctatatatcactgtcacaattgatctctgcagagacattttagacggataaaaattgcgttcagttagtcgtgttacaatcatcatcccggcggccagcagcataaatgtcaaatggaatattagtcatgtaacatacacatcaatcatatatcctaggcactatacatacacatggtacatatatagctcgccatttcactgtcatcgaccgcatctttattcatatccattcatttcatgcgcacgttattaactgcactaaccagctagtggtagtacttgtagtagatgatgttttgaattgactaatccgtttgatttgatgcatggtgtagattactgttactaccctccaagcagcgtcagcgtgagcgacgacgatgacagcagcacgagctcactctctgctgcagtcagcgcaatcagcctgcagcagcagcattgttcggcctcttccagcagattggggccagcatctgcatcagcatctgaagacggaggaggacacgccggacggccacggcagcgagagggggaggaggagcggcggcggaggaggatgagtcggaacaggtcgatggtggacatgcggagccagctgctgcacaggacgctggtggaggagctcaacaagcgcctcttcttcaacaccgtcggcgccgtccacgacatcggcttccgcgaccctactacttacggatcgtcgtcgtcgtcttcttcgtcacagcatcgccggagaagcagcagcaaggtcgaccacaagcaccactacatgttctgaataaactttttcagagcaaattagtactctaatttggtatgtacagaatgatcgatcagatgcagagtacgtaagtgtgcagctagctatctagcccgcggccacaaaattgtgtatatttggagagaagtgcatatatgagtgttgttcatgacaattttgccatgcgacatgtgaatgaatatatgagtgatatttgtacatatggtatgagtgatatttttcccaaaataggtaccccagcatatgcatgcgctgctgaccagagttttaactgctgaacagttcccctcaattgcactccttttgtttttaagtttcgattttgctattaaaattggctctcttttttgtttaaagtgttttaaggttaggtgagtttgctggtcgttctccgaaatcttttccaatccaagtattttccccgaaattgattgtggaaatcacgaggtgcctataaatcaagcgcccaatttttttttcaaaagtcgggcgctgtttcaccgagtagatcgaacatgtttcactaaatagatcgaaaatgtttcggtcttttaaaaagttgaaacacaaccaaataacctcatgaaacattttgctacaacgtatgaaacaacggttttcaaaaaaatcagagttgtttcaccctatttaaaaataatgtttcagcaaatagcaaaagaatgattcaattcttagaaaagtgaaacacggtcagatcgctagatgaaacaatttggttcaacgtatgtaacaaacgatttgattcccgtgtacatcaacaaaccacgtgtccatcaagatagaaaatattaaacaatataaaacccactacaatatttcatctatgcatagtgaaacatcatgagtacacttgctgaaacattgttggtggaatgaaaaatgaaacgaattctcttaataagacgtttccgtaatatatggtgatttgttgcaacggcgcgtgtggtggggatgacgcggaggcgcagtagagcgcgggtgcccgatgtatgcgtgccagcatcgggcgtccgatttgaggcatttaagtggaaatcaaccaaaattttctacccaaataatcatgggctctggacacactgatagccctcccttccggggccacgtccatcgatctctgggctgcagtattgggccttggcccatcaccgcgcgtgtgcaattactgcaacgcgtaaacacaccctgcaacttgctgtatctgtatgcgtgtcgccagcttcagagggcggcacggtgttctcaaaaaaaaaaagagggcggcacggcaaagatccacagtcaacggtcaaatgttccccatcccatttgcatctctctcttgatccaatgcattgtaccaccaacatcttctccaagcacagatcctaaaatgcctaattgtttcctcttttttttatgaaatagaaatcaagtatttgcctcatcttctcaaggtgttcaatgtgtctcagatatcgcgcgttgtcaaggaccaaattaagctacatatcttgctaacctctttacatttgtatctagctgatcatctcctaattaaaaggtagtaaatttgatctgtaattctaacatcaatgtgtatctagctgatcatctcctaattaaaagatagtaaatttgatctgtaattctaacatcaatgtgcatcacagcagtcagaaataattcagaaaactgcaggggaaaccaaagaataacgttccattaattgttgcgaactaactagcaaatcgatctcatgtgtatatatgtacatagtttctgtatatcgaacaaatcaacaaaaagaatgaaacaagaaaaacaagtagcgtgtgtcatacactcatacatacacaactaagatagaaagcctacagaggagggagaggaagagggcaaatacgagtagctagctaagctagtttgtgcgcttgctggggctggatggctgtggcctccctctgggcttcatgcttctcaaccaagacagctgctgctgcatcacttgttcttcagtcgtcgtcgtcgtatctgctgatgctgtctccgattcgtgcttcagctgtggctgcatcggcgtcggcgacggaagaggcagaggcctgctgcaactgccgtggtgtgcgaagaagacgagcaggaggagcagcacaagcagcagcaacgacgacgacgagctgcagggcttcttgttgcttgacaatagcaatgtggccattgttgtgatctccttgtgttggaagctaatatggatggatttgcagaggaattgaagcacaggtagctatccgggatataaatacaagagataggtagccgcagagcgaagaaaagggggcgtttcaattaaagtcaatggagaggagacgatcgatggaattattaactcaagctaagacgtgtttcctcttccaaaagattagctctcaagacgtgtggaatggaaatatggaatcaattaagccagttttgcaagctggaaggaagaagcagaagaagatgtagataaagaagacttggtgtgaggggaggcgtgcggatcaagttgaagctagctagcaacgatcgatggagggacgacgcgttttgagtagcaagctccacctggcgagaccgtgtagccgtctacacattgatgccactagtatactgtacattcttcttcactcataggctgacaggccacgtaccgactttctatcagcacacctctagcttgtaagcacgcatctatcagtaattccatttaatttgtaacgaaaatgtttagctatcgtgcaaaacgctaggccccataggcccatacgatcgaggccatgtcttaccgataatgggagtattagagttgtaagcgatagaccacaacaacaggattgtaaaaggtctcagataaaagcccaatgtttcactggaccagtagtgactatgtctttgggtgtgataatcctattgagagcgttgtcgaggtacacgttctctttctgtgaggatttttgggtgaacaccatattcagtgtatttggacgggcgacaacaacgtcttttttatcgcaaacttcgtggagacatcgtttttttagtcttctttttgtggtgttgttgttggcctagtggtgaccaacctcgtatatcagtggttggtttgggctcggtttctctcttagcagcttatgtttgtatggttgatatgtgatgcagggtatgcatgtactttgatgcacattcttcttgacaaccggttggcgaaaaagaaagaattatattcgcaatcatatatatatatatatatatatatatatacatacgtatatatacatatattaaaaaattatatatattataaaatattgtcaattaaacacctcaaaatatccataataatagctgatacatctcaaaatatatatacagaatcactgaaatatatatatatacatggagaagtcaggtggatcagcacgtactcaatcaaacagaacgagttagtgactaactaaatcacaaatagttgcccttctatctcagtattaatcttctaccactagtggagaagtgatttttagtcccagttcgtaaaccccctgtagtcccggtttttccaaccgggactacgaatccgggactaaagatcgctatctttagtcccggttcaaataaccgggactatcgctattgatttcacaccatcccctcccatatccaaatcatcacatatcacaggacatctccaaatcctcaaatccttgaataaatcatctccaaatacatcacaaactcttaaaaaatagatcatctccaaatacatcacaaactcttaaaaaaattacatcacagggttctaaaaaaaatcatcacagattcacatctcacacaaaaatacatcacagattcacatctaaaaaaaaaaagaaaaaaatccggccggcggccactgccgcctcccctcctcccctccgcgccagccggccggcgccgtgccg

SEQ ID NO: 5533 - DNA, 23787 bp, Oryza sativa
gggactaaaaatgaacttgctaaagatcatttttagtcccggtttttaatggaaccgggactagtgtggatttgggtcgaccgaccaaagatggtttctctaccagtgtacgtaagtacaagatactagttaatcagccaattaatcaatacagaattactacatacagtgacatattgcagaatactacaatatacaacatgttggacattcttttttcagtacaactgcatggccaaaattaaagcgaactctagtacagcacaatccatctgctatctgaatttgggatcagtttcatcagaaatagtgtcatgttgatcgtgacagaggagcactctgcacgccaccatggtctcacccaccttcatccccggcgtcacggtgaatgcaactccatctccttcgccacgaccagcatcggcggcggcggcggcggccacgacgctgtccatgtactccgccgcgtacctgctccctctcctcgcgtacaacatcctgacacttccacggccacaacatcgccggcgcgccgtcaccgccacccgcagcgcccacgccgacctcgccatcgtcgcgaacgccctgtagaaccacgtcctcgggtgcccgcctcgcgacacgaacgccctcacgtccagattatttctgaacatagctgcctccatctctgacgacacggccgctaagtactttgttcgacagaacctcgcgaagctggagttggggtgctccatcaacgcgtccagagggtcacagcatctcatgattcgatcgaagcgagcaagatcgagttcgtcgtcgtcttcagcaccatcatgtactgcaagcattgtccgtgacaggtaagcttccagtgagtacctcttgtatggtgaatgttcgtctgcattgttgggacagcgatgatcaggtgaggaaatcaagctaaagatcagctctgcgaaatcatgcaccgatgtcgatgcaaccttgaacagctccaagactgcactaggcgtcgtcaattttttcaggacaatggagtaatccttatgatggttaactgatggtttgctgctactgatctgtttattcagtctcgaattcgcactcttcagaccatccagctctcttctcaacagcataatgtctgaatctttcttcctcgtctcggcctccagttcctgcaccagcgaccatcgatcattgataagtgacccaacgctgccattccaactgcataagctctgtagagcagtgaccgagtcgagctcgtaggtgatgatctcgtcggcgaaggcaatctttggacgattataagggatatgagctttctgcagcttgatgtaggttgacttgagagctccgatttcctcaaacagtcttgtgataactagcctctgatcatatccgccacaataatctccaaattctgtcttcgtgtcagcaaattcaggcgcggcacaaatctttgtgattttgcagagtttggagaagcctaatacgagtccaggaacattacaggtgctccttgcaactgaacttcttggtgttcttgactccattggggctgattcagtgcaaaccaagaaacaaaagaagaatctttgagacgacatgggagagtatggtaaaattatctacgagaaaatcaatgtaatcgatggtttgaacttgctttacttctctaatttgatagaaagactaacaaacctctgtttatgaccacagaccaaatgcagcaatatctttcattttctgagatgtaaacccaagaggaaaccacagactacatgggcatgatgcaaatcttgtgctccatctccactgttgaacatgaagggtagaagagcaagcatgcatgaagtacctgagagggaggctgggactgaccagtgaagtgctgaattgaattggtgcagagtgaccaagaggatagcctggtttcccccggctaaaattgaaacatttctaagtctgctgctgctgcttgcaagctatgcagagaggaaagcgaaagagcaagcaggagcagtagtacaatgaaggacaagaaatggacatggcagtggcattgggaacaacaaaagcaaaaaggttgcagagacaaggtttttgcgatgcattgtgggcactggaatggatagtgtgtgctgtcccctcccctggtggcccgttgtctcaaagcaaaagtgaaacaaagtggtaaatgaacgtattgagatgatctttcattccaaccaaaccttttccaacatttgactacttcaaaatcaaatttcagacactttccgatatactactagtagctaggtaaatatatatcacttccaacggtgatatcaaataatggactcttttctattgtcataataatacagaaatttaagtgtatgtaaccaaacttctgaagcttccaaccaattaattacatttttttctaaaaatagaaaaaatgtcagctatacacctcaatatactcttgcgtgaaattcatctgtcaattatacatctcaaaatatacttgtataaaaatactagcggtatgcataagcactgactgcacatatgtataaaggtcaggtgcatatatatatatatatatatgctctcaatcaaatgagttagtacttctctctccgttccaaaataaatcaaaatatgattggataagataaatctactcttctagtttgatttattttgaggcggtggtaggatagagttagtgaaatctgagatagcgtcagaccatgttatctgcggtgctaataatgtcatctgcggcggcgacggcgacgtcagaacggcagagcgggcatgttgtgcggttgcgcagccacttgacgacgcaatccttgtgaaacgcgtgcgcgcaccccggcagcatcctccatctcccccgctcgccgccgccgtcgtcgacatcatcctcgctctccgacagacagatgacgcactgctcgttgtcttggtcgtctttaggtcgtagcagcagcctctcgatcagcatgtcgtacttgttattggcgtcgtcgttgcggcggcggatgagtccgaccaccgtggcgatggtgagggcgaggaagcagagggccacgccgatgcaggcgaggaggaagaaaaagatgatgccccacatgagacagtccacgatatcctccgcgtccatgcctgccaatgcactgcacacacactcgactcgatcgatatgtctcgattttcttgtgtacgtacgtatatgtcgatggatcgatcatcgactctgaattggattagcaaaaagtaaatccgattctgacacgtgaccgtcctcctgcgccgcagccacggccacccttttgcttctcctcctcatcatacattcatactcatacatggacagggcctcgtcgcgcctctggaagcagagcatctcacagatcgatctttttttttatccggtgattaattaaagatccaatcaacaggcaataataatatcgtagttgatccatttctttcttgtatgtatgcagatcataacaatatttttatctcatcttaaaaggattaaaaatcaagtccgagctaacaagagatccatatattgtgcgtacagatacctaaaatacactgatgctactattttttttttgaacggaatgctactattttaggatctgcatatatataaagggtgcaacatatatagctgattgatgcttgcaacacattattacgcataaatgcatgggcggcgcagaacacaattcaagtggaattggaaaaacagaaaataaacaatactatcaagatatagttgcgcgatgctgttcttgaaagagctgcccatctggcaagcgttcgggttttccttattcacaggggccctcgccggcagcatcctgtacgccgtgtgcgtgctcctcctctgctgcgtcgatcgccgacgtcgacatgccggtgcgccgccgcctgatccgaagatctggctgccggaccacgcgcaccatcgccggcggcgggatgagtcgtcggagatggagtgcagcatatgcctgggggaactggaggagggggagaggtgctgcacgctggcggcgtgcaggcacgagttccacaaggaatgcatctaccgctggctcgccaaccgcaacacctgccctctctgccgccacatctccctcccccctgcttcatcaccaccacctgcgccgccgcctcaccatgcttctcctcctccttccaatgtactggctgctgctcatgtttagatcatcatctgaagagattttgtttcttaaaataaactaaaaaggtttcttccggcttaatttgttttgaagccaacaaaaaaaaaagaaacgtctggaagaaaaactggaagcactgatggacgattgctcttttacgtgatcatatatgttcaaaaactttactattttgatataataaaagcttagaaaaatacaacttgtgtgtgatatatggcgtcggcagccactcatccatttttgggcgttatgtaaaatttcctgcgcagcgccggcgcccgtccctctcttgcgcacgcgtaattagcaagaggactgctacagtctacagtacaagatatatagttagaaagctacactttaataaacccttctcttttctctacctgcataagcaactaaccaactacgcgtaaaacacaatgtaccaagagataattcaaggaaaatcaatagaaataatttcaattctaggaaaaatctaataaaaaataacaacaaactactcccatagccagaaaattcctacatattcccattgcccctaaaaacaagcaatcaagcgtaggaaaaagcacgcaaagtccttcaatatgactagctaactcaaatcaatgagcaaaactagcctgagaaatcacctctaaaaaatgcttaaaaaccacacgaaaaaccaacaaaaaaaacttgccaatccgattcgccaccacctcaaaaaagcctcaagaatggcccctgcgatttcttcacctcgagttgagttggttttccacaacagcacacaagtcgttgttgaccacacggactgatgaccacatggtgctcaccgcccatgagccatgagggtgagagggggaagggggggagagagggagggagggagatggagagagggggggaggggaagaagaaatacagggataggataagaccaaatacgtggtatactgacatggataagatgtttaagtagatgattatttagtcacatgcatgttcggacgggagactgttctatagtattttcagattagcaatttggaaaagctagatactggtatcccgcgcctagcacccgcgacggtatcgtctccctcattccctagagcacaagcgtaggcatgcggcaacggagcagcgcaggcatgcggcaacggagcagcactggcatcgggcatgcggcagcggaggaagaagggagagaagggagctcactggagaaggcccccgctgcctcgcctcactgcttcgtcggggagcacatcaccggagaagatatgcagcaccacgggtgatgagttccggcatgggactaacgagcctcggcgtggggcgtgggaagacgcagccaccggcgaccagccctggcgtggggcgtgacaacagaggacgcggtcgccggcatcgagccccagcatggggcttagacagtggaggacgggctcgatgtggaggacaaggctagcagtgacaacgtctcggtgaccggctcctgatgcctagtaggaaacacatgatatctggcaggtatcgcgctctggtatcgacgagtatcaagtggtattaacaggtatcaacatctagtaccaatgggtatcagtcaatacctacaagtattacctgatacctgacagaaatcgtatgataccggttaggtatcagaggatatgatgataatggttaaatgccctgatacttaataggtatcaaatcctgatacttaactggtatcattccgtccaaacgagatttattgtatagcagtttagatggtctatctttttctctaatagagagcttgaacaggagatttgggaggtacagttgaagcgatattactacttgataggtggcaaaatttggataagatagggatgcgatacacgttatcataagacccttcaaatgtaaaaattaaaatcatatataaaagtaaattcaaatgttaataaaaaaattagtttatcaaataaaacttaatttgtaataaaatattattgatcaaatatttaaaaatttgaattttaaaattcgtatgtgtcttgttgagtggatcgagcagagggggtaatattttgctcatcacctagacacttgttaagagaatatttgtaagttgtaacaaccaagacgggttagaatatatccccttcatccttaaaaaaaaatataatctatgagaaaatatgacatagtctaacgacgaatctaaacatgtataatctaacaccaattcaacttctcctcgtcggagctacaaaacccctacaggaagctggtgtgggggcatacgccgcaccatgccctagtgggtgggtccacgcctaatactcatatgagcacgtgtatacatggcgatctgactcatcagcgtcagcgtgacagcgtgtacagtacagggatcttctactacgtggagtatatatgtacatgcatgatctagacatacgtatactctagaaagaaattaaggaagagaagagagacgaaaagtcagagttgtgtggtgcggaggtgtacacatgcatgtgtgcgtgccgtgcagacgtggcagtgatccagcatcatcgatctatatgattagaggaatttttgtcactattttcattattgcgacgaccctatccaactgcagccatccatttgttcagtgcatgctctagtatattctcaattactagtctcttcccgtttcttaaagcttcgacattaatgtattcaaccatgtgaaacaaatacaaatcctagtttcttatatttggtatatggagggactatgttatttgcttcatccaaaaaccgacgggtaaaataaatttatttatactacaacacctacatatgctcagagatgataaatttcagctatttttatttgctctatccgtaccaaaatataccaactagtaataaattagatataataagtacattgtgtctaatcccgtatttactatattttcggatggtggaaaaaattattggtaaattatttatgctgatatgtacttattatacggataaattaaatattttaggaaacaaacttgcaagaaaagcttaaaacaaatagtctaaataatttaagtaaaagaacttttctttgagaaaacatatatttagagctgtatagcaaataatctattgcactgacctgatgaacaagcttgaaaaaaaagccttagaattaattaatggttataactgaattttgcacaaataaaaaaaataattacctcctcttattgcttttttcttaggaaaatcgtttatcattaagcaatgtttgtttctcttcttaggtacgtttgaattttgataccccaaacgttagttttgttcattttccattgtcatgccattatgttggattttgaaagactcaatgtgtcagtattttttttaaaaaaagatggtaatagcgttatttctcttcacatataagtttgcatgatctttctcagtgtgcaagttatgtccaactagataaaaccctgcacgtggtgttgcgcgagttttgtatgataatagtataaacaaattttaagatagctagacgacatacccttaaataatttgcatctttgatcaatcattttttaaaaaataaggtgatgatatttaaaaagtaaaattaaggtgagttggcttcataaaagaaaaaacaaaaaggaaggagacaatatagattggtcattcaaaagcaaaataaaaatgatattgctttatgagaaaaaaaagaaataatatggatcatgtattaataaaaataagaaataatttggataatgtattaatcatcaagtgctagaaacagtgggggtgagagaaatgcactactacgaaaacagtttttctttgtgggggaaaaacagtttttacgtgcggaggtggcgctcgtctgcccggaagtgtctgcaaaaataaggatttctctgtgcggacgcgaaaaataaaaatctgaaaaaaaaatcaaaaccctagttgccgccgcagctcgtcatcgtcgtagccgtcaccgccgccattatcgccgtcgccgaatccgggcggcggagggcgggagagaggtgccaccgccggatccgggcggcggagggcgggagaggggcgtcgccgctggatccacgcgggggagggccggagaggggcgccgttgcggggagagcgcggggatggccgccgtccgcctccgctccggccaccacctcctcatcggcggggcggcgtggattcgtgggaccaacggcgctgctcccggccacctcgtcaacggcggcggtcggtgccctgctcctctcgccgttgcccactgccgagccgcccacctaccgccgtacgtgagtgtgtgagaggagaggagagagagcgtgcctggcttagaggataaggataaggaggtgagagagttggaggaaggatattaggatgtaatttttgaagtgttgaggaaaaaatgagggagggtattttcgcgtgcgacggtcttaaaacgcccgcatgcgaaactcaattttcgtgtgcaccctattaagaggttcgcctgcaaaaataggtttatttttgcacggggatccttaagaggctcgcctgcggtcctctcaaggatccgcacgtaaaaataggaggacgattttttccagacgggactagttacggtccgtctgcaatctaaagaggaccctgtacaggaaaatcattttttaagtagtggcggcatcaattatgaagtgaattaattgacagactgaaaggcgcattaaagtacataaaaacgcaattgagatcccctgtagtactgcatttgcagctcactggcatgacatatgggccccatgccagtgagcagtaatacacatgcagtactgcagacgacttgcatccataaaaacgatcaatccacgctttcctgagaatagatctgttgatccataatcataatagaggaaatgccatcttatgaatgaatgaagacggaattcactcgaaattacttcttgaggcaatggttcattgattcctaagaccgtggatagttcttgaggtggatgaatgaagccaggaatttggtgcacatgcatgtgctgattcgtgttccgataaatgtaccacataaaaccatcggacgaatcaagccggggttctagacaagattcaatgtggggctgagatcaagttcagcagggggacaaaataaatcatcagaagcaacagagaacaaaatcaacatcaataatagatgccactatatcaagattgttcttacttgatggaatactccatacccacgtagaaaaaaaaataaaaatgcttgatcgtatttaataagctagataggagtattagataaaaaaacatttagtaatcactattatgatattttttggcccctaagaattttttcattgtaactttgaaacctttaattcctcgccaataatttaatgaaattgcagttctcctgcaatttaaaataaaagttactagcgcttgtttcttttcaacatagttgttgctctgagtaaagataaatggtcaaacgtcacattaagtcaacaattaatggtgttatctattaaaaaatcaagagtaacaatctacaaataaaatgggttgcttgggaagtgtgtgtagcttaactggttatattccttgtggtggaattaccccacccaggtttaagtcctagactttacacgatactactagaaaaacgatttttaccgacgttagctttttaatttttcaagaggacaaaaaaaaaaccctcttataaccatttgcgaaaatagctaaagagcatctagatttaactctgcctgcgaaaatcaattttttcagtcggaccccttaagacgtccgcctgcgaaagtataccttaagtggtccgcctgcgaaagtattttcgcaggcggaaccttatgtggtccgcctgtagagaaaatatctaagtcccatccttatattctcctccaccatccttatcctctccaccactcattttcctcccccttctctctttctctcatcacacgcctgaggagcgtcagcggctccaaggaggtttgccgccggccgtgacaacgactgggtcccaccgccagctgcgatgacgacaacgactccgcctggatccaccgccggctcgcctcgggcacgcggatccgctaccggccggtctcgaggaggggaggggaggccgcggcttggctgctccctctcttggcgatgatggtggctcaatgacgaggagtggagcgcgtcggccgtgaggaggaggtgaggcggtggttcaacttctccctctcctggcctggcgacggcaaagatgaggagggccagcaatggcttggtgatgaggaggggaggcggcagtcgtgctccaatccccccttcctcctagatcctgccggcggtagaggcgagctagccagcagtggcggcgctctcctcgggcagtcgggcagcagcggcggacggcggacggacggacggacggcggacggagggggaagggctagatggggaggccggcatcggcgccagcgagcaggggtggtggcggcggatttttttttgttcgctgaaaatatttttgtaggcaggtggatctaacgtctgtgaaaatcatttattttcgtaggcctttgcttacaagcggtcctttcccccacttgaaaaaattattttttggcagcctaggaaaatggttttcctagtagtgtgggtgctcatctttatggctaattattctttcagtgctaggcgacgtactcgtcaacagcgagacgcctgcgatgacttcattaatttcaaaatatatcggtccagtctttcggatgtgctcataggaatagggtgtacgtgtctacgtttgtaaaggtgaatatacgctcgttgtgagtttctgcgtttgtattgtgtttataaaaaatgggttgcttggtttaattggatgaatctgataagtaattggtattttcgttgattttgttggaaggaataggacatgtaacgattcgtgttgtatgtgacaccacgacgctgttgccattgcaacgtaaggtgtacattcaccagcttccctttccgttttcgagcagcaaattccaaatgtaattccttttgtcacacgcaggcaacacaacgcatgaactccacaaatcgtgtgcagataattaattttggacaaagacatttcttggaagtggcacagatttttttcactgtcatgaaaggcttgattgatgcaaactaattgagccgtcatcggctatctgtacattatccgtacagctgccaagtttgtattgatcggttttcctcgaggttaatttgtaacttgtatgtttttcttctagtaacttaagtaattatttttaaatctaaggtcaatatgcataacgacatattcagaaagacttatgaacaagctgattgttcattggtaaaatatagatatgcggatgtcaataaaaaccgacgatgcctgaccgaaacaaatactacatgtctacatccatgctaaaattaaataagttcacttctatacatgaatttgactatattcatatttatgtaaaaaataaatttatttttgaatggaggaaataagtatatacggtgataattgaataccgctcaccaaagatccagctagtagcacacggataaatggctgcaagccaccaaccatttccggtggtccaatacctgaagaacagccagcccattgatgagtcagcaaaggatcagatcgtgagagatgagccaatgccatgtatttgagttactccaaaccaaaacacaccatcacatggaaaaagtaattaatctaacaaatgcctcaattaacattggttatgcagaaaataaagctgcagttaacggaatcagattaaagaaggaaacaactgctcattttctgtaagacagcatcacggccttcagatctataaataggattaggcaaggtgattagtgatacattatgtgctgtacctgtttcaagaacacaatgatgagctgtaccatcatcaattgtgaaataattaattaaattatcattaagccccaaaccgagccaagccaagccaaatgaatgattgctgtggtgaagggcgacgactagtcagggatgagtcggatggatatgctctttatgtgatgcggtgcccaggaaacgcggcccaaccaaatcagggtcattaacgtcaaatcattctctgctaataatgcaaggcaccattgtttcttctccaactctctccctggcggctgcctcctctcctcttcttgctcggttccccctgtataaaagagaaccccgtcttctcgctctcctcgcatccactccacatactaccactcaaaaactctctctctctacccaaacaggttttgagaaagaagtggaggacagatccaaaaagttcaccttttgattatccaaacaagtttggagtttgttacctgaatctcctcttcttcctgtcaccggaaggtatgcagttcctctctccatatcatcttctagcgtttctttctacagattcttgattgctcgcttttttccattattctcttttgctccaacgtaggggtagggccacatcagttggacaagtagaaattgatggcacatcaattgagtagatgcggaaatttctggtttttagttaaagtttagaccatgccgatgccaaagtgctgccgtttaatcgaatacaacgatatatactcttgcaatggcatgtgtcatgaggtgtttgggtttggcgaggctcagttttcattgaatttcccctccttcccatgtggccgtatcaagcctaatctttgaaaaatattcacttcatgtggatgcggaatcactagatgcagcttgactccatgcaaatcctaactcctgccatgtgcccatgtgcctgtcccttatcctgatttgcatctgaattcatttgctcagtaatttgcttgttcagtgcctaatccgatagacgtccaaacaaagttttaattaggagcagaagatccagcaatgttattttttctgaatttgtaatgtcttggtttctgaattcgtaattgactatttttattaatcacctttctgaacctgaacgaaagatgcataatgattcacatcggttgcaaatttactgaatatttcctcttatttctagtgtgttattcatagagttccgaaactcaatttcccttttttaaaaaagcttctgatttaccattccagatttctgataagtacttagttaaagttccttattatattaattatctatattatctattacacaacacgttgaactcatgtaagttctgattgattatagggaacacttatattatataagtagtaggtataattatataaaaatgcagttagtactacaataagctttcaaaattcttcgtagtgacttttgtttggttaaagttcttacagacttccagattattatacgtaccttgttagcgacattcaattactgaatctgatgcctggttttgtttgtgcagggaaattgataaaaaaaaagcagtgaaagcctcaaggaatgctgaaagatgtgcttgcatagaagaaattttccgtgtgagataaagcagattgctggttcactagtgctactgatctgctcaagtcttgatgtgagtgatcaactttcctgcactaattctacaccatttagactccgaaacgacgatgatataagaatgttgttctccattcatgatcatgaccttggggaggatggctaaagaattgcagtccatctgattggtggtcaaaacatagtgctgagatttatatctttgtgggcatggagagtagagggaagatactaatggagaggtatgagttgggcagattgttggggaaaggaacatttggcaaggtgcactatgcaaggaatctggagtcaaaccagagtgtggccataaagatgatggacaaacagcaggtgttgaaggtcgggctttcggagcagatcagacgtgagatcacaaccatgcggttggtggctcataagaacattgttcagcttcatgaggtcatggcaacacggaacaagatctactttgtgatggagtatgtgaaaggtggtgagctatttgaaaaggttgcaaagcgtggaaagcttacagaggttgttgcacataagtacttccagcaactcattagtgcagtggattactgccacagtcgaggtgtgtatcaccgggacttgaagcctgaaaacctgctgttggatgagaatgagaacctgaaagtctcagactttggactgagtgcgctttcagagtcgaagaggcaagatggcttactccataccacctgtggaacacctgcatatgtagctccagaggtgatcagcaagataggatatgatggtgcaaagtcagatatttggtcttgtggtgttatcctgtttgttcttgttgctggttaccttcctttccagggcccaaacttgatggaaatgtatcggaagatacaacatggtgaattcaggtgccccggttggttttcacgcaaacttcagaagttgttgtacaagatcatggaccccaacccaagcacaaggatttcaatccagaagataaaggagtctacctggttccggaaaggtcctgaggagaatcgtattttgaaggaaagaactttgaatgaaaacaccaccaaaaatgttgctctggtgcttggtgtgagacgcaagaaaaatgctcatgaagatgtgaagcccatgtcagtgacaaacttaaatgcctttgaaattatctctttctccaaggggtttgatctctctggcatgttcattgtaaaggaatggagaaatgaggcaaggttcacttcagataaatctgcctcaaccataatctcaaagctagaagatgtagcaaaggcgctaaatctcagggtaaggaagaaagacaatggtgtagtgaagatgcaagggaggaaggagggaaggaatggtgttcttcagtttgacatagagatatttgaggttaccacttcctatcatatcatcgagatgaaacaaacaagtggcgattcattggagtaccgacagctactggaggagggcatccggccagctctgaaggacattgtcttggcctggcatggagatgaatagcagcagtcgcaagagtagattttgatgtctcaagcatttagtttccgctcctcaaattcattaggttttagctcaaatgaatttatttgtcttgcctatgttctttttagcatctatgtttttgtatctggagagttcatgttgaggcaatctatgcacaatttagatggagtctgtcgagagtaattttatgagaagttgagctgcaatataaaagttggctttgagcctttcaagctttcttcatatattcgtccttgtcctgtcataaagctatgcttgggtgcaatgttgtgacaccattagcaaggttactgcagcatgaagtatgcaattcttggtattcaccagtcgctcaagaatttctagagtttttaactttttattaccaacttgttgacgaaaattctcatatcaatagtgctacagaggtataccttatcagctattgaacataagtctttatcaaacaaataaaagaaaaaccgaagcgacttctcattctgcggacgaacaagataacacgagtgcgcaatcctacaagatagtagcaggtaggcaacgaaataccaaaaagctgcagtttcattggaaggccaaaaaaaagatttttttttaagaataaggatatccttgtatttgccaaatagccacagagagcgaagttattggtaaacaaaagaaaatataatacacatgttgaaaaatctgaacaaaagctatttaaacactagttgtgaggaaaataaattgtccctgtcactgaggatagatccaacatccaagagctcatttttcacggtactaattgatcacccaacatctttccaagatgttaataatactgctaatcagactgtccaaatgtcgactggatttggttaatctcaacaacccaatcgtagctgtgacaagttgtacatatgacaaagactacactcttcataatttcatattgcaacttgcgaatttcccacctagatgcttttgtcctttgtaagatttgagaatttttttttgctttgagaaataatactgagatatcattatatcaatgatagattcctgataagatcgctgtaaattagagagagggagaaaaaaaggttttaagataagtcatgttgtcatgcaaaattcagttctagtgttctactactatacatttatatatctttcagatgttgccagtttatatacattagtgtttgtcttgataggatatgttaaaaaaaagtctggccgacaatatgtgatgacgatgaggtaatcctttatagctagtaaagcagaacagagggaatagtagtctgaatttgcaagagatggggaaaaaccttgacctgctctgctgtcctgtcaccttgaccttattatcctcttggagaggagatggaagaaggaactaggctttgatctgtacagcttgcgtgccattgatctctgcaacgcggagacaccgccaccctgagtggtgtatacctggccggacctcgacatacctcggtcatggttgccgtttcagccgaagctcatcaacctcggctctggcagattttgtgccgtcaagatcttcacttctggtggttactacaacgactctgatgatgacatgattcactctgattttgctgcggattttgctgttttcactggcctgcagatgctgcgtccccatggtaaagatgatccaagacaggttcggatgatcgagcacaagtccatgtattagtacattttcaacgcctataacattgaatttgttctctaagaaactaatttcgagtttttatagatgagaattggtgtattgaaagtaatattatttttctatgaatcaatatgattttctttctatggaaatctatttatgatgcacattaattaatttccggtggactcacagactcacagtagcctgtaggctgtaggagagtactgactactcactactcagtggagtcggaggctgacgattttcttttcctcttgcagacgcttttacaagtggcattagtactactacgcacctagacacccaacaggttaattcagaaacagcaacgggcaagctactttgaatcgaagatgaacaaagtaagaagcctatattgaagtagtataattttaaaataaaacgttactgtccaagcatcatctgagaaaactaggttacagtccagccattttattcaaaacattatctgttgcaaggaggaaattaaaatgaaatttgcaagtggagtagtagactggggcccccgcgtcgccctcccctgggcggctcgggaggcgacgcgcccgccgccgccttcctctccccgcctcctcctccgcctcgccgccgcctgagcgggcgccggcaaagccgcgtgccgcaaggacggcggcggcagggcctcgtctcacccacattgcactcagaggccgggggagctgtgtgtggcggcaacggtggtggccagatccgcgccgtgtccggccagatccggcaggggggtggccggcggcggcggctgacggtggtggcggcggcggcagcgctggtggcggatatggcggcgaaggtgatggtgatggcgacgacgacggcgggccgcggcgcgtgtcgcgacgccggccgggctcgtcaaggacctcgctgccacgagacctctggcgcagcaccctcgtcgacgctccctccacgacgccgatgacccgcgcggcgcggatggcggctgtggcggcggcggtggcggctggcgacggtggcgcctgtggcggtgatggttggcaggccatcacgaccgaaggggctgacggtgtgtcgtcgtcggcggcagcatgtggaggcgaggaaggagtctggcggcggggaaggagaccaggtgtaggcgtgacgttgacggtgggaagatctgtggcagtggcctaggccggatcgctgaagggacaatattgtcgaccggcgatgatccttcttgtgcggattggttgtgggggtttggacagggaatcgctagcaaaagcctcgccgagccgtttggccggctgatgacggcgacaccttttggcgtcgttcccctccctgaaggcgtcgttttagcgtacccctctcctttccctaccattctccaggtgaaaaccttgcttcggcttccgaacgagcggtggcggcgatccacgtcgcgtcctccttgggggcaccgctttggagaaacttcttcgtgcaaggatgtcgttgatggtctatgcatttgctttgaagctttttagccctagcttttgatgaggccttctatttctagctccaccttttgttttgcggtggacgacctcgctctttttttgattttgttaggtggagtcggagctgctttgtccgagtgacgaagctgggcaacgatgacacgctgcattttctttctaggggttttgttgttggccgtgaatagattgtggcgcttaggcagctttggttgatgttcatcttgggaagtcgaaaccacttgatcatttgcagcatctaggttccgatggtgcatccggtttgaagtcgaagctgctgtgtcgcttggcggcaagcttggcaacgatgacacggttgaaaagtcagaaccccctatgctgttttggtcaaccttggtaacgacatcctacgttgggctccgtcagtggtttcagctgttagtgagttctggcgtgtgctgtgtaactgttcagccagtcggtggttggtttttcttttcttgtaacccgtctagggtttttactactacttattgaaaatataattggcagctctcctgccggtttagttttttttttaaaaaaaaaagtagagtagtagacttcacctatcgtgcagagttggaaaaggacggcccattgggcccaataatgaggagagttatgttaatcggaccaaagaccgcaggttcgccttcccctagcgccggtcgtctcggactgcacctccgccgccgcccgccgtcgatctccagctccactgcatacaatactacgtacctccataatatttggtgtaaactccagggaaggaatttctgctggtcggtaggtatgaggttaatttcttctttaatttctctctccatttattattgatcttctcgttgctagctgtgtttgcatggtgtgtctaatctggattagaatcaggccggataaataagtatcgtctcggcgtttggagcagatacgtaccatgggacgacgacgatttgtgaacctggtggtgcagggcgccggtggactctattctctgcgccgcatacccgcgaatcgtctcttctacccatcaacaagagcagctgaagaagcaacggcaaagtcacaagaatcattcatggaggagcacggtggcaggaagcatccaggcctccacaccatggagatgttggagaagcttccccgttcgacgttcgccttcgagccggcccccgtggatcgctaccatcttaggtctctcgacttcgcctgtctcctcggccacgagagcaggatgctcactgcagacaacaggggaaacaccgtcgtcttcgacgccgactcctcctccgtcctcgccttccccaacctcatttctcccaagaggtataacgccatatccctctccattatcaacaacgatggcagcaacaacaacaacgggttggaaccaccgccggaggacggcctctacgtgatgacccggagtcccgacgtccacagaatcaaggatggttgctttgaggtgctcaactactcttcttcctctgccgatttccgtgagatgacccctcattgggtttctctgccaccaccgcccttcgccggctgcatgaacgccgaaattacctcctacacggtggttcacggcaccaccatctacatttcttgcaataagccaatccattctacttatgccttcgacacggttagccatgagtggcgccggctgggctcctggacaatgccattccatggcagagctgagtatgtgccggagctcaacctctggtttggactgtctgctcgccacccctacagcttatctgcttttgatctcctctccgacgactcatccgtcgcagcaaaaccacccacggtgcaccatacttgggtggaccttgacatacctcagtcctggttgccctggaacattcatctcatcaacctcgggtgtggcaggttttgcatcgccaagtgtcgaaacatgaattcggcaataataaaaggggtagcgcacgagacctaaaagtggatggatgcagagacaaaggatttagacaggttcaggccctctcaatgagaggtaataccctactcctgtttggggatttgaatccgccgggtgtattatagatctgacaatcatatgtgctcctgccccctagagggcctccttcccaccttatataggatgggggcaggattacaagatagaaaccttaaccaatacggtatcggtttcctaaatctattttacaatattattaaatcaggactttaggccgctccataatataaaaggaaacgtaatacccaagtcatgattcgttacatattccatagatataagctatcccctatgactagtcggataaccatgccgtgtgggtatggggtacccataatctccacagtagcccctgagaccttcatagtcgaaaagataatgttctctcgaactagattactccaaagccgagtgcttcaatcatctttgccatggtctcccgagtacttttaccaaatctgaagactgtgtagggctggaaaataaagtcaggtgcatcgactagatgcacctaataggtgtgtggttaattgaacaaaccaagcatatagtcaaggaaaataatccaaccaactgagtgatttcgataatcgtagtcaaccaagagacttgatattaatatatagcatatgcggtgtgaatcccccaaataacatgatccatgtgatataccgactgcgttgtaaaaattgatgcgagcaacctaaagttgactacattgaaaattcacatagcaaaatagctataaaaagagcttgatgttgtgaataaagaaacttccaaagtattgggcatacaccatgcgcacactgctttaacaaatgtgcttaagtccctaaaagacacatgatttaaccacacctggaagtatatggcatatgtggtgtaacatccgagtaaataaactcataaggatttaccaaccgtatggaaaatgaccaaaatatataatcagcctaagccataatattggtcaataaaaatgcacacttacgtggcaaaaggcaatgatattgtatccaatcaattgctttataaacccaaacagcgccatgactatataaaaaagtcagcggggcagctatataaagctttactgtttgacactttttaagatgcattgtaccaactcctaaaaagttgagtaactgtggtataaaaggattttaaggtattgagcacttgatcacccgcactttagcctaagcaaaaagtgcctaagtccctaaaagaacgtgacagggcacacctgaaaatatgggctgcagacatattaggcctaggccaaaaaatatgccttcaacaccctttaaaggatggcgcatgtaacatgctcccgagtaataaatcttccgggtgatatagaccaagtgtagctcataagaatagcttctgatctgagtgattatctcttatggggtactccaaaatagatataaaaattgaatcccgactggcgcaagtagtcggttgatagcccttgtggggaataatgaatagtccagccgttaagcatatgaaatcgactcgtgaccataaattcatgttgaatgtatccggaacaagtccaaattgaagatatgatccttgtgattgagttgataagcccctaagcatatatggcttgtccttctgtcatagtcaaaattgtccattggcaatagctgatgcagtcgacatgaaggcaagatgatgaacatggggatgatatcgcccgtcagaggtgacaaaaatgttggtggtggtaaaaacggtgacaccaatcaaagatgatgaagtcgcatagccatggaggcgaagaaaccagtcggcagcagttaggtcagctagcagtgaagatgaagacgcccaacaacaacgacagagtagtcggtggcgacgaaagcaagccgacgatgaagacgtagacacgtatcgatggtgatggcgaaatccaccaattatgaagatgaagaaaatagtcggcgatggcaaacgcatccgacggtaatgatgattagcggcaacagagatagccggctatgatgacgaagttgcccatcaacggcagcagagtaggctatgttgaagagacttgacaggatgttgatgaagataaccatgtcgttgatccagtcaatagtagtgtagcagtccatgataacgatgagatcctctatcggcagttgcatagtaggccaaccgtgaagacgaaataacaagtcggcgatgaaagtcggtgatgacaaaagcaaccgacggcgaggacgtagtcaccccttagcaacggcggagacgtcagggccgatgaagtaaacgtgctggtgatgatgtcagtgacaacaatccatcaaaccattgagaagatatcgaagcttgagaagtttccttgatgtgagcgtgtgcataaagaaaactgatgcaatgcttcttgatttacgaagatgactgtagaacttagtgttacagctgttgtagatgcttcacttggaggaaagtagatgttgttgtccaactcgtctaaaccgagctgattggttgataactccaaactcccgaacatgtagattaaatcttgaacttgatacttgagaattttggagtagattatggcagcgctgagaagccaaaattgtcggtgaaataattgaagttgctgaagtagaacatctgctccgaagcaaagatgaagacaatgactcctggataaattgattgcttcagcttgtcgaattttgagagtcttgtatttgtgtagctcccgactctttggttaattgggaaacaactgaacatagagtcgagaactgtagcttcttgtcatcgagtagtcatcacttgagtgaagatacatgttgaagatgtccgagtagaattcttgaaaattggaaaaccacttgttgtaataatataacacgacatcatagttgataatgcatgccgagatgtcgaagctcctatagacgtcatggctggtgaaatagcaaaacttgcgaagtagcggcaattgagtttgccgatgccgaagataataaagatgaagtcgctccaccatggtgacaaagttgcaaagccgtgataaagtgaacacgagtcagtggcacacagaagaaaaccggtg

SEQ ID NO: 5534 - DNA, 6420 bp, Oryza sativa
tcatgcagccatgggagtgaagaaactagtcggcagtagacgtagatagcttgtgttgaagatgatgacgcctattagcggtgatggcgacgtagccagccgtgaagaagatagcatcagttggcgtcataataggccagacgtgcaggcggaaacaccagtcggcggcggacgaggcggccggtcggtgaagaggtagacgcccaacaacggcggcataataggccagccgtgcaggcggaaacaccagtcggcggtgaacaaggtggctggtcggtgaagacgtagacgcccaacaacggcggcataataggccagccgtgcaggcggaaacaccagtcggtggcggacgaggcggccggtcggtgaagatgtagacgcccaacaacagcggcataataggccgaccgtgcaggcggtgacaccagtcgacggcagacgaggcggccggtcggtgaagatgtagacgcccaacaatagcggcataataggccagctatgcaggcggtgacaccagtcggcggcggcgaaagcaaaccggcagtgaagatgtagacgcctaacaacggtgttgtgaccaaccaaccgtataggcgaagacaccagtcggcggcgacgacggcaagccggtggtgatgttctgactgatccattcctggagcgtaagagataagcttaaagccataaatcccttttatgcatatctggatttggatcctacagaacaaacatataggatgagtagtatctgatgtaaatataatacttgagaaaaatgcaagtattttaaaatgtttataaatatgtatttctcctcttgtcaattttgatttccccgagcagatgactccttacgtttaaacactctgcctgactagtcatagcccccaagcaccgggagttggcctaggcacttcccaaacatgcatataagtgacaagagttcgtcattaatggaacaaagtttcacgaatcagtatttactactcgggtacttttgcaattgtaaagagcagaaaataaatttatcttatctccatgcttttgatttattctgattaatacttagcaccttgcgttactcggtccatataacgagcccccgggtgctaggaatcggcccaaaggcaactatccatcgacaaaccaaacggaaagcatacgaagatagaactccataactcgataggcacttttgtactcagattatgtcgcaagcaatcaagataaatattatgaaaaattgtttaaaaaatatgatataacatctgtagcccccgactcactagtcaacggcaaaccagttgatgtagtgaggcagaggaaaaggaaaatatcatataaagaagaaaattaattatgacttagctttctagtctttcccttggtgacgaccgaggtggccgatgtgggaacaaagtcatccattaatagcaatgaaaacaccagccatagaagcagcttgaggcaactgacgatgaaagtgaagatgcccatcaacggcggcataataggccagcagtgcagacggaaacaccagtcggcggcggcgaaggccagccagtcggtgaagacgtggacgcccgtgaacggtggtgtgaccaaccaaccatataggcgaggacactagtcggcggcggcgaaggccagccggcggtgaagtcgtagacgcccaacagcggcggcataataggccagcagtgcaggcggaaacaccagtcggcggcggcgaaggccagctggtcggtgaagacgtggacgcccgtgaacgatggtgtgaccaaccaaccgtatagacgagaacactagtcggcggcggcgaaggccagccggtcggtgaagtcgtagacacccaacagtggcggcataataggccagccgtgcaggcgagggcaccagtcggcagcggacgaggcggccggtcggtgaagatgttagttggcaacagcaaaggtagccgacacgggtacatacaaaataaatcaatgaacagatcatctgcttagtaccacgtaaaaaaatataggtataaagaagcttgtgcatgtatgtttgcatatatcaatgcatatacacggcttgcatatattgattaattagccaactaatctcctgtggcatgaacgctagacacatccacacatcacccgacaggtcctgccatgcgctcgcacagatcgcaggtccgagtccagatcaaatccccgtcagaagcttcttgagatggggatcggacacgttcgactagtggtgcatgcaaaataataaaccacagatcaaatagagattagtagcaaaaagaaataaaaaagtatagatgattatggatgttaatcgatgcatgtatgtttgcatgtagatcgatgtgtagaagaagtcggtgtgtcagccagcttgccaggaaaagcattgattagctattaaaagaaaacagatgctttacgatctctatgcatagcgttattaggtaaattgtgcatcttctccatagcttgcatgcatgctcctgtttgcacacgctggctgtgcatgcatgccgccatgaacgttccagtggacatgtgcttgtttgattcgtaaatcaacaaatgcacgaatttgcttctggtcgtcgggtgttcctatgccgaacctgcggcatctccatctgcaaggaaaggagcactcggacacggctaggcgccaaagtaggcgacggcgatggctgtgtctcaattttagccagaacgtgaaaataataaaaataacagtagattaaaaaatcaatctcataaaaataagattggaacgacaaacccgattgaagattagagccactaaaatcaataagattgatctcagcgtttcttctgaagttgattccatcgcacttttcgacgggtaattcgacgcaacccctacctggcgcgccaactgtcgaaacatgaattcggcaataataaaaggggtagcgcacgagacctaaaagtggatggatgcagagacaaaggatttagacaggttcaggccctctcaatgagaggtaataccctactcctgtttggggatttgaatccaccgggtgtattatagatctgacaatcatatgtgctcctgccccctagagggcctcctgcccaccttatataggatgggggcaggattacaagatagaaaccttaaccaatacggtatcggtttcctaaatctattttacaatattatcaaatcaggactttaggccgctccataatataaaaggaaacgtaatacccaagtcatgatttgttacatattccatagatataagctatcccctatgactagtcggataaccatgccgtgtgggtatggggtacccataatctccacaccaagatgttccattctattttgggtgatcgcacattttgttcctactctgacagtgacgatggcacaattgaagactctgacccaattcatgggagtttcgctatcttcactggccttcacatggttcgccctcgtggtaaacatgatgatgtccagatgatcaagcacaagtccatgtactaccaatttttcgatgattacatcgaatgggttatctgaagctcatgattattttgctataagcacagctagcatatgtgccctaaattcactttggtatttgaagcaacgcagctttaatctcatatacatatgtccatgtttctagctacctagtggtctatatatcagagactctacttaattggattggagtagtaattagtaggattgtaagagactcttctaaattagtagtggtttctaagcaattaatatttctaaattaatagtacctaataagtgccacatcactgccacatgcgacgaagacctagtcaaaagaggcacgtaggttccacgttagtcaaaatcggggccaataccgccagagggcatcgtttgcactggttttgtaagtttaagtttggagatacattgtatccgttttacggttcaagaatgattttgtaatttggtgataagaggagggacctctggtgtgctttttccttaaaaaaatggagcaccgtaccactcgagtaaaaagtttgtgggtccatgggccaaagacagctgagcaatccctaaaagcgacgattttcttttatattcactactacaaaacgattttcctgtacatgcccctctttagattgcaaacgaaccgtaactggccgcgtctgcaaaaatcgtactctattttcgtggcgggtccttaagaggaccgcacggaaaaatctaattctgcaaacaacacttaagtggacagcaagcaaaaatgaacctattttcgcaggcggacctcttaagtggaccgtacgcaaaaatacagtttttttatcccatcccctctctctcttttccctctcactcacttcaattttttcaccttctctctctctttctccctgcctttcctctcctctcctctcctctcctccaatccaagcgcgtggggcgcgggaagcggctagctctccgccgacgacgaggcagcggccgagaacaggcgggaggccgtgcggcggttggtgatcggcggccgagcactcgacggctggatccatgctgccgccgctgacgacaacgattaggcggctgggaacgatgggctcaggagcggcttggtggatggcggaggccgtcccccgcccagatttgacggcggtggcggcgagcaggcgggctcggacggtagggaggcgtggcggcggcagatccggcaacggcgacggtgatgacagcgaccaggaggagggcggcgacgacggcttctagggttagggtttcggatttttttcttttttttttttttttgcatgtgggcaacataagcacccactcgcgaaaatcagattttcgtgtgcaggtgcgccacccgcacacaaaaatagcgattcttctagaccctatggcgcgtgcggttagcccttcctcacacgaaaacccctttcggaccgcacggaaaaaaatccttttttagtagtgatttattttttaaaagatttacaaaactaaattaccagttcgaagttatgcagaaatgtactccttatgtcctaccgtaggacaagacatataaaacgagacatataaatcatcctatgcttggacgagaaatgtgacttggcaaacgaccggataggcgtgctgtttaaattttgcgagcaaggtgctgcctctgaaaaggcatgacgaaatcgctctttgttagggcaatctactgttgcaatggcttatctagaaaaaaaaataagttgggtggcaacggacatattttacaagtgccccctcccggtaataaatcgctctgcaggaggatgagtctcacatttcctattctacggtaggacgatttatatggctcaacgcaccatagagaggaggagtatattcatgcaaaatttcaaaacggtaatttaatttttattttactaaaaaaataatataagaaaaaatcgcgactagcaggacccagacggccctaatccgtgccatcgcgctgaggctgagcctcggcagccgccgccatccttcctgacttgtccaaccctcctccttccttcctgtagattgcacgctgcccctgtagatcagcagcttccatctgatctgcatcccggccgactgtcacagattgcaaggaattgaaaggaaatccacatcctttgctgctgctgctgcaggtatgggtttattttgctccatccattgttgtttcgttctattggttggtctggttgctcgtcgtgttttgttcagggttctaaatctcccgctaaactgccgctatctcccgctatagctctttcagaagagtttcagctatttgctctcatgtacaatttaaccgctatagatccatttagcccgctatagctgtttgagaaactaaccgctaaataccttagcctgctatttaaaacattggttttgtttcttttattcctttacggaattactaaaattgtgtctccacaattcttggctgattatagtcagatttatcaacatcatatcgattctcagattcgttctattgcacgcatgcaagcccgttttgaaggccgagttaccaactgctcttagctggcatttttcttcggtcaatgtagtgtatgataaagataaggttaaaaggtagtcacatcaaatttgaactacaattacatgtcacttacattacagttacaccgtattaaaaaatgtaggtttagttctatgtgcatgtaaatttatatttttatctatttttgcacagaccttgcctgctagctttggtttttagctatgcagctagtagttatgctataagttcagtactgtcaaattgtttcatcagtaatgagcttttgttttgtgtgttaccattgttttgtcctggccgttgatctgtaatggtga

SEQ ID NO: 5535 - DNA, 1472 bp, Oryza sativa
tctgtaatggtgaaaaactgactgtttttaggctgaaagtgtggcaacagttatataggcactcccacccaacaatagaaatatagaatcatcccatcagataagaagatcagttttggttcggaaaaagatatggggaggcgatttctgaaccttgtggtggagaacgcccgcagtggactgtattctctgcgccgcatacctgcaaatcatctcttctacccatcaacaagagcagctgaagaggccacggcaaagtcccaagaatcattcaacgcgtacgttaaggagcaccatggcaggaaacacccaggcctccacaccttggagatgttggggaagcttccctctcccatgctcaacttcgaaccaaccccctgggatggccagcgtcgatataggaatctcgagttcgcatctctcctcggcaatgagaacaggatcctctttgccgaccacagtggacataccatcgtctttgacgccgactcctccaccgtctttgcctttcccaacctcatttctgacaagggttgtgcagccatttccctctccatcaaaaacaacaacaccaataagaacattagtggcggcatgtgggatgaagacagcctctacgtgatgtcccagagtgctgaccctgaaaccaaggattactgctttgaagtgctcaactacacttcttcctgtaaggattttcgtgggaggactccctattggagttctctacagccgccgcccttcgccaactacatgcatgccgacattacttcctacactgtggttgacagctccactatatatgtttcttctatggagccagatgctacttatgcctttgacacagtggggcatcagtggcgtcgcctgggctgctggacaatgccattcgatggcaaagctgagtatgtgccggagctcaagctgtggttcggactatccgtcaaccacccctacagcttatgcgcttgtgatctcctctccgatgcagcaaagccacccacggtgcagcagcagcacacttgggtggacctcgacatacctgaatcctggttgccctataacattgacctcatcaacctgggcagtggcaggttttgcgtcgtcaagattttccgtcatatggcagatgactgcactggtttctccgattacgatgacgatgacgcaatggactctgacctgattcaagggaaattcgctgtcttaactggcctacagatagttcgcccttgtggtaaagatggtgatgatcaaggtggtgtccggatgatcaagcacaagtccatgtactacaacttttgggactatgaaatcgaatgggttatctgaagctgagggttttactataaaaaaaatgggaccaatctagaaaggactagattgattttgaattaaggagggggtgaggctcgaacccggaccggctagctcgcagcttgcgttgctagccgggaagaccccaggccttt

SEQ ID NO: 5536 - DNA, 5353 bp, Oryza sativa
gcatcatccgacgaggaaggtgatgtaatgcccactgattggacaaatgaggacttctcgggacttgttatctcagaggaacatcatgtaccctaggaatacaaggataacgaggtaattgagggtgctacgtatgctcataaggaggatatgaaggaggcagtgaagcattgggcggtctcattgatgagagagtttagggtggtcaagtcaaccaattatgtgtatgaagtgaggtgcgtgaaagaagattgtccgtggcgtgttcatgcatataagggtacatggaaagattattggaaagttagcattgtgaccgagcaccagtgccacttacaagatgtcaagaagtatcactgcaacatcaccgcaacaacatcactccagccgcaccacagccgcgacttgccactgtcagggacgagtaccccacgcaccgtgaccgagactacttcatgggggtatgtcgaacttctactcacttctggcaatagtttctactcagttccttcaattattttcctactgacatgctgtcttatgtcttgaataggccgacacggcacgagctgtgaacgccgatattacctcgataatagtgaggttggacgccgggctatacttgagtgatgctgagcagaggattaccttcgaccggatgcaagagaagatgcacgctgtcatgcgcgtcttctcttgttgcagcgccatggacgcggtacctccacctggtccagtaccaccatgtccacgcgcccctagtaccggagttgtgcgacctacagctggttcttcgcacggtactgctccgcccagaggttagttcaagtatatatgatttattctcggtaacatgactacgtcctaactaaatacgttacgcgcaagtccccgtctgcccttccgcgcccttgtcggaggcagcagttcgtcacagagatcgctgatccctcgtcctaacacgcagacgcgagggatctttgctagtggagcctcttcctcacacgccggtggcacaggtcctactgtccggttctacgatgacgacttgcacggggcgccagaccaggagatacttgggtcctcacagcttggtggagctccgaaggcgcacacccaggagcagccactggtcacaccagtgcaggagggtcgagcaggccgtgccgtaccaccggaccgtctgacgtactcccagggacacgttagggcgcagggcaggagggaccggggtaagaggcctcggcagtagtgttccacctattgagtggttgtgtgcacttttctttaggcttacttttgctgtgtagaccagtattacttttgctgtgtagaccagtattacttttgctgttagtactacggtaccattgccttgacgctctgctatttcgttccttccacatgtccactgctacaactattccatgcgtacgaagcctaactttcggcgcgtgacggtccagtccattatagacaaagcgttttgtcgagttgtcagcatcaactttgcaccacagattccgcacgtgaattaattactgcatgctcgcatgtgctcgtgtcatcaatacactgcatattaaaactacttacgcatacgacaacaaactttcggcgcgtgaagattggctcctttaggtagcgcagcaaaccacagtacacatataccttggtagttcgagttgtcactatcatctttcagccctgttctcggagataaagtgaatgatgctcacgcgtgcgcgtgttgtcacatcaagtgggccagatgaacaaaattaagtccagttatagcactagttgcggccctatataatagacaagccgaatacaagctcttcaaatcatctttcatcttcccacacatctagagagaatggaagctccatttcttgagcgtctcaactagcgaagcgatcctttcgccggttgatttccaccatggtgtgaccggccgttatgcacttgtggggatcgatgcatacttaagtcaagcctcatggtagaaactcggggcaggagattcttccaatgtgcaaaccttgatcaggtatcattcattcgttacaagttcaattaactatactgaacacatcaaaagctaacagatttctactccatcataacatcttacacagacataccgtacattgtgcaactacattgagtgggtagatacagagaacccacaaaatgacagaacacgtccatatgcacgtagtgaatcaagatcggactacctcaggcggaaggatgagcatgaacgtcagattgctgcggaagctttagaatggcaagtaaaccccctaggactccccacatggcgggaacgtccagagtgtcgttgtggtgaccgttgtcaggtgataaggtccgtaagacaacgaactcgaggacaaagatgcttcgtgtgtcctaacattgacgacgacgatttcgtcgtaagtatcttttttttgggtaccactaatcactactttcatgcacttacctctatttacacaaattttaaaataggaggaggttaggaaatgtcaattcgtacaatggatcgatacggtcagagttacttccattggtcaaacgataacgcaacctgagacgaccacgcaattcataacaggcatggatggagtacgaacgtcaggtacaaattgcaagcttagactggaggaacaatccattaggtttacctaaatggtcggagcgtccaaagtgtggttgtagatatcgctgcctggtggctacctcgtttgcagaacaaacaattggcaggagatactttgtctgccccaatgtagacgacgatttcgttgtacgtataacaaattccaaatttaagtagaatctgcttattattactatcctatctgaataactatgtttgtttctcagggcaatccaaggaggtgcgcattcattatggatcgacaatgtcaatcctacatatgatggccaaaagataactgagtctgaaacacaggtagagtactagcgagagaaggaccatcaaaatgcaatacatgttgaacgacgcggaaggagtcggtagataagctcaggctcaatttgtcaggaccgacaaatttgtatcttttatccatgctatcttgtcattataatgtttaattactatgttgtgctgttgtatgtgtcacgaattataatttaatgtgactatatcattccgatttctaaagtttctttgacgccatgatatgttgtatccttataatttatatgtacctgcttatatttttataacttccaccttcaattgtgtacatgattcaacatacatgacaattatgcgtaacttgcaatttataggtaacaaaccccctcatagccctccaatttatatgaaaaattgagttattaaaattttgtcaaaatgcacgtactttgttcgtttcaaaatgatactttacctaattttaactgctaaaaatcaggtttatgtaaaatacctatttcgtaaaattttaagtgcaaaatagttagatttatgtagtttgaaactattccttcttcgacttcgaaacaatgatttatgtagtttttacagtaacaattaaatatttcggtgtaaaaacaccccttgttgggctccaaaccgccgaaacaacgtaccattcaattctaataatattttttcttgtttcacaattttaaaagtgatgatttactaaattttctaaatgcaccgagctaaacacctaggggctactcttaaagctggcggcacccaacacagtaccaaaccgcccttcataagggcggcaagggggccgcctgcaaaaaaaacagggtcctcgccgccttttgcaggcggccccccgcacagtactaaaccgccctccgtaagggcggcaagggggccacctgcaaaaaaaaccagggtcctcgctgcccttttgcaggcgccctcccccccccccccgcacagtagtaaaccgccctccgtaagggcggcgagggggccgcctgcaaaatggcaggccgcctatagacggccattagtcgtgcgctaacggtggtcagccacgtcacgaaaatcgccctttgggagggcgatttttaaatatcgccctcctagaggacggcaggcgactagttttgtaaaattttgaaacacaaaattacttttgtgaatattttaataaagaaaattaaaaataaaaaaattccccgggtggaagtgaaaggaataagttcaccggaggtccctcaacttaacagcgagattttttgaggtcccttaaccacaaaaccagaaatgtctactcctaaacttactcaaaccgttcaccggaggtccctcgacagtatttttgcccggttctgctgacgtggcatcctagtcagcaaaacaaaaattaaaaaagtatgtggagcccacatgtcagctgcacatcttttttcttctccttctcttctcttttcgcttctctcctctctattctcctccaggctggcggcgggctcagccgcgatggccgagcgcggatgcgggcggccggcgagcgcggcagcagagcggtggcaggctgtgggcggagtggacggcgggcgagcgcggcggcggagcggaggctaatgggcagagtagccgcgtgccgtggccgccgtggtcgtcggctctccaccgtcgtcgtcgccgtgggcgaggctacacggcgcggccattcggcggcatcggccaggcgtcgcagtggccgtgcataggatgctcaaagtgccggctgacgatgcaccctagtcgctcgcactcctcctgtgccgcggcagtggcagtggtggcggtggcagcgccgctagcctgatcccatggtcctcccggacgcccagctcgcgcagctgcagcaggagcgtgtccacgctcggcgtgccatcggcgtcgtggacggtggtcggcgcgggcgcggtgaccctcgtcgtcttcggcgacgtcgcggtagcacttgacgtcgtagctcatacgcatatacgccgggtacagacggccgcgtgtacatgcgtcttcgtacgagcatatatatgcatgcatggagacaaccagctatagcctagctagcttcttgttggtttgccgcccgataacatgcaaccgtatatattagccaagcatgtgtatatggctgagcacactcacatgtatatatgccattacgtgcagcggaggagcacggatgcggggggcgagcgcggtggccagcgagtttgggagggagggggaggtggccggcgaccaagaaacaatctcttcctctgcctcttccccttctcccgccggtggtgcctctcctagcatcatcggccacccgcgggggcacagcggtggtggcgg

SEQ ID NO: 5537 - DNA, 3640 bp, Oryza sativa
aagaaaaacatgtgcagctgacatgtgggccttacgtgtttttttaattttttttgttaactaggatgccacgtcagcaaaactgggcaaaaaaaactaccgagggtcctccggtgaacggtttgagtgagtttaggggtacatatttctggttttgtggttaatgaacatcaagaaatctcgctgttaaggtgagggacctctggtgaacttattccgaaggggaatcatctcttccttatcgtcttcatcgcatcagttgagctgccagctgagctatggcttctctccgccacggccacctctctccctccggcgccactgcaccaccctcctccttcgcccaactccgccgcccttcctcctgcctcgccggaccacgacctctccgctctcgtctcacccgtatccttccttcatcctttctgctccccctcccattgtcccaatgctgactgcctgaatactactgcttgttcctttctttcttgcaggggtgtacgcgctttccagcaacgatatcagggtgggctccaacctcgaggtcgacggagctccctggaaggttcttggttcgtaatcgtatccactcacaatctcatcttctttggcggtgtttagttcagcgcaaagtttggattttgattgaaattggagatgatgtgactgaaaagttgtgtgtgtatgacaggttgatgtgatggaaaaggactgaagtttggatccaaacgttggatctaaacacagcctttcttcctttctgctagtactaaacatacctgattcctggttggagtctcccagtggatacagtagctttgttgaacatacctcatgtagccacaaatttcattatttcaaggcacattattatctgcatatataggaccagatgggggggacgaaagctgctaccttcatttctttaacacattttaggaagaataacaactcccttttatacaactgcaatccatgttgttcataagcaatgtgacactctagtgctataaaaaacaactattttcttggttgttgcatccactgtttcagaagaattacctcctttcatacctttcagtgtgtacttgagcaaatttgcttctgttggttcgatttttcaaacttcacatatagcttagcttgccacaatatgtgaatgttatttgctttcccaagtattccctgcttttcagatcactcactgctatgtttctttcagttgctagaatggaatggtaaagcatactctagtacctataaaaggagctttaagagttccatttgttacgtttgatttaaataaaattatgtgtttttcaataaattccagacgaatctatatctgtgaaaaaacaaatgttgaaatgtcatagagtattctgacagatgtatatcatttcttgccatctattgctcatctattccattttactttagatgctcgatataagaaatatcatataaaactttctgtcttcatgcaacaacagaatttctccatgtcaagcctggaaaaggtgctgcttttgtaaggacaaaaatgcgtaattatatcactggcaacacagttgacaaaacctttcgagctggaagtacggtaatccaagcagaaactcacctttctaaacctgtagaaattactccctccgtttcaggttataagacgttttgactttggtcaaagttaaactgctttaagttttaccaagtttgtagaaaaaagtagtaaaattttcaacccaagacaaatttattatgaaaatatattcaattattgatttgatgaaactaatttagtattatcaatattactatatttgtctataaatttagtcaaacttaaaacagtttgactttggccaaaatcaaaacgtcttataatctggaacggagggagtaccattctgtgactgtatcagatcatgctttagcttatgtaataaaaaacaactgatatgatactcatcaactctccttcaatgtgttctaacaaagaagagcacttattttgtcacttttgttttagatcccagaggcatccatttcaaaggaaactaagcaatttacctacaaggatggagcccagtttgtgttcatggatctggtacatgtttcagtttttcattcaaacatatcatgaaaagagtagtcgctagctgtctgtatgcttcagtaatcagtatgcaatggaacacccatgtttgaaatttaagcacgtgctaaccatatggtatatggtactatagaaacatatgaattgaactcgctgatttttacaatgtagaaactactggtagaagtatcgtttaaagttttacggacagtcggaagttttacagacagacagtcaagttttagaaacatatgaattaaacttgccgattccttttgtttgcagcaaactgctgccaacaaagaaggcaaagagaatgaatgggtcttttatggtgtgttccccaagtgcataatgttacttatctttataattttcctttccagactacctttgaagaaagtcgcttaaatgagtcagatgttggcgacaggcagaaatggttgaaagaaggaatggactgcaatttgttatactggaatggacgggtatttcctgttttgtttttacataatctgctgtccaaatccaatcaattaattggctgttgtcagttcatatgttcctattttgtttcaaactcttgataatgtgctgtttgattagttatgtattcttgcacagaataggatattggtcactgacattaatatgtcctgcagatcattgattttgatctccccatcaccgttaggctgactgtaactgatactgacccagggcaaggtgacagtgcacaaggtataactgcatgtgaatatcacaattagaaaaaaaatgttttcttattaaagctgacacgatcagaataataatcttttaactgtatattttgtaggaggaacaaaaccagcaaccgtggaaacaggagctgttgtcacagtgccctcgtttgtgaacgtaggcgatgatatcctgattgattcaagaactggcagtatatgaacagagcatagaagagatgagagactagacatcaacagagcattagtttttgtctccccatttttggcccattccctcccctcaccaggtttgactgtattgtttacagcatttgaaccctcgacaggatcaaaatgctttctcaaatttttgtactgcatatgtgcgtacatatttcaccagagcagatgattaatgagccaaacacattgtaagatccatcatccatctcatggcattttcacatgtctgcacactcaagccggggttccgttctgaataacatcacaaggaagctagagttttgctaccgatgtacaccccgaaaatggcacgtgacttggcgacagttgagcaagcgaatctgcagatggttagtgatgaaacagaatgagaagctgttaccaagaaaattctctctatctcaatgcacacatttctgacccttaagattttccatgtcctctaatataagtgactgtatcgtacaaagaagaatgctcactctgggactaccttgtgtgatattggcattgtagtatgaatcctgaagagaaatcctatggcctttccagtgat

SEQ ID NO: 5538 - DNA, 6138 bp, Oryza sativa
tcggagatcgaggtgctcaatgtctatattaattatatggattaccgattgcaaaacaaatttaggtatcatcttattcttttttatgttaaaagctaaagttagttagttaattaaatttagctactgagtattttttttacaagtcaaggttgtgaaggttttacaaggaagctcagtacagatggcagggttaaaaggaggaggaaaaatagaaaatacatcttgccaacggagagctacagccctatatattcttgttgtttgaggcgctcagcacatagccgagcttaattcctgcttgcatcctcgcggagtgttggagatcgaaggctgctgattaattacgaaagttgttgacatcatgttgattgttccagagcgatcagcatctagaataattcatccttatgtagatctagtaaacactttacgtaggataaaatcgtcatccaaaccatcgtgggaatggattttcacagattttaatactggggttttacgattgaggaatgggaatgaaactggactcataaagtgaacttttctttcagtctgtcgctccaaccaagcgtgcaaacaatattcatatttggacaggcaaatcaacatgggccgcaggacacacattatgggccgcgcttgagccccattcccgtcccaggccagcccagacttataggctgcacgcgggctaagggtgctccggcccaacagatacaggccgcgctccagctggaaaacgacggtaggatgcgattgcttagtacggaccgacgattaaagttgattgatttctggaggcaaagattttacttgaaaacattttactcatatatatccctgatctttgcgctttgactgacaaaacaagttactatatattactattgttttattttaaacccagtgagacaaacaagttcagcagcatccagcattatattccagttaggtgctaaaatactgtaaatcatcaccccggccatgaggagtacaaatgaagaacatgccagaatctgtaggagcattatatgtagattagcatatatgtatgcagatccagctaatgaactgaaataattgacaagatgcattattaaaagactcttcattggatggatatatattgaagcatgcatgcatgcagtaaggtacaatgcaagcaggtcctctaaaattcatgcatgattcgtctgcccctcgtcccgtaaaggagacagatcaaaatcaaccctcacactcttacactagctataacgacgactatcaaaccgcgacgaagcaacaggtaagcagatagtaacagaacggaggagtaacatgcatttctagctcgatctctctgacgacgacgaatattgcagatagcaaccgcaaaatgagagccgcagatcgatggatccatctctccattattattgtggcatcacttgacgttgatccactcagtgcaccctgcatgcgaatgcacaatacataggcagattaacaattaatggttaattaagctgcagctaatagcacagatcaaaatcgtagtagtacgtagtaaatatcatactgatggtaatcaactataatgaattacctggagcagtcggtggaagggctgatagcgtaggggatgttgacgccgcacttggaggggatgccggcgaccaggtcgggcctcaggccgcccatggcgctggtctgctgcttgaggcaagcgcaggtggtctggcggtcggcggtggtggcgacggcggagttgagggtcctgaccccgtcgcagcagccgccggtgggggcggacaccctccccgtcgcgtacatgatgcacggcgccagcatgctcaccacctgcccgcatgtcaccgcgctcgccgccggcgccgccaacagcagcgccaccaccatcaccgccgccacatacttattattcgccgcgcgagccatcgatcggtcacacgaagatcaagttaagttgctgcttaattagctaagcgcagtactatgctggagtggagtgtggtgtgggtgagtgagggaggggtagggagagggtttatataggggttttgggccaagccggagatcgatgatagacctataagttggagttggttttcatcctagagagtaattagtgaaatcatgcacccacgcttatgtgcttcaattcccggtaatttttcaagaagcgcagtgtttcaatcctagagaaaagaggacttccgagtccgagtgtccgacacatcagttgataccttacacgtgcagttacatgtgcagggcggtggaaagctaaaattaacactgcgtgcttttagttaactgtacatatgacttttgatctcatgagttggtggttgttgagttgtttcatttactacttgccaactttaatttgcagtaccccaatttaggataaattcatggcacctgcatccagccatccggagagagtttataaataagtactccttctgtcctctagaattttgacattttacttatattgtttgaccattcgtgtttttcaaaaaaattgaaattattatttattttatttgtgatttactttattatttaaagtactttaaacctaactttttgtttttatatttgcacaaattttttaataaggcgaaagggcctgtagcctagtggttacaagagcctcagtagcacttgaggtcctgggttcaactctccacgggagcgaattttccaggatttatcggtattgtgctttcagtggtaggcgacgtacccctagacagcgagacgcctgtggtgacttcgtcaatcttaaggatttgctagctcagtcttcgaagatgttcatatgggtagtttaataagacgagtggtcaaacagtacaaataaaatgtcaaaatcccttatattagggtcccttatattaggggacgaaggaagtatatgtatatgctattacagcggtttatgtatagtgtgagctactacgagtatttgtggttaaggatagtggaacatgcccataatctagataaaaacgacatgcacaagcagccatggattcagaaaccaacgtgtatacatattctgccctgcagaacagtaagagttcgaagagagaaacaaagtatacgtacagtctccaatattacaccataacaacagtagataatttacattgtgaatagaatattgcaacagtaatgacttaatggcagtatcatttttatgtatggcgtatatacaaaatacaattcacaagcatacatattaaaagacaggtctttagaaagattgacatttgacacgcagcttcaattccatctgtgggcaaacagagcaatgggtactccactgttgaaggaatccatatttattgaatgaaagctaccagcttcatttatttgtagcctatcgattgggcagatggatcagcagctacttcgcaaatttctcctttcatcagtgtgaccatacagatacagtaatgtgcagtgcttggtcctggtgcagagctatagcagcctgcagcaacctgatcgatccattaattcatccagagacgtcgcctagcaacgtatactactctgttcatttgatcctcatctcgataggtcagataaaacctcgcatgcacatgaatggcatcaactccatgctcctaatgtcaccaaccaactacatgcctgaaataagaaaatgatagggagtactaattaatttatatggaattaaggagataagattagatatgtcaatgacaaaggagattataatttataagattagtcattttatataccttcttgcccctaatattcagctcttactgagtctccagaactgtttcatttgtgcccatataaatttccattgctccatatacaccgaaacttaaaacttttactggaatgtcgttcaccagcattgtatagcaaatattacagttaccatctggcaatcttaaaaatgaagccaagaaagaatgcattctgcaatcctatttgtgtttgcccatctggatcagcttctcgagctcgtcaccatggtatttaacttccaccgaaatactacttgctttggtacttgctgaaaattccacctttcatgggctactgatctagcgaagcgttcgcattgaaatcacttctaggcagagcacagagttcaacttcattctccttttctgcatttcagtagccaatttagccagtgcagtttactgacaacagacactaagtggagtagacatccaaaatttcacatattgcaatggaaatggatagaaacccaatattttcattttgtctgatgcatgttgggaaacaatgcacttctccaaagtcctaaccacaatgattgtgacatactcaaaaacgaggactctcagtggaaaaatccaaggcatttgatggaacaggcacatttcagcacaagaagaaggttatctcccatctgctgtgcatcaatacattaatagtttaatacgactcaaagttcttacgaaattcacagttcagcagtcttcactttgagaattagcagcagtattgtcctaaacatcacagaaggtaattttagaaaatatgaaattatgaataaacaatattcagatagataaaaaagttacttgagaaacgtgaactcacccgttggaactacagtctagaagtggtagcaaagtggacttctggaaatgaagctgaatattacactgtacagcttgcggcgggtttattggctacctaaaattaacttggctgtttgcagcatgctttgaggcattgtatctgatcatctctgttctcagatactcaacttcactccatctctgcttctgcccaaacctttggtactgagtgatatgagtgaaggggcaatgatgtgagcaattcttttgctgccagttattcatgtctaaaacattcaattagcccggaagtcatgattcagtttcagaaacatttgttgttgatcaacaaaaccattcaagcaacggtatcggttaattttcttgtgccatcacacatatgtccatctggaaatcttaagataaacaagcatgccataacaatagttataatttgcccttcttaacccttctgtacttaaaatgacttgacaccaacatcaagataaaaatgaagctaccaacattaaaattattggagctacagcccagcaaaactcaagagctagggcttctagaattaagaatgatcattatttcctatagtttcaggcagatgtattgcttacattacgtccatttgactatgtgcagcatgcttcaaagcactgttgcatctgaccttcattctcagatgctcgacatcatcccatctcttcgcttctgcataaacatttgatattgtgacaagtcctccattatcagttagaatcaactcacgtagttcatgaaaaaacatgtaagcaagatcgatgtgcccatgcactcggcaagctgccaacaacatcttccacagaacagagcttgctgttgaagggttttctttaatcatcagataagcttcttcaatttttccatagcggcaaagcatatcaatcatgcagccataatgcttaacatcaggaacaattctgtagtcctcaatcatgctattaaaatatttcctcccctcattcactaggccaccatggctgcaggcggtcaagacacccaaaaatgtgacaggatttggctcaatcttcatcgaatcaaagagctctagagcctcacgtgagcagccatgcacagagaaaccaacgatcatcgcattccagcatgtaatatccctcatagacattctgtcaaagaccttcttggcaagatccaacatcccacattttgcatacatatcaatgagtgcattgccaaccaagccatcagctacaatgcccttgttctgaaggtttctgtggatgtttgtccccaggtccagcttaccaatctttgcacaagccccaaggactagtacaagtgtaagctcagtaggttgaatgccattctcctgcatttcttgaaaaatccccaatgcttgggtatatttgccgagctttgtgtagccactgatcaaagagttccatgatacagcatccctctctggcatttcgctgaaaatccttgcagcctcatccatatacccgatcct

SEQ ID NO: 5539 - DNA, 3700 bp, Oryza sativa
ctgggggagggcgattttatactgtgctttatatttttgtataaatatcaatagttatcaaatctttttatattgaaaactatacaagattaaaatctccaagactggtaaaatataattttattattttttagggcctatttggaatgttactgtacaaatattttgttagtgccaaaatataagcaagttttggcactaccaaatatttggtaaggtaaaattgtatttgatcatatttggtttgctgccaaaatgtaaaattgtagtgaagaatgttctacataatctcaaatctagattacgtattaccaataaataggcttcaatcgaaatcaaacacaagtactattcaaattaccaaaatattggtagggcatgtttttggtagcaatccaaataggcccttagtcatacgcaccactgcaatgtgcactctctctaggaaccagtaccagctttcagtgttctcactctctacaaatgcaaaagccataggtagaacctggttgttcccatcacacccaattgctgtcaatatctgacctcagtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaagcctttgcatagcttatggtgtacttgaatttgttctcgatgtgcctaataattgattttagttcaaagccaatgttaccaacaacactgttgtacatctcacttgccacaaaagctgaagtgatgtttcggtgatacttctccaccccttgtaagtagcacttgtgctcggtcacaatgctaactttccaataatcattccatttacccttatatgcatggacacgtcacggacaatcttccttcatgcacctcacttcatacacataatttgttgacttgaccaccctaaactctctctgcaaggaaactgcccaatgcttcactgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcctttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgtaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaactcgcatttctgtactacgccctaagttacattctctacaatattgttctccaaaattctaaaagtaggttacattctccagatcaaactagactacaatcttacaattaacactactgtgtaggtctcaattaatgctattatattctatgctcgggatctacacatatgtggtgtgtgctacagatatgataaaatatatggaacgtaaaactaaaacgcaacatatatactcaaacataacatattagtacaaatgcaaaagatgtatgggagcaaacctgtgatgaagtgagcgaaccagcagggcttcgccgctccccttgtgctgccctcccctctctctctttcgttttttttggatttttagtgaatataatgaagtttcagagaggggggaatggggtttatagggggaggcaaaaatcgccctcccccagggcggcaagggggccgcctgcaaaattccatgccccctcgccgcccatttgcaggcggcccccgcacagtacaaaatcgacctagcggagggcggcaaggaggccgcctgcaaaattcaatgccccctcgccgcccatttgcaggcggcctcccgcacagtataaaatcgccctagcggagggcggcaagggggccgcctgcaaatttcgttgacggccgtcgcccgagagcgaacggccgtctgccacatcattttcgccgccctctgggagggcgattttcggtaggcgattttcaaaatggaaaattatttttgtaaaacttttaataaaaaaaattaaaaataaaaaaaattcgaatggtcgcagggggaaaggaggaaccgtggcttgaagccgcaggcagagacagcgtcttcttctcctcttcgtcttcgtcttcctgccgccgccgaggagccgagcaaaatacaataataatccatcatcggagacgagcacgagcacgagcacgcgcatcaatcatcgtagagtgactcatcggaggaggcgtgcgcgaacaaggggagaaaattccacctttccttttcttttcttttcttttcccccccttgtattctcttattattaaaatcccaaccccgtaatccgtaccccacccacccgcgcccatcgccggcggcgcccagatcgccaccgatcgcctccgccggtgggcacctcttccgccgcctcctgcatcaccttaatccctcttctagcggcggttgctccacgtctccggaggagggagggagggagggaggaggcaactcggggcgttggaccgggctcccacggcgacgcccatggttgacaaccagggctgctcgccggcgctcgagcccgtgcccacgccgtccaaccccgacccctcatccatctcgcaggaggcctgggatcccctcgaggccgccgccggagccgtcgtcgcccggatccagcccaacccgccctccgaggaccgccgcgccgccgtcatagcctacgtccagggcctcctcaggttcaacgttggctgccaggttcatctcttactttgctcacgcctgcctttctagtattccgcaataactactactctacctttcctttgtgcgtcaatggcatgtccacaacacctagtatgagcttacatgttaatcttattcagtcatgtaattattccctctcgatcatttctatgtagacagctgctctggggtgtttaggaggattcttttattactgtttcacatgttgtttctattctctctttggatatggaaatgtagtcaggacaacatgctacatacattgttgcctctgatttggctaattaccatccttggagtttcatatacctacaatgtgatgg

SEQ ID NO: 5540 - DNA, 726 bp, Oryza sativa
cacttctgtcaattttcaaaataaaaaattatttttgtaaaacttttaataaaaaaaattaaaaataaaaaaagtttgcgaccattcggtggcctcgaatatctcgtgggctttgtttccttggcccactaaccaaaccacggcccactaggagagcccaccaatgcattccacaacaaccatgaccgcctcctacctccgcctcctgcgccgcttccctcgccggagcgccgccggcggccaccagctccacgcgctgctcgccaagctcggcctgctccaccgctctgaatttctctccgctctcctctctcgcctcccgccttcgccgtcggcgctctccctcctactcgaggcacccccggccgtcctctcgccgtcactcgtctgcccggtaatcgtcgccttctcttcctcccaggccccgtcctccgcgctcctcctcttcaatcatgcctcctcgtgctccctccccaccccgcttcccaccttccctgcgctactcaaatcctgcgcccgcgcattcaaccacagctctcgcgccagtgccgcgtcggtcttcgtctccaaggggatggagctgcattgccgtgtcttgaagcttggctgcgggaaggatcgctatgtgcggaatgcgctcgtctccatgtatggcaagttcggtcgcctcggggatgcacggaaagcgttcgatgaaatgcctgacaagaatgccgtctcctggaa

SEQ ID NO: 5541 - DNA, 1122 bp, Oryza sativa
tgtatttggccacctttccggccagagccaactcggcctgctgtttgttgccccgaggaggacaacatggagacgatcgtcgcgcaggatgcgcttgtaatcacgtggaactcgtcgccagacaccgcagatcttgcccgtggcattctgatagacactgagagtgccgcaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaatgcatgggt

SEQ ID NO: 5542 - DNA, 20353 bp, Oryza sativa
atatttctcgtcatacaagtcatatactcatattaaacacaccaagaggtgaagataatgataaatcaattcagtaaattctatcctatcctttaaagtacctccatgggtttctccacaatctgcatgtataagcgcctttaaggtggcaatacaaaatcaatagcctttcttataataatatgattaaaagttattttttttctaataaattattattttaagattcaggttgactaggtcttttcttcaaaataccgtagggtttcacatattaaaaagaagcgctatacaagatatgtatatttgatcaattaaaaagaggggatagcaggatggttaaaaaaaaacttacgagcaataaaagtttctcgagacttctcaaggaaaaagtaaacaataaaaattcaattaaaatgaaaaatgctttactttaatttcaacttattttgttagaactatttccaaaacaaaataatatacatgcccgcgcgaatgcgcgggctaccttgctagttggtagtaaagcatgatggtttgttttattaactaactccaaagtccgctttagcgcattacctttggcccttttgctctactaaaactaggcggtaaagaaaagaataatcttttgctatatgccaggattccaatgggttgcactccgtacaaatggaaccggaggatcgaatttgttcgatgttactgttcgtgatatatgacctggaaccatatatttttggatgaatgtagtactaatttttaaagaagtataaccccattacctttcgaaaaatcaaaaccttcgtaggtggatgtctcctgaatggcaggaccattgaacagggtggttatatattggtggctactatattttaggctaaattggcatgccaattttggtgggcccaatttttaaacaaaatctgacaaaaattggtgcctatgacatatgaacaccaagtaaagtttttcaagcccaaatgtgtaatagcaacctaacaatacagtaagctggtcaaacttccttatcaaagatatagcaaaatgtggctactactaaccaaacatccccggaagtgacaaatgtgccaattaagtagattacatgaactagctgctaaccaatatgttacgcggttatttgttatttatattttaaaataaaaaatatttatgttttaatgattttgaaattcgtaattaataacaatcgagttatactcggcctataattttagttgtaacagttctatatttgacaagtctagctaatatttagaataaataaaactagtagattgtattcatattggagtctcaattttcataacatgcatatatatgggtttttacgggatccatgatatttaatgcaaacctaccatgatctatataatcaagtactactagattttttttagttgatataagagtttttatggcgttcacgaaaaaaagtaagagtttttatgatgtgttcgattaatttaggtgtagtagatggatgtattatttggtatcagaataattttatagtggacatgaaggtgggggctacgggtatacggtcttcagtcgaagtgatactgtacgatctactgtatcctaattcttacaggtaactgaaaacttcttggcaacattagagcaccactgattacgttgatgagcacggtactgcagctcagttgcaaatgcaaattctttatgtcaaatactacaacttctcttatttcttccagatcaagaaaaaaaagagttaagcaaaggccgtatatatacagcacagcatacaaatgaatacctacaaacacataccagttgcacacacacgctgctgcagtgtgggcaacggaaaaacaaagcctgtagtaattcacaggcacacgagctagctagagctagcgctcgagccgatcttcaataatctccaggacggctgggtagacgcgcagggctgttcgccgccgtcgatcgagctgaacacctatggattatattacgtgtgtacagcaaacaagccgatgccggagacgacatatttttttagataatagaaatggattacatctccggcttctgtcatacacatagccatagccggagacgacacatgccgcgataatatttctaccgggcccagaccgggatgccgtgcgggctctgccgccgctgcggctgctgctctcccctcgcggcggcgggctgcatcttcgccctcttcttcatcatctccgacgcgtcgtcggcgtcgatctggcgctgcctgcactcctcgctgcagaacggggtgtcgcctctgcacgcgcgcacaaagcagaaaaccaccggtcacaaaccagaacgcgcgtgcggcaagctacaacgtacactacaaactccatgcggcgctcacctgtacatgaagatatccttgttcccggcaagcatccgcccgcaaaggaagcaggcgtcgaggtagtggtggtggcgcccgcggagctcgccggcgacgtcgacgtcgcgggacgtcgtgcgccgggggctcggcgacggtgagactgactcgaggttgccaacgggctccaactccaaggtggcggagaagtagaagtaatcctccatggctcggatcggtggcctcttcttaacttgctgctgcttcttaattggttgcaaggggggagacagagacagttgagatctctgggctgaagaggactgtggttatatagaggagaggagtgaccggagtttcagtttgcctcctctgagtctgttctcatctagttttgttagtgtgttctaaaattttggcggacgatgaattacggatgaaatcaattatttaatgacacagatgaaaaaattaaatactagaaaattgagagatatgtttaaaaataatctaaaaagtgctgaagatatatatttttttaaaaaggtgacattcaataggtcgagaagtgcacccacaataatccataacccctgttctgaatggcttatggacaacggattattgccggtatgttttctaagcttttaaacggtaagatcttctttttttttaaaaaaaatcatcagtttcttagtaaacgtttttaatcaacttatcaacttaattaatttacaatatatacagctcattagttttttcttttagataattgttataaactcggtttcattcaccatccatcagactatcactatttttgaaaaaacccttggactaacaatagattgctcttgtcgatcatctctccagcagtttttatatcattgatgctcttcttagctgaacttgttttaaatacatttgatccgtgaacgtgtatcattaccagagtgacgataaaattaaagatagtacagaagaatgataaaaagacaaattattaattacgtccgcggagactttgcattaacgtagaaatggtaaaaatcaatcctgaggtcatgcataacgcatagctgaacattttattatcatattaaaaacaaccacgttcgtatgcatgtggcgttactatgatcttcccttgccaaaagtgaaaattatattgctgcaggaaaacgacaagctaatcgtaaactcattgtcccaattgaagtctttgttaaaagcatggggagtaagatgtaagaatacatccatcctccaacgaaaggttggatcctccaaattaaagaaagcaagacagaaaaaaaattgtggttattaccaggttaggcatctagctggccaagtggcaacaaatctaaagctggctcctttgagtgctatgtggcgaatcaggtggccgagcaagagcaaaaccagggcgcagggtggcaattggcatggtcttctgatgatattataaggagcagctacacctcgtgggctcacgacccctatattctatgcgttcgcccctttccatttctcggcccctttactttgtagcacacggcccgtccaatttgatggatagaatagttttgtttctagaagtcatcacttgctcctggtttttgggtggttttgtgtgttgagcagtgcagcatgcttgcttggaacaccactaacatagttgaattagtatgcaaattacatgtttaacttttgttgcaagtgaaataaactaagatattttagtcaaacagataggtggtcagccatggcgtaattctgtattggaggtcaaaaaatcctacaccctccgtccaagttcatttctagcatctctcatttatctcaaaataagtttactttttataatcattgaatcagaatatataaaagtagaggataattatattaagagaaaattcatgaaatgccattgacaaacactctaattccagaaatgccattgacaagcgcaacttcctcaaaatgccatcgtacaagcgcttttctccccgaaatgccatcacaaccatagtgctgttaactcctatccgttaagttgtatgaaaagacaatcttacccttgggcaacctttttgctaaaacaacatcattttgtattgtttgctcacagaacattattttgaattgatgcatatttaaattcacagacgtgtattattttgctaccaatcaaattatttcaaaattaaattcacaaattttggcatcaaaattatttcagaaattttgctatcaattatcagggttgtgatatgagcaaaaataggggcatcaattatcagggcaatacacacagaaagtaccaatcatgatcaacatgaattttcacaaaataaagggttcacagtacttagcatcacaacccaatataaagagtacttagcatcacaacccaatataaatggttcacagtacttagcatcacaacccaatacaagagtactttgcatgcttaatacatcttagttcagacaatacatgtgacagtaagaaactcaatcaattattctcctcttgcttctagtccccattgctggactactcttcttgcttctagttctcattgctagactgtcatgtggtacttcattattcttcctccttttggcaggtagagtagtaggttgtactgttggggatggttttctcttgattttcttgtctttgtcctccttcttccccttccccttccccttctccttccccttccccttggcaacaggtgcagcaacatgttgtagtggcacaatggtcatagagctgaaaaaaaaagttatttagcaatcgatttaagttggcattaatcaagtgcaatgggtacagtaaaaaacaaaaatggctaccttggtaaggatggcaaaggctcattattagactcaagtccagaatcactaattgtcccaccaacggcactttaaaatcatatattacacattagttaagttgctgcagcctaggagcaataaaaggttaacaaagtggaaagtggaagatagaaatttcaccttgataggctagccaagatttgacttgacatagcagtaggatcaatgttttcagtggcaacagtggcagcagaagtagattttggttttgatttccttttcagttttttacaagaaaatgaaaataagcgaagtttgttggcaaaggaaatcaacatgaagatatggatatagaaatcacctttgttttgccactaaagcataggcctctttggcttctggatctgcttctttgcaacttgtccatctatggccataatttttgtagataggacacttttgctgacatttggtacctgcttttctcttgcccttcttattcccctcaaccccacctttgtgccttaaagttttgggcctccctgcagaactcttcaatattggaggataaagaaagaaatcacgtgtattctttggccaatgggaaatgtcagttagagctggaatgcgggctgcatatgtggctttaaatctggccacactatagcattcatcaacataatcatgcacctgcacccccctaatagatgtgatgaagcacaaggcatgagcacaagctttccagacacttgccactctctacatgtacatgtcttctcttcaagatcaactacatgcctcttaccaccttttgtgaaaatgcaataataagattatgtccatcaacattaataatgggaattgcaagtataaaaattcaatacgacatacaacataacattacctgggtctttatcagtaacctcggcaatgaaatcatcacttctatctaggtcaaagtttagtcctctacttttctcaagaagctccttcatgacacaaggtagaatgatattaccttccaatttggctaccaccttcttcctcacacgaaatttatccatcaccttttttctaatcttatcaaccaattcgtatggcataagacctttatgctttctgatccaattgttgaagcactccgctaaattgttggtgatgtaatcaaccttagagtgcgtggagaactcgcttcgcatccataacctacaaaataagcaaagacaaaatattacattcaacttcagttcacgtactgaaaaaacaagtattcgactaaaaaaagataccttttgtggtgggttttcaagtatgctatagcttcaggctttacttcacctattgaagccatgtgttcatcgaagtctataggagtccatgcatatgctgctggccataaatgttcctcaaaaactttgccatggaacttgagcttgaaattggacacaaggtgtcgcatgcattccctatgctctgcataaccaaatacctctttaatagcatagtcaatgccttttcatgcatctgaacaaattgatagtctagctggttcaccaatagcttcatgcagtttctccatgaaccaaagccatgtctcactagtctccgagtcaataataccataggccactgggtacagccaattgtgtccatcaatagcacatgcagttgctagctgacctctatactttcctgtcaagtgtgtactgtcaattgctaagtatggcctacaacctcctaaaaaaccttgaatgcaagggtgtagtgccacaaatagccttgtgaatctcttcttgtccttgaatgtcatatggtcaatggcgactatacttcctggggacctcttctcgatctccgccttccaaccatatagcttgtcaaagctactatcccagtcaccatacaatttactcatagctaattccctcccagaatgtactctcttgtaggggatggttaacttatgtgtgtcctttatcctcctttgcaattccatggccccaacactagcatcctcacgtagccaccccataaccttatcacaaacccacgctctctttgcattcctgaccttctcgctttttctagtactaagacaaccatggtacatctcatggaccttaatctgaaaaagaaaaaatatgcaattagataagaaaataacaaaatatgcaatgtaacacattaatgtaacacatacctgcactgctggaccaccatgaatagttgacgcatgaagcctccatccacatccttctttgatacatctagctctgaatctactaggatcagttttttcaacaaaaaaactcgaattctttcttaatggaatattgagccacagccaatctaaactcacacattgaaggataaatagtctcaacagtcatgggtgggttttctttgtcatatgcaacttgtgggattactggatctgcctgagcatctcgtgcaatccactcttcatcatcactatcagtgatactcagatcatctcccccttctacctcaggcacattatcagtttcagcaatagagtcatcactctcagatgaagagtcatcactctccgatgaagagtcatcaataccaactgagtattgtttctcatcatctacacctacatgctcatagtgcggaatggattttctaggtatgcatcacttttggatgcctgactagtgctgccttcctgagtaaaaaatgcctgagaggggactgaaagtgatggagtgcaaggtacaatagcttgggacaaattaatttggtttcccagagtgattaccactttaccccttttagtatgatgaaagcactccaacattgctgtcaagtcctgatctttgcatattggaatgagttctttgctactagcatgaatataatgcaaacatacagtttcatttaaaccccatggatatttttcacaaatatcacccagaaaatctttgaagtttgttacgtctgcatcaataggccatttgaaagaaaaaccacccggaaattcaggcctacatgtcttacccattattctcacgtcaagtaaataagtagaagatgtgtccattctgttgatgaacacatcgtcgatgtgtgagaagaaaaatgtgaaaaatgtaactgctctgactccctaataaaagtatattactcatagggcataagatgaaagacatacccatccggaatccaagatgaatccatcccctcatgttcatgctctccttcactgtgctccaatccatctataattccaccacaatatctcattcacatcatgcagtacaaattcttcaaatgaaaccaaacaaaagaaggaaaatggaaccacctgagagggatgtgccacctgctgggactattatgccgctgctagtgaccaccgtaccggcgcatgcagcccccgcaccaccccctgtgccgccacttgccacctcctcgcctcccgtcgcctgagagcctgccaccgacgcgccgccacctggagccgccgtgccgccacctgggagcaccacatcgcagtcgagggccgccgcaccgccgactgggagccccgcgccgtcgctaggggccgccgcgccgtcgcctggagccgcgggccgccgcctgagggtcgcgcgccgccgcttggacccgccgcggtgacccgcgccgtcaccgggggctgtcacgccgtcgcctggagccgacgtgccgccgcctgggagccccgcgccgccgctgagggccgccgcgccgccgccgagggccgccgcgccgccgccgggggccgccgcgcctgagtgccgcgcgccgccgcccgggagcgccgcctcgctgccgccgccggggatccccgcgccgccgcccgcgagcgccgccgcgccgtcgcctgggggcgctgcatcgccgccgccgtcgccccccatcggttaggtttagggttccctctttttttccccaatctcttttcttttaccgcctgtagacagtataatttggagcgagggtaatctggtcattctggtaaaaataaaaattctaacggtgtggactaaacggtaagttgactatgatggcatttcagagagaaaaacgcttgtacgatggccttttgaggaagttgcgtttgtcaatagcatttctgggattagagtgcttgtcaatggcatttcatggattttctcttatattaagagtaaataaagtaagagatagttatattggtatttgataaactgatggtattatatttttttttacttttttattcatatgtgtggaatgggtgaaaaatgattctattctgagacgttgatgagactatgactgtatttgtggaattgtaaatgagatagtgattatttttttaagataatggaaatgcttaaatgggaaactgatacacttccgttttgccggctgcccatgcttttcccagcaaaaaagagtaacatcactttgctgcctattcctatcggtagttacatcctgcaagctcttttcgcttgccatctgtcgcttaattgctgaaaccatgtgccggcctctacagctacagcacctacacatagtttcagactccagatcaagcctgaaatgcagcgatcagtaagctaagggccctgctttaatcaagccttaagtacgtgtctttcaaagttttgcgagcttatgagaggcagacacatcgcacggttaggcgcgaaaacaacaggggcacaggacaccgatcgttccattccatcccttgcgaccaccacaaccatcaatggtagtacagcaatgctcctctttcccttttggcctcttaaactaaagaatttttctttcgtccgaatctttctttaactgctcttttttttcgtgtcacgaactcgggaaggcgtgcatattagcttcttgtaatttgcaagatgcaagtggttacgagacgtattagtaccttttgtcaaaagggaaagaaaacaagaaagaggttagtacatgagacgctacctttgggacactttaccatgcataggttgattgatagacaatgcatgctacgggtgtgtttagcttacgccaaaattgaaagtttggttaaaattggaacgatatgacggaaaagttaaaagtttatgtgtagaaaagttttgatgtaatggaaaagttaaaaaattgaagaaatattttggaactaaactcggcctacattgctacgaccgatctgaactgtactccctccgtcccaaaaaaaggcaaaccctgtgtttccgtgtccaattttaactgtccgtcttatatgaaatttttttataattcgcattttcattgttgttgaataataaaatatgattaatattttatacgtgacttgtctttttaattttttttataatttttttaaataagacggacggtcaaacgttggacacggaaactaggtttgtttttttttttttttacggaggggcgaagaatgtagcagctaacgtcctactacggtgctagtgtactggattgcatgtgtgcagttgatcgagggggtgaccggtcaagtcaatcgtccgaatgacgacgcggacaaaaggtgctggctgactgggtctagccacgcgcacaagctggattcgcttgatagttttcgcggaaggacgcttatgattttgctttgtgagagagaagcctctgctgctgcctttttgcatggttcggtttcagcggtcggagcgtgataactagccataggttacgccgtgtaaacagtgagcgacattgggctcaagaacgtcgaaagcctcacgaacgtcttgggatggaagtacgcagatggctgtgctgtgtcatgtttgttttcggtcaccaaaaattacgcactgttaagctcaaattgcagtgctatgtgatagcctgataggtggtagtattagttttccccatcttttaaactgtactatagttctaaaaaaaactgtactataaaagatctctaattactcattatcaaacagtgcaataggtcatcatactaatcggtttgtagtactgccttaattcgtttgttcgttcgttaggaagccggcagcggccccgcctcaactgttcattttctttacatttctgcatttggggccaaggccaacggaccaacatcatgttgccggtcaggatggccaagatcattgcacaaaagcagctacaatgccttaccggttgatctgctcaggtgacaagttaatagtacagaatcgaggcacacattttacccagtaggatctacggctctcaaggatgaaagaactggttgcaacgacacagcatcaaagttctctcccacaggtcgaaaaggaagggaaaaatcctcacacaagaaaaaggggaaaacgccgtcatatacacgtattttctctaccgcgctatttctcttgctctaatacatgcacagaacaagactgcaagggtgatggacagaaaactggaattaactcggagcttgctgcttgccctgactcatctgaatattccttgtgcgttcatctcatctcgatcgggcgattccctttactttctcaaggggaccccggatgctttacttgcgcctatggcttagctcaggacgggcacattcgccgcgacggcgacactgccggcgtcgagcctgtggcgctgctcgtttcttgcagcgcgctccctcgcattcgtggcgctaaccctcactgctgcttcgtccatctccatctggtgatcccggcactcctcgctgcagaatggcgtgttccctctgtttgttcacaacaaaaagaaagctcagtcagaaactattcagaatcagagctcagagaagctgatcgcttggtgatcactttgtattctcctgcctaattatccaagtgattcaaccgataggagcaaaattgagcgtgaaacagacctgtacatgaagatgtcgcagttcctggtgagcggcttccggcagagggagcaggcgtccatggcgtggccggacaggcaggcctcgccgccgtcgagtggctcgatgtcaaagaacgaagaagaggacgacgacgctgacgccatctcggttacaacttacaactcgagctgaaagatccgaggagagaagaccgatgagctgagcaagtcttggggatcactgccaatacgggagagacttgaggctctcctcttttataaaagagaaagggggttagtggtggttgctgagtttggtgcagggggatgcgcgagaaaccacggctagatttccaggaatccgtggcaaacaaagcacggctcgcatcgccagcacacacgcgggacacggctaaactggccgaaccggcgcggctagggccaacacaagaagtgttgccccggtttttgtttgtttggttgctcgcgattagtctcccctggttgccttggagaccttggtggcgccggcgttgtgaactgcaatgctgcagaatccaccggaagatctgtaacaaacggggacccggtttctttatgcgcaaattcgattctatggggacctcttgttgtggccttttgctagctgtttggttttgtttattgcgccggtctcgccacgtgttgaggagtgcacatgactaggacacattaaattacaccttcaatgcggtattaaggacattaactgatgatagtttagtcacatttattatagtgtacaataatttcgaaacagagaggacatgtttctacgtgaagcatgttgctggctttatgtattttctcactcctttttggaggagaagttggcaatgaaaaagaggaggaaaggcaaggaaactaccggagcgaggagtgagtagtgaggctgtagcagcgatggcgacgcacgcgtctctagttctgtaccgcaccgtgtaaactttggaagcgtcaccggtgtggacacggacaatttacggtggatccaggaacaaattgcaggggatctagtagttaacatatgtatagttgcagtccgtgtttgattggttcttgacacggataggaattccccttgacccgtgttgaccacgttggacgtacgccagactgagacactgacgatgacaaacatttgtgtccgagccgacgaccccatggtcaagtaactaaagtttctgtcatgcatgtccttaacggacttcagggagagacagattcaattcgtctgcttcagttcagtacgccagaaaattcatagacgtgcagggcgcgttggcgtgtcgaatggtccacgactccacagtgggagtggatctacgatccaggaagcacattttccgtttcgtggttaatgcacattttctgttttgtagtttaatgacctggtctgaacatgcgtgatccactgatcccatactatagaattgcgcggtgcagcagttcagttcatcagaacggtgaccgggatggacaagggcatgcgtgccgaaatttcatttcatcaatatttcttcttgagttttgcttttgaaggagattgttcttgcttcttaaccatatatgtttttctcagagagaatcagaaatattgaattctaaatgctgtaattttttttacgtatgtatgtagatactccctccgttctaaaatataataacttttagccttcaggatttgtcccaaaatataccaccaacattctcttcccaaccaatcacaaccctccaccattaactttcccacctacctccactattcatccaatcacaactctacaccacccacttctacctaatttcttaacaaccgtatataattctaaactttttatattctgagacagagggagtaatagtttttagaatcaactagccaagcccaaaatgtttagaattcatactccgtttatgacgggctgggtatcttagcccgtgtaggcccatgaacgtcatgttgggctttgttagtttatgacgtttttttggggaataagttcactatgggtccctctatttgtcgtcaagtccgattttcgtcccttgaccacaaaatcggatatgacccgtcccccaacttacgaaaaccgggcaaacatggtccctcggcggttttgatagtggttttggctgatgtggcgcctacgtggctaatttgactcggtcttcatctgacttggcactgacgtggcgcttacgtggcaaatcgaatcgaaaaataataaagcccgtgggacccacatgtcattttcacacataaaatttttttaaaaaatagtgggactcacgtgggccccacatgtcatactcaccccctcatcttcttcctccctttccatctcccctctctccatatctctcccctcctctctctagcctccaggcgccacggctcactgggtcacgggaaggttcagcggtggtggccagcgacgcgacagcagccgccggcggcgagctccacctctcggcgcagccgcgcgcgtttctaaccatgcgtgcgcgcggctatctgatggcgtgggcggcacggatggattcatggatctaatcccgtgccagcacgtagcccccggcgacgcgacggcgagacgacgacggctggcgacgtcgctctcatgccggcaagagagagtacatcttcaactgccagcattaatttgcatcgagagagaaaattagcagtagcatcaaataatatcgtttcagtttcgtcgtaattaagctagctagccatgtgaggagtcagttccatgcctcgatcgatcgtcggcgtcgaagaggggtcaagaactcaagattaggcgatcgattccatctgactcatcggctgaatcatacgagctaccgtcaattaagtactcgtactaacgtacgcgtgtaaatgctattgactgcatgagagaactgtacaagtcctgtgcttacacaatgtactacggcctagccatgatctagatgatgcagcaaaagaccttttaattaattagtcgatcgacaagcgatccatgcatgcatgggagtaatttacaggcttcgagttcatacactgttgcattgtgacttgcgaaaaacacagtgctacactgagaattaatgatggtcatccgcagctaagtaatgatctgtgagcaattagcaattaccagttactgacaagaggtgagtaggtaaaggcattattagcaagaactgcatcggatcaaagttcattccggtggtcaaaactcaaaaccccagcgagctgaggcgtgagagcgacgtcgccggccgtcgccatctcgccgtcgcgtcgcgggggggttacgtgctggcgcgggattagatccatgaatccatccgtgccgcccacgccgtcagacagccacgcgcgcgcgggtcagaaacgtgcgcagctgcacggctgcgccgagaggtggagctcgccaccggcggcggctgtcgcatcgccggccgccaccgccggacctccccgtgacccagtgagccgtggcgcctggaagctggagagaggaggggagaaagatggagagaggggagatggaaacggaggaggaagaagatgagggaggtgagtatgacatgtggggcccacgtgggtcccactattttattattattttatgtgtgaaaatgacatgtgggtcccacggctttttaatttttccggatcaaattgccacgtaatcgtcacgtcagatgaagactaagtcaaattagccacgtatgcgacacgtcagccaaaatcactgtcaaaaccgccgagggacctcgtttgcccggttttcgtaagttgggggacgggtcgtatccggttttgcggtcaagggacgaaaatcgaactggccgacaaatagagggactcaaagtgaacttattcctttttttgggctgtttatgacgtcctaaaattacagcccaaaatgttcgcgggttcagatatgaaaagcgggagaaccgggccgtttcatacatgggctttccgggtcagcctttcgtatttctggataattttgcttttgctcaactgttcatctttttcctcgcaattcaagtatactatccaatattgccagattcccctctagaagttccacttcgtcagattaagatggaaacatgcacacttttttaaggtgaaaacatatgaccatctagtgctaaatcataccgataaaatacaacacgttattcggttattgctcttcatgttgcttcattagaacttatcttgagggtcaacgagcatgtcagctcttctgccccgagataattgattacttcgattggccagacgatgatgcgcgttgggttgacaaaacgcattggattcaaaatattatcggcgacctatcagctgtgcatgagctaaatgtggatacgcgaatccacaatcgttttaccgggagcacgcattcccttgcaagtttcaagtcacccgatgagactagccgatcatgcatggaacacgccgcatcaaaccatccatcaacaagatcagatcgatactggataggtcacacacggccgcgatacctatcaacctcgtgaagaatcagaccagactccaacctaaccatcccactaggagagaacgatggcgccccaaaattacaaggaagaaaagaaaaagaagagaacgatctgaacctgcaacagcgacccattcatccatcgcggcaacaacaccacccgtgaagaaaacggatcagatttcggggcggctgctacgagctatacgaccgattcgcggccggacttgcagccgccgctgccgtgcaaccaatccaatcctaagggggaggtgatgccactggcgtcgcacatgacgctaccggacggcgggttaatagccgggcgcggcatccatccatccatgcgaccatgcgtgaggcatggggtcagtctccgtcacgcacgccgcggaggcaggcggatcgcgttggtcattggtgacggcggtggtggtggtagcaggtagcgcgacgagaagtgcgtgccctcgctgcgatttcgctcatctcaaccacggctgttttaatggccctactaactgaacgctgctgcagtccaaaaggaccaacctttttatgaaggcacgcgtactcactggcagcatgcatggggatggggtgcgctactggtgtactgcttaccgacggtactagtagcgcgttggacggactaataacttatttcatcgggttaggctgcatatgcacgaatttgtgcatcatctacggcctggagccctggacgctagcaccttgtcactgcatccttcaattccctttgtaaagcttagcggtaaaaatttctcacagatcggaatcgctctacgccgttggtcgatctcttcgcagatacgtcaagatcgtaaggtagaagtaattaattactccgtcatagcagtggcagtactagtactactcccctactgcctactgtaatgacagtatcttgcatagtgctggtggtgcctgccgttgcgacgagtccgtcgaccatggcatgcatgaggggcaagggctcccctatacccacgtcccaacacccatccaccctggcaacgttcgtgccagcctgcggctgactgctcctccctgccacctcggcgaatccactccccaccaccagcgatgtcaagcagtcgcacgccccgcgattcggaagccgttcgctccgcgcgccggtggtgtgcgcgccagcaaccgacaaccgaaggcactgtgctgccgtgccgtcccgcgcccccgcaataacttcaccgctccgaggaagcgcgtcagttacctcgcgccaaggcattaacggcctccgcgcgggggtttgaggtttgagcaaatgcgggggaagggaaaccaaccacgtcgaaaccgcacggcagcacgggatggatgaccaccggggtagcatcacagcacggtgggtgtgatcggctgttaatatcaccaccaagtacagtaccccctataccatagtaccattggtaatatctacatcagttatgtcaatgggttgcaaagacgccaagacaggcacggtggaagcaaattaggagcgaccagttggggattatgagagccagaaaaaggaaaagaacgtgcagcttcagctttgcaaattgctccgtactactattaacaatgaacttatcaattgaattctcctaaaccccaaatataaaaaaggagatttgaggaagtaatcctcggtggtaaaaaaaagttggaaaagatatgaacaagaagatgaaagttctaagttttttttcttcttccctaattatgattttctgggatgggcaatgatgcctccgcaccagacactcacgagatggacggccgagatgagacgacgacagctcaacagaggatggcctccacgccccctgtccggacgcaatggcagacggggcacgccatggccacgtccacgtcgccggcggcgaagcaatcgccgcagaggctgaggtgcctgcaggggaggagcaccacggtggccggcctcaggcggcaggtgaggcaggcgcggtcagacccgctgcggcgcgggtccacgtacgccgacgaggacgactccgccgggcccgcctcgccgccacggagctcatcgccggacgcccgcgccgcggccgcggcctgctggagctgcgcgtggagggacacggcggcggcctgctccgagagggccttcgcctgccacgccgccgcctcgctgcggaggcgcgccagccgctcctcgagttccgcgccgcgccgcgcctcgcgctccgcctccaacgccttctccctgagccggcgcgccgcggatcgctctgccgcgacaagcagcgccctgttatggcgccgcacccgatcggccatcgcccgcctgagctgctcgccctgtccaagaacgtgccggcacatcacgccacggaaaaaacgaaccaccgaaacaaacggatcgtgtggggggcaaaatcgtcgattacctgctctttgatgaatcggtcgagctcctcatcttgccgcttcatctgtccggcaagctcgtcggagaacgagacgaacggcatgggcgacgacgagtagcacaaggctttcaggcgtttgctctcttgttgttgctgctgctgctgctgctgctcatccaatgccaggcgaaggccagtggacacgagtgccgccggcgcgcgggacggcgacgccgataccctgttgtggagctgcgccatgttgacaaacgacgtagactgctgcggctggagcgtgaacagattgaccaactcctccttggccggcggcggcgccatggcaatggcctccctcgagcgcttattcctccgattaatcccactcgctgcaaagaaaccaaaaccacatacgcccatgtcacaatccaagaaccgtagtgcggcggcgccatggcgcgaccttgaactccttcaacatcaggctatctatctatcaatcaatcagtcagtcaccaccacccacctcctccgctgggaaagtacacctccggcgagactccggcgaacatctgcggcctgggcaggtccatctccttcgtcctctccggctcacctctgtaaaccagacgacgaataatccatcagcccaaaggaggccaaacctttaaaacacgtagccgccctaacgaagaagaggagacaagccgcacctatcgtggaagaggagactggaagggtactgggcctgtaccgccattgttaagaaggaagagagggagggcgaggcgaggcgaggcgagaaacggacgggtgggtggttcgcgaagcgggaggtgacgacggggaagaaaacttcctcgcgtggttttaataggggtgcggacgagccgagtccaattccgagagcacccacttcgcacgcttgcttttaaaacctctcatcgcaaggaacaaggaacggaacgggctcgcaccgcgcgctcgctcgatcgtcgatgggaaacgagtgatgcgtgaggagggagcgttgcaccaataaaaacggaaaagaagggggcctaaatttactggaggcagaggcagtagaagaaagatggtagcggatatgggtggttaaaattaggatcccagaggatcgtgggtggattaaaagttaagcgtctgttcttgattttttttccttacgttaatgctgaagattagtgatcgataaatggtgtctgtggtttcgctgtgccacgcaat

SEQ ID NO: 5543 - DNA, 18718 bp, Oryza sativa
tacagtagttcatcactccgacgcgaacgcatgcagagaggggttaagtgcgggcgaaggaaaggcgggggaagatgacgacgacgacgtactcccatcgatcgatgccaatgaaatgatccgtccacggccatgcctgcactgcactgcaacctctctcttttctttcgcaagtgttccgggtgggcatccatccaactgggggcgtggcatgtgatgcctcgttgctcctttcgaccgccgctgggtcccctctctccctccatagcttggaagcacgcacgtaatactagcacctaactgttgaagatcgatcgatttttgcaattcttccggagcggaattgttgctagtggttgttgctgtcagaggcaagcgaccggcgcctagctagctccgatcgggattcagatcggtcgaccgagaccgatctgttggggtcttggtatgtacgtgcgtgtacatgttagttgatcgtttagtaactggtagttggagcttgtttcgcttgctcaacaatgacttcgtttaattatccatgcagagaaagaaaattagtgcatgtacaatggttgttaatagtggtctcttagcgttgctaattaggaatacttgttgacatggaggaaagagaaagaggagagacaaaacatcgttgttatgcatgacaatggcttaacaacgactcttagtcactataatatgaaaatatggttgcatgaggatataaatatggaaagaatattaacaaaaggaatattttttgagttaatgattaaagcctttgtcatctcaactattgtaaagatatggtctctaaataatcttatattgtttaagagaccatacccgtctctaccattgaacatgccctaagtccctgacagagacggtaaccaaactaaaaaaacgatctatccggatggattgtaaagacggattggcggtacgccatataagtaccttcaaaatcccctgcatgccggaccttgtcaaatttcacatgcatgtacttgagtgaggttaatggaaccagccaaccactaggattcaatcgaaacttcagcgcggattacatcgatctcgatcgtgttcacatgttgatctagtaccggcgttcatgatctttcagcaaaagcgatcgaatacgatggatgttacagttcacgaccgtggtggtcgcgtcaaatgtgacaacgaactctcctcccgtcttgacatttgaagcttggaccagggcctacctgtcactcgccggcaatgtacattgggggcgagccctgttgctatccgtctctccatatgcttggaacccgtgggtttgcaagcaactagctagagagcaagtttactagtatagccaactattaattttaaataatctatagttaattaaatagacaattcacacaatagttatatataaacatatactacactattaatacatggtcccacctatcatatatacactatgtcttaagtccgtgctgtaactggttataaatctgtatcctactgccctcttctctcttctcttttatctcatcgatatatgtttatagctgatttatagtctgctaatgtacccctcctagtactaatataaaacacatatgtacgaatacctagtaatattatattccctctatttcatattataataactgctttaactttttaagtcaaacgtctttaaagtttgataaattttatagaaaaatatagtaatacttgtagcaccaaattattacatttaacattgaacatattttgatattttttttgtttcgtgttaaaaatattgctatatttttctataaaattgatcaaacataaataagtttgactaaaaaagttaaaacgacttataatatgaaacgattgtagtacacttaatattgtctccccgtttctaaatgtatattgctattaatgtttagacatgatttgactgtttgtcttacttaaaaaatacataaattaaatattatttttatgttgagtacattcaaccaaactatggtaaactataaatttaagatgatatatcacaaaactatagatttaataccaaatttatcacataacttgaaatttttcaccaaactacagatctagtaatagttttgtgatatttaaactgaaacatgtagtttatgataaatttaatgtttaattaatatttttgtgatacaccattttaatctatagttttataatagttttgtcgaaatatccatagtttttatgaaatttactctttttatgttaaatgtactttaagcatgccattttgttcgtattcacaacagttatgtaacaagatgaataattaaatgttacatccaaagtcaacaacgtcatatatttataagtataaaaaatatttttctacaagtcaaaatttagtattggatactctaaaaatgtgatgtctaccggagggcgggaaactattttaaactctcgagggacatcccttcgttattagcattccatccaaatggttagattaatatgtgataattaaatcactccacaaacatgcactaccatatttaatgtctacaagttgcaacgaacaaaaatattttttgactgcgaatatacgttaactagccatagtttaatttgtttttccgttgcaacatgtagaggttaaatttaaactttcatatttgtggagtgatttatgatatattaatatatctttttgacttttttcaaaaaattttataacaatttagataacatacaaataacgaggggacgtccccttagagagtttataattcattcccatcggaggacaccctaaaaatgtagctttggttgtagacacctaaccaaacatgctttttttttctctaggacaacgcctgcaatattatattatttccgactattttagagggagaatcaatgtgaaatgatgagaataatgttcctagaaaaaaacttatgtatttaattggaccaagccacctcgacactgtcacgtttacaactgtagtcgaaccacacctcaaattttgaggggggtatgctagttattttgcaaatttcctctatccaagttagttaaaaatgataaaataatattaccctcattttcatgcattaaagaaccatagatttgatgtgttcatgggcatagacacatttttagggtattaacgagtaaataccacgtttttttttgcggggaaaataccacgttcttagctagtgtggtgttgtaaatttttctctttttttttgagaggaataaaattttcttttttatacaactatagtagtagcctcgcttgatgtaaaactcaaggaatcgcaaggcatgcatgacccagacttatgtttctttgtacgagtgcatgcatgcacggttcaaccttagtttgagtcatccgagatgtattgctcggaacagccgtcccaaatggctggcaattaacctaatctaaacctgcaaaaaaggcgtacgtatggatgcatggatgcggttcgatcgtgttgcccccgtacggtttcaccacccgtcctgttttcctgcgtgtaaattgctcgccttttgcgtgttcttttcctgaaaatataatcatgcacgcacaacgcctcggtttcccctgtgtaaattgctgccgcctgcgtcgtgtcaaccgatcaattgactttaaacaaaaggagaattggagcgcaaaggcaggcaggaagatggcagcagaagtggagtggcgagtgctgtgttggtgttgccgcctgcctggtgcctgccggctgctagatctggtctgtggtcgcccaatcaatctcccccgtctccttccctgcagattcccccccacgtctctcatattttttttgcccggtttctctcatcgctagctctcgcgccgtccgtttccgcgacgcctttctttttaacctgtggagactggaggagagcgctgctgccgtgccgagatgtgaacggaatcgcgatacggtgcaagcaagcgagtgcccccggtcgtgctcggctcgtacgcgcggacacgcgcggcgcggccggcctcgggttggacgagcgatgggtgcagcagatgttgtcacgcatcaccgctggatggatggacccagggggtagctgtgacgggagcaacgaataaggcgtgatgaaccgtagccgcgcaagcaattgcacaccggggttgttccattccatctcaacgtcattcaattttccccggattttctgcgacgtcgttcggttggtttggagcagcgccaccgctagctatacgcgccgggggccggccggacgtccggtgtgatgctttaccttacaccagtacaccactcagaggagaaaaaaaatgaattattactgtttatttatttattacctttatttatttctgaaatttgtgaggtgggtgactttgccgtatgaccagggtaagtggagggtgtaagggatggaatgtgtgtggctcctaacctagattcactcgagtaacacaaggctaagcttttatttttcttttcttgattacatgaaagacacatgtacagaatattttgcacgtacattacattcgcatcatgcacctgcaagagtgcaagggcatctctttatcacaggtttaaagaaaccatggttatcaataaatccctagcattactaaattcttattgaaagtgtagccttatacgtgtaagccattcccaacccaatgactagaatggtgtccatagcattaaataagctatcacctaagatgaaaaatgatgtggcaagtgaataaatgaagaaatagaagaaaaccatgtcttgcatgagacatggttcctacacaacatccaagatatcatgtgagataagtagcattaaatttaagtatgtaatagtagtgattgcattggaagagtagtgtctagtactagttttcttgatgatgtggagtttatggaaaccatgtctaatattttaggttgagaatggcctaatattcactagctaagttcttagtgggaaccacaaccatatatagattttgtagggcttttataccaattaatgaatcagttcaattctactattgttccaaagaaggcctaagattatctctggtagttcccaaatatccttctatcaaagaaaaaaaaaatacatattcaggatttcggtgtctaacagtttacccaataccttccactatccccaaaagttattgactcaataatccatctcaactccctcaaatatagggaaagttgcaactcccacataaagtagttgtctctcctattactgccaacatgcatcaccagctcagctggccgtcgaagacaccatgtggatcatctaagaggtgttgtctaaacctcagtggccattggccactatccaatcgtccacatgtcatccatcggctggtctatccgagccttagtgcggttctttcccacgcccttacttggccattgcttgagttccacctccccccactcccgtgattatcaacaagcctctgccgacaaaactttgtcgtcggcttggcctccttgagctctaactgtggtcagcccctgacgttaggggtctttcgcttttgctagatctctatagagatattacgagtcctccgtcccaaattcccttgccgcaaccatctggttcaccagtactatataccaaaaagtctcatgcttacgttactgtgactacacttcaccacacctagggcttgaccctgccaaaccctggaggagttgcgtccgatgcaccgccaccagcgtcgggaggtcctccatcactactagcaccatcaccggagagcagctccgtgcgagtacctcctctcctcgtcccgctcgagcccccatgctatcagatgtcatcactcgaagcctgctctctcatcttcatctgacatatagatctcattaatactgggatgagatattggatctatcaaaagcaccccaataaccatgaaattggtatttgggaatctccaataagccaattttgcagatgggatatgaatatatgatagtgggatactgttggagatgctcttacatattacatggcttataataacaagtttgaccaatttttaccatttgaaatcaattatacaaattttaatattgaaaatgtatctttaactgaaattagtgaagtattgtcttaaattcaaattattgacctcaaaattcaggaattctgatgaagtgccaaacacaacgaccaaaaggaatactccaaaaatcacttaaaaccttctagctgtgaggattatcgatcatgatcggcatgaccagcaggctgacttaacaacttggtaaattaaaattaaatccataagataaaaaacaaaatagcgagacatgcatggaaacatctctagtgtggacatcggtgctttggcattatcaaattaggtttgacatttgcacgcagaagacggctagacctgccaattaacaaggcacatccggatcccatgttgcaagcttgcaatggagaatacggttacagcttctttgagctgacgtgaacggtgttaaccatttacttctaaatggcgcagtggacctgctttgatagaactatccgcgaatctgaccaaaattaacctctttttttaaaacaaaaaatgacaggaaaacaacggatgtatcatgaatggtgatgatagctagcttggaaactggaataacgtttgtttgtcgggttcaaagaatggctacgtattgtggctagtgggggtatttctacttctctatccaagctgagaatgcgtacaatacagcgcaatcatgcgcgatatttgcctgcagatttctggtcccttgcgcggcttgcgcctaaaacacggccgattgtgtcgttctctcgcagaaagagtgagcgagaaattaaaccaaaaaacaaatgcaaagtgctgcatccaaagtagagtgaaaagtctaaagagacgcatcgatgttatcactatgggagagggaggttaagaatcacatcgctggaaatcactatgtatatatgcttggttgtcatatgctgtgtgtgcttccattgtcacgaacgcatacatgacaaaacatgacaagtcagcagtgatgacttgatgatggcaaggggggtggcacgacagaatcatgcccgctggtgatcttatcgacctggctggctatgggccacaacagttcacatctccttcgccaatgtaaaattagttagagttaatttgatgaaattgttgtttaaaaaatcatgagataataagccacaatatcacataattataattgtggatgtaacatatcatttatcacgaaatgacatatttaataagttgtagtgccatattagtacatagagtaaatgcattagaggttaaatccttaccaccaaatcgtagtatcatactacaacacacattaaatacttttacggttcttaagaaagcatctacataaatagacaggtatcaaaattttaatatctcgagataccaatgcaaattttacactagaaaatgtagtatctctagttgtgtatttgtgtgggaggggttcatagtccacttagactgtgttcttccccctactttccttactcacatctctcttttttcgcacacacgcttttcaaataactaaacattgcgttttttttttgcaaaagtttttcacgggaatgttgctttaaaatattaattcatttttaaggtattttagactaatacttaattaattacgcgctaatggaaactacgtgcggggaggtggagtttccaaaaccttatcattgttattataagtttataacatatctttccaaatttataagtgaaaaataatccgtgcaatctctagtttaacgatacaatagtttataacgaacttgatactgattttttttctatatcttttttcaaagtgtatataattatatgaaatttacttaaataagtatgattggatggcgcagtcgtcggctgttcaccatgttcgtgtgcagcagagaggttagtttcgtttttctcgtccggtagctctccatgccttgtagctatagctagcatccagccttgcttttgtagatggagcaaccctgtcagctggtgaatgttgttgcattatattgagcctaaatcaacagagatagatatataaactgtagttacggtgtgacttttcagggcaccagcctctcgtgtacttgtaaaagaaaaagacagactggtgtcaggttgcgcaattgcttattattcataatttcttatatcgctcatcagctttgcgaaatggatgccattagctttgcatttcaggaacgagttggatgcctcaactagaagttgttgctaaccacactcgataaggcacggcacttgcaaaattttcctgaagctgaaagaaagagtcagcacgcacgatcgccatcttctgagcaaaattcaagagcattcaggagaaaagaacttaatcttcattttcaagagaaaagaataccacctaataaaaaacttaatcttcatcttcagaagaaaagaataccacctagcaaagccacggatacagacgtacagagtatactctaccatgagctgatagacttttcttcgtggtaaacgaagaggattggcagtattattacttttaccattcaccattgccattaattaacaaaggacataagaattcccatcagcatctgaaagatccaaatgccataaacacgattttatgtaggggaccctaaaacagggataggcaagcttcatgtgacatcctttaataccaagaaagatcatataaaatcgatccaaaccaagtgaaatctcaaagaaagggagagctggtctgtgtgtgagattggtcagaggacaaaacaaaggctggaagtcagggagagggaggagaggagtaccaaattcccatgaaactctcaaccccaccaccctcatgcgcagtgcgtagtagtatttatttccccgtgctttaaggaaagaagagaccaaagagatctgaacaaagtgggggagcagcctccttacaggaaagaggaggtgcgagtgatgccatgacaatgaagagagatggtgcaacggcaactgaattatatactctactatgctcgtccaacttggcaggctggtgccaaagagtctgcctcatgcagtcctgctttcagatatcactccacccaaccaaacaagcaagcattattgcatctgccatgagaattttacacaaaaatgtcaattgaagtaccgaatacattcaggtataataatgggaaaacagcagagataatgtcagtaatatactccaacaactgccaacatatgcaggtggcatgatgcatctacttgaactgcatacatgacactttaacagcagtacaggaaccctttaattttaacaaaagattccaacagcttgattaagggatttgggcacaaggcaggtaaagtgcataaacaaccttcatttccaggcactaatgagagactttcgcaacttctcatgaatcatggccatcaccaacaccgtctttctcgctacttaatgctgtgctagaaccaaagcatatgggcgtcgtcagaggagagctcctttcctttggccccaagctcacacttctccatgccatgctctgatgctgctcctcctccccattgtttagcccacctactcttctgtagtcctgttgcctccattagcaattcttgtctccgttttctttttttccatccttttcttcttttctttctttcatatcctgctcagtcctcaccttcttggttggataaacatgctaacgtgcagctagctaatgtgttttggactttaattattatagtaagtgatgctacgggagactgatgagtgtttcctggaggagcaccaaaccacaccaatcgccatcacatgcactgcctttatattattacactcttctgatccttctcatgtgagcagtgcaaaggccaccactcctcccttctctggtctcaacagctgcacttgtctctccaatatttgcttcctattccctcttcacgcagcaggacgcagtgactgagactgactcctcttgtatgtgtgcaatctttaagaaataggagtgtatctctctgtatgtgtgggtgaaaacatcataagtgagtgactgcacactgcaacaaagctgatgaatcagagattcacagctacactctctgcgggtcccaagctcatgttgcctcaactaagctaaatgcaaacccgtggcttagcaaagtggcattatagacatgaccctgaaaaggttccgacagagatgtgtatatatttatcctgcgaggcatgcatgccttgattgctttacttctttgctccataaaccctgataataattcagattttcactgttccaggcagcattgctgtcttatcttgatcaccacttttactatagccattgagcaaagtaaagcaagcaacaaacctccatgcctaacagcattaaccaaccaagctagagggatctgtagagagagcatctgtacctgatcggcagtggcattggcatgtgcatcggcccttccctatgctatgctgcatctccatatcacaaggttccttcccccatcatgcattgggtctctctctctctctctctctctcgctaggccagctctgaccccagatttgtttctaccacgcagtgcagcggcagcggcagctcccacaccattactccccatctgtgtgaagtgagagggaaagagacgagtcagatacctaaaattgtgatggactgatattattgtcaactaacgtgtgcccccctggctggcatgcccttccaaagggtcggccctgtgcttgctgctttgcccatctagtccacggcagcgttgcactgtcttttgatgcccaccctaatgggagccaggataccgaggccggccagcccagcaaccttactcactcatcagtcaccggctgatgcaaaaacatgcagcaatagggacgctgctggccacactgctgctggttctagcctggactggactctggagaggaaaaaagagagaaaaaggattgcatgaacgggtcgccattgtaggcaggagtttaatttgtttggattttgcgaggcacgggctgcagcaaggccaacctcttcagtcctctccaccccacttcttgatgacagtcacatgctcttttttaaatataaattatgtttttcaattcttttcttatcttttgaaacaaatgttttctgtttttattttcaccaggcatacaaagaattacactttggactacctcgactctcttctcaagcgcatcgacgactttgagtacaacagctcctacataccgctgaaatcccgcacaccgatgaactccaataccgcagctagtttgaaataggatgaaagaaagtttggatgatccgataccgtagcttctagttggtcaaatgttagcaccataatcacatttcgtccattgcagaaaggatgattttatttttgttagtgctgtccacccattagaaagctccataaggagccagctagacaattattttgcaacttatcgtgttgactgcatctttcatgtacttgcccccttagcacaagatacaacctaatcgaaccagcatcttgcgtcagggaaagaaggatcagatcagtttgcttcagcctagtttagacgctaagaagagaaacctaacacatttgatggcagttagttgaatgcaggtacatggcttcatgggtcctaaaagtaatgaagcctagttgaatggcaagaatatataaggcacaaggctagaagcccattataagactgccgcgaaggggatgctttgctcaatcacaaggactaatggccttgtagactttgcaggtaagcatggacaaagaaataaatatatatgtttaagatgaatctaatgctgcattatggtactaccacaggtatgcagaagtactaacaaagtcatgccgcaaggcccactaatgtccgtacacgcttaatccaactctgcaaccttatgatagatatccactttatggatctcttctacttttccttccattttctttacatgtattaagtagatatttcaaaataacatgtattaagtatacgtatacgcagctcaaagaaatgggtcataaacaaattcagagattcatatattgatatactaatgagcaaccttcgtcatgctaatatggtaatgtaataaacaccattgctcttcttatcttaaggaagaagcataggatgcatcaagacgcctgcagatatatccatcagcattgttagatgccaccgagaaacatgaagagaggaacaggtgcacgataagagaatgggaataaagctggagtacagacgaggaaagccacaagcaaagctcattggtttcaggggttatacacaaccagtaggaaagtggggatggtacctcctccattatagtcaggacacccacaaatactatctaggatccttaaagaatacttatgcaatacagccagcagcttagagattagcaccaaatggatgccaagtccattcctttggtgagcatgatgccaccaagagaggctaaatggaaagaggaaaaatgaaggaaaaaggaggcatcatggaaggaagctttggcaggtaaaaagaagggagagaattgctccacaggcatccatggtgggtttgttacatccttaagttgggtgagtaagaagatgctgaaagcaaagcagatggcgatgcatggtgctcagtaccgactgccagatagcaactgaagtttctcttctttcaagatctcaagttcagctgtgaccaaagcattttccaaaccaccctctgttgcccccattagaaaaaaaataaggttggatactgcaagagcaaagcattttggttgtaaaccgacacatgagaaatgcaagatagagatgtgcataatgagtcatcctctccacctgtcaattacaagacgatgtgctaatggccaagtttggacaagtcttctacaaagacaacacaacaaataccagctatttaaagtttttttttgaacaactcgcacaagatggtgcgaagttctattgatagagcagaagaaaaattacaagattacaaccccgtaagatcgtaaccaggaaaagaaaaaaaagtataccaccacccacacgtcgacagctccaacacacggaaccaggagaagcctagcaccgaattggccgccgctaagctatttaaagtccacctatactttctacctcggtatgcatttcaaagtatattagtatatccaaagttaatgaagttactggcttgggcatttgtttctaagcatgtccacactacatacacaagctagcttttcacagaactggaaaatatatgatgaaagcacttacatggcaatgctgtggcatatagctttacctcttgctagtgctcaagaccaccacggtagcatattctgcacttaaaaatattcataacacctgttgcaagatgtcactaaccctgacctcaagattttttattttttttggagatgtactgcatctactcgtatttcaacggtggcgttcgttttcagataaacaaaataattagctagtgcgagtaatagcatcctacgttaacccgtgacacattttaaaaagacaaagcacttcctcgcaaaacgcttgctgcagatatgatgtccagaaaaatcatatccggagcaccacttgccgcttgctccaatatatgtcaatctgccgtcccctaccatgccaccacccgtcaatctttccaaatctaaaagtttggcaaacgagagagatagccagacggaggaggaccttggccaaccaaatccaaacaaatttggaggatagaacaagcaaaagatagacaacccacaaacaattaagaggagaaacattagccgtaaaatactcccatttgaaaagtactactataccaagatggagacgcagcttactttgcacgcaagtatatggactctggagtgaaaatcgtggtgcacggacaaagaactaaccggcggcgacaaattcttacagtcaagttatcattggcattgcagagggggaaattaacataggctatcatgggagtaacatgctaatcgcaaaggaaccgcactaattccgaaattggcaaactgcacatcccgtttcaacctagcttggcaagattaattccataattttgcacgagacagcggaactagaagaaacggtaggattagggctttttcccaattcccattcgataatcaaaatcgcccatgtcggtgtctagaactccataagcagcagacgagtactaaccgctggggtgctgatcacggcggcgaggggaagagaggcgcacgcggcgacccgaaactggcacgccgggatcggggagaacagcgccgccgtcgagatcggggaggacagcgccgccgtcgacgccccttcgctcctgcatctccgcaccggcggcctgtacccggactatgggcttgcgtggttgaaggaatagaaggccgaggagttggatctgcaatctgcaggccgcatgaaaagtgggaagtggctctgggcttttggatttgtttacgtatgcatctattgggctatacgttgaggcccaatgggctactatgcatgtggaccgttaggtacgagtttttctatttttacattttttattaaaaatatttaaagaataatttttcgtttcgaaaatttaccaatacgcttcacgacagattttaagtgacaatgatagccagatgatctagcgagtacgtaccgatattagcttgcgactgacctatgggcaaccgtacggtgcgagcgctcacgatcacgagcaacgacgataccaccatctacggtaccaaatgtactttattctatactgtaccaaagtagttctgcacttcacttatgcagtatgctgtgtggggtctagttacggcgaaacgtgcgactcgcacgtaactaaagaaatttgcatttgaaagcaagggggtcattaattaggaactttggtatagggattttatagaattaaaaacccctttatgatttttttcccaatatattccctctgttccaaatataactatcattttactttaaatttaaatattttagaatggagggagtagctctttagtttatagaattttgtttgaaaaattcaaaaagaaaatatgttcgtcactttttggagttcgtcgaatatgaacttactttctcaatctcaaaataaatcaatttgtatataaaatctggatggagtaaaccaaattgtattgatttcctttgagaagtcgaaggaaccatgtcttatcatctctcctcttaattctattcaaacaatattttctcattaaaatcatatgattttcataagtcaagtactatttctgtcccgtaacttcttttttagtccatattgcacgtatcaatacaaaactaaaaacactataatatctcactttaacaaacaccaatatatttcccatccattctagcaaacattaatgtgtttgtcccattttaataaatccctatgtatttgttttccactttaacaaaatcgaatgcactgactgttccaaaataaaatctttgtggaacaaatgaaaggggaaataagtctactttgatttttctggacgagacattctttatgttacaaaaggggcccctaagatgttcctgtgtgcaaaaatgcatttttctcatgcgtcctcataagagacccacctacaaaactagacttattttattgggcgggcttcttaggtggctgcatacgaaaatcagattttcataggcgctctataagaggtccacttacaaaaatcaatgtgaactaaatataaaataccaaatcctctccactcctccacctcccctcttatcctctcatcctccacactctctctctctctctcacacacacacacacacatgcatgcacacactccctctcgtttgtgcggctggcaacgcaaccaaggcaacagcggcgggtgggtcggtgactggcggtaggcagaagtggctggcgccgagctggagtggcggggagcttgatgatgatggatccggcatggagaatggtgggagtggaggtggcagtctcggcctctcgggcacggtagcggccttggactgggcggatccaccacttgcacccacaagagtggcatatccgcccccattcggccagggatggtaggagcggcggcggcgatttcggcagcgacaatgatgatggtggcgtcgacttcgggagggacgggaggtgtggatctggcggctcttcctctcccacgcagatcctaccacctctccctcacgcattgctctggcgacgaaccttgggcacgggagcaatggcgacgggtgatggttgcttgacatgggagctgctagggtttcagttttttttttaccgatttttctttttgccggcggatggcataacatcccgcatgcggaaataccctttttgtgtgtagttgtgcagcttacctgcaaaaattgctatttttatagacacatgaggtgcagacggttgccacatccgcctatgaaaatatgatatagccatatggaaaaaacccattctctctttccggatggagggaatattaaaatgacccattcaactcattctcgtgtttttaataattcctataagttgacaaatggtgtggcattcaatttcggatggctcgctgccccccccccccgggccgcttagcatcaagcagccaggagcgctagagcgtagtcgtattgttcccccgagagaaatttccggtgcatctcagcttatattttacaatataaaaatatccatttagggtctattcattttggataaattatttctttattctaacatataggaatatgaaaagtgaaaaaaatagaaatgcatgcacattttaacccataggaatttccaacaggttcgagtggatgaaaatttcctatgtttcctctcttacaagagaaaatttgtatttttgtatttggttttcctatacctacgttcctatgaaccggatgatgctaataggaattaatccttagcaatctaaatcatttggttttccttcaaaatgaatgggcccatacttttgaatattagtaggaaacaggaacgctgaagcagtcttttagggagtactccactataattgttcctctatagtccccttctttcctctccttccttctaacggaatggtaaaattagagtgaactgaaaagatcgagaattttggttaataattccatctgaggcgttggatagttgaaatgtagttatttggttaatccaccacaaccctcagttaatcaaataggctaaaattcggtccaatagacttaaggccaacaatctcaaaaaactatcattagcattctccaccgcacaagccggctgatcacgactatcctcccatccgccatatccggcgctgccatcagccgagaatgctaatgggcgactagtcgcctgtggcccgggccgtgcgaccagttccactcattccatttttggctcaagcggttttctgcttttcctttttcttttttgatttttctcatgggcttcattatttagcaggccagttcaattcgttcaaccagactgatcagactttttttttcttttttagcaagccactcctattcaaccatgtgtataaagtttgtatataaaatttatacataaatattctatatatacctatataaatgctatatataagttgtatatatgtctatatatatactttgagggaggggaactaacccgcatggacgcgcccccacacgacacgaccaacaactaatcagcggttgccgcctccacctctgttcgcccgtgtgctacggtcgtcgatgctgtgcttatagatggccataaggcccgaggcccgaaggcccggcccgacttgggtcaggcccgtgccggcccgacctccgggccgtgcctgggcctccccaccggcatgctgggctggcccggcacggttgggccggcccgacacaatgggccagcatgccaggcccgacatacaaagtatagggactaaaaatagactaaatgtcactgtccaaacaatagggaccttaaataaaattattttagctatttatatatcacagcccaaagaatagggaggtaaaatagacttttttaggtatatatatgtcacagcccaataggagggaggaatattagacttattgtgagaaaaatcacaataggccatcgtgccttcgtgttggcccggcacggccgagtcgtgttgggccatgcctgggccgtgagtgcggcacgtgggctgccacggcacggcccggtgcgtcggtcgggccgtgccggcccgacaagcctcggcccaggcacagccggcgtgccaggcggcccacatggccgtctatagctgtgcagcctctcggccacccaccgccaccagaattttttttatttttaatttttttattaaaagttttacaaaaataattttccattttgaaaattgacggaagtggtcgcctaccgccctctgggagggcgatttttaaaaatcgccatcccagagggcggcgaaaatgacgtggcagacggccgttagctttcg

SEQ ID NO: 5544 - DNA, 12654 bp, Oryza sativa
cggcccccttaccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaccctacttttagaattttggagaacaatattgtagagaatgtaacttagggcgtagtacagaaatgcgaggttaagccaattattgttttcatcaggcacaatgtcaaataaggtcacatttcagatagttcacggtgaaggaaatattagatttggtccagatggtgttgatctgtcagattttgtaatgacatctaagggcatcgataggcctgggagagaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtgacaagtgagatgtacagcagtgttgttggtaacattggctttgaaccaaaatcaattattaggcacatcgataacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttgtacctatggcttttgcatttgtagagagtaagaacattgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagtaattcaagaacaagcatcttatggagctctttaagaggttctgtgcacagaaccaagagaagaaatttaatgagttgtgggacaagttggatgagttgacaacgaagcaaacagatgagcaatctcgcagaccacaagttgaaggtgacgagcctcccatacctcttggcgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcggatacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacactgagtgcccaagttttttacattccagatccatctaagttaagggtgaaaaagggtcgacgccaaactagacgcatcagaaatgatatggatgagtcagaagcaggtgggaggactttacgctgcagcaagtgtgatatgcgcggccaaacttacaagaaatgctcgaagaatgcagaagttccaagcggcgcagatgctagtccatctggacaggcaagtgatggtaggcgaccacctggtccagcaagtgatttgcagccgggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctctttatatcttctttcccactagcacacaacacacgaaaatggaagcgccattccttgagcgtctcaactggcgaagcgatccttttgctggttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggtggaaggatgagcatgaacgtcgaattgctgctgaggctttagaatggcacgtaaatcccctaggactccccacgtggcgtgagcgtccggagtgtcgttgtggtgaccgttgtcaggtcataaggtccgtaaggcaccgaactcgaggacaaaggtgtttcgtgtgtccaaatattgtcgacgatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgatcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactctatcatatcatggccagaagataacagagtcagaaacacaagtagagtatcaacgattgaaggaccacgagaatgcaatgcattctgaccgacctagaagatgccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcttattcattagtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcaagtataaattcgccctcccccagagcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctatcaattttcaaaatgaaaaattatttttgtaaaacttttaataaaaaaaattaaaaataaaaaaaattcccgccaccaccagtcctcgcctcctcacctccttcccttctcttagctcgaactggcgtacttatgccagcgcatcgtccccttctccctgacacgcaagcacgatgttgcatcctccccaatgggcgatggcaacttaaccgagcaatggttccccatctctgagatttgtttgtgtgtgtgattttttttttggatccgctgatttctttggtgatttgtttcgatctcctaaaatttcggtcataatcaagattgagagcgaattacttgcattggtcttcgtggtaattcagtctctatttttacatgactgaattcctgaaaagactgtagactgcgactgatgtcatcaatctaacttaatatatttaatttttaaatagtgggttagttgtgctacaccgctactccatccatcctgaagagcatggctaataatatagccaaatgcttgctggttttatagatctttacagtttaccgctcagccaactcgtatagtggttagctcttaactataaatatatagtctatatgtctctctcatatattttcttggtttctgtacctatgccggctataaatatatggccatccgcgcctctctctcatctcctctcttctctcatccatctatcatttagccttctcacaatcttctattagtacttgcttgtaacataccgaaaactaactattttctaatcctgcatcatgccgctttttatgttcttaataacttcctaaacctaggaaaatacaattagagggaccttctaaaactaacttgcataaaatctctttctggtatttaacttcttttgtgtttttcatttaaaaatatagttggttaaattaaggtgtttcttgatttggttttaatttaaaaaccttctttagactaagattcttttattcaaatttagtttgaaaactctttctatttttttatgaattatggtcaaagaaacattcccatactgtcctagaacctaaaacaaagtaattccaattttattataattaattgttagcccattctttgttcttaaacccatcctttgattctcgatccaaatgtccaaattcctccttttgatctagccaccaatttaattcctgtggcttgatttcctcttcggcacaagaatagtattattgtaaatattgtgaataattgctcttgtgctaagaaaatagcaatttatattcttcactcaactttccctattagccacaaataattcttcaaatacttctactatcaaatttaggattcaaatcctatttattttacctccaaccattctcctccaaacatatatatacattgaggaattatattgttaattcccctctcatttgagtgcattaaattccaccatattccacttccaaaaatattgcactcaaattagaaaatatctgttttggaaattagatccaaatataatttcctttcaaccttccctattcaaattatctccaaatatattttcctttcaaaatcttctattcaaatccctttcaaaattgagaaaccaattctacctaaattgggccgaaattctttttctccttcggcccaagccggcccaatacccagccgagccgccaacttgcaccgtgccgtgttcgtcctccgccgctgctgtgccttaccctcctcctccgccgttttctccttctctaagaaaccgtcgccgctgccctaccgtcgccgccaagtcgcgtcgatgctgtgccgtgttcctccttccccgccgcccaactccctggcagccgacgtgtgtgcgcgccgccgtcgacatccaatcggagcacagagccgacgccgtcgttttcttttccacggcgccgtcacgaagttttccttgatcttcccctctggaaccgccttgcgccaccgccttttgccgcctataagtattcggcgaggctgccccttttcccctccacaccatcgagctctccgagctccttctctctcctggccattaccggccaccaccatcattggctgatctccctcaccggagcaataccggccaataactcgcgccatcgagatttcctcgattagaggattccatttttccccttccccccttcctccacctctgaatcaaacctcaccgaagctctctctctcctcccagttcacgaccttgcatccgccgttccggccatttccctcactccctttgcaggacactgcccttcctaggtgcgctgcactcgggaacaccaccggccgccggcgtcgttgccttccggccactggagctctggcgcccctcctctccctcctgtcagtttgctcggcagtagaaggaagaggaggaagacgacgggaggaagaagaaaaggaaaaagaaaagaaggcagacactgacaggtgggcccctgcacagtaactcttcgtattttctctatttaattcaaatcctaatctttagaagcccatatctcctaaaccgtagatccgattccattcaaacttggacctaaattcatataaattcaaaatctatattttgataccaaatttgctattttaagattctgtttgaatttccttaatttattcaaatactattagaataaatatttgattaaatcttacaattgaatttacaacttaaatttatatttgcttttcaaatattttattttattccaaattacccctttagccactaaaaagccgccggttggaactttacgccttccatggggatgttcgcggtttactatcctcgacgtcggaccgttggttgtaaagcccgacaaaaaccaaacctaaggtcgaagtgctgctcctagcaccccacgccttgatgcgtatagcggtcggagcttcactattccctcgacctccacagcacgccgcacagttagctctcgggctcttttgatcttagccgctccgccgccactcacggttgtcggagtaacacttccgccccaccaaacctacaccaacctcatattcctctagccgatatactgtcggtcgacaccggctagagaagacactaaatctagtcattatgctgccaactctagcaacgactagcaaacaaccaaaccctagccgataccttgctagtcaaatcccagttgtcatccaaattccatactgtcacgccccgaactagtaccgaccggaactagcccgcgacgctccaaattaacctgttaattgataccagtcccaggaaacagtgctggtatcacaggaagacagattatcacagcaacagaggtctctttattatagagtagaggtacagtcatgttgggctgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggctacaaagaaagggctgctgtttttgcaattgattttatttgaactcttttctgaaaacaactaagtgagtgcttctcaaacgacacggatgagacagtgcgtctcgtccggtcggagtatgtgcaatgtatcagtctttagaattggccaagattggtacccggccaacatctttcaaacggccaaccgggccaacaactttcaaacggccacccgggcctagctgatcccatcagctgtagatttctcaaacatcgatcccctttttcacaacggcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtttctcggcatcaaggctcccctgataagctagttactcagccaggggtgtcccattccacccatgtggtcgtacttgtcttatgttcggatgaaaatccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtccgccaatctgccttgtagacgggacaaacagattaagtgcgatcctatcaatgcataatatttttcaagcaacataattaacttcaaatataggctcaagatgttcaaaggtggcttgccttgctcgagatcttgggcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaagaatttaattaaatcctttttgaaaaagaaaagaagagggggagggaaattagacttttcctcgggcggctagggcgcggcccgagagaaaaggggcggctcagccgagctaaatgggccggccggcccaaggcggcccaagcacgcgcgcgcgggaggggaggagagagagagccggtggaccgggctcacctcgtgtggtcccgggtgggacccgcttgtcggtgacacggttcaccgtgcggagcgagcacgcggcgcacgcgcgctggcgggggagggacgcggtgcacgcgcgcggttcgcggtggaacggatgcggcgggcccacgcgcagcctcacggcttgcggtggaacgcgcgcacggggaggggctgaccggggtcgactcgacccggccttggccgagttggcgccgacgtggcgcctacgtggctgccacgcgggccggcgggaggtagacgacgacgccggccggaacggacggcggacgacagcggcgagcggcggagcgaaccacgacgatacaggcgaaagcgagcacaccgggtggttgcacgagacgaggggagacgagccaacggctcggattcgccggagggagcttgacggcggcgaatcgcggcggcggcaaccggcggcgggagaaggggaaaacggcgacgaggtcatgaggggccgattcccggcggcgagagcacctacgcggctacgggaatccgatgctagcgttggattaggaggaaacgcatcgggggaggccggcgacgagaggcgcttccgagctcgggcggcgacggcggcgagcacatggcgagcggcggcaacggtcggggcggcgccggctagctacggggaggctactcatgctactacccgagtctaaggggaggagatggagcgaggagggagaacggggagatgcactaccgtgcgggcgaggcgcagtgacgagaggctgacggcgcgggagtaatctctccggcctcgggccggggaagaggaaggagagggcgcgcccggagtccccttccgcgtccttgctcgtgccggctcctccgacacgcgcaacgacgaacggcgacggcgaacagagcacgggaggcggcggcaatggcgtggaggcgaatgggagaggaaaggaaagggggaggcttgggtttataggatggcaatgtcggtttgggaaccgacttagggcgggcaaaggagagggctagcgctcggcggtcgcggccaaagcggcgacagggaggagggaggaggatgacgccggcgggaggaaaaaggggaaaagagggagaggaaagagggcttgtcccttgcctcttcgggaaaaggacgagggagcggaggcgacgcggcagagggaggaggagctctgcctctgtcctttggcagcttgcgcgcggagtggcggggccgagacgatgacgacggcgatgacggcggggcggtgtggagcggagcggcgacacgggcgacaggcgcgggcaggcgcggcagaggctgacggcggcggcgaccaggcggtcggccaccacggcacgcgcgcgcggaaagcaacgggcggcgctgcggtttgagcggcgcggctcgggcacgcgcgctggcttgcggggccgagcagctgcgcggctgcaggtgcggcagggcagcggggccgggtgacgcggacggcgcaggcgcggcacgggcggcaaccacgcgggcgcgcgcgcgaacaacggcgcgcgggggccgacttcgcgggcggggagctcgccaggatggagactgggagagggaaagccgagggggaggcgcccggcgcggcgcggttcacgcgcacgcgcgcgcggcgcgcgggcggag

SEQ ID NO: 5545 - DNA, 6829 bp, Oryza sativa
ggggagatgggccgagagagattcggcccatcgaacccgggggaggcaaaatagacttttgcggaggaattgatttgggaagggtttggattcgggattgaactcgacgatagatcggggatttgagatctgagatggcacggacactagacaacaagcaaagaaacaaatttcgcaattagggtttttaagagataattttcctgctaggcgccacgacggaacgggcgctacagaccaacccccctaacaagaatctcgaccccgagattcagcacctaagggagcagctccgggaactcggcgcggagaagatcttcttgctcctaggttgcctcatcttcagaatggttgctccattggactttgtagaacttgatggtcttccttcgagtctgacgttctgcctcttcaagaaccttgatcggtctttccttgtaggtcagattcttttccagcacgatattacccaggggaacttgttcttctggaacacggagacatttctttaactgggatacgtggaacacgttgtgcacatctacgagaccttcaggtaactcaagctgataagccacttcgccacgtctggcggttatgaggtaggggccgatgtagcggggtgctaacttgccggacattccaaacctcctcataccacggaggggcgatacccgcaggtacacatgatctcctttttcgaactcaaggtcacgcctccgattgtcagcgtaattcttctgacggttctgcgctgtcttcaaacgttctcggatcagcttaacttgttcttctgctgccttgagtatgtcaggaccgaataccagtgcttcgcccacctcattccagcacaagggagtgcggcactttcttccgaacattgcctcattcggcgacatctgaatgctggcctgatagctgttgttgtatgagaactccgcatacggcaaacaacaatcccaagtgccttcgaaatccagggcgcacgcacgcaacatgtcttctaggatttggtttaccctttcggtctgaccatcggtctgcggatggtaggccgtactaaaatttagatcggttccgagggcttcatgcaactgcttccagaaccttgaggtgaactgagtgcctcggtctgacacaattttcttgggacagccaaatctacatacgacatgggtcatgtagagttctgctagtttctttccatcaaaggtggttttcactggcacgaaatgagctgatttcgtgagtcggtccacgattacccagatggagtcgtacccgctaggtgttcttggcaaaccggtgatgaaatccattccgatctcttcccatttccactcgggaatcggtaggggttgcagcagaccagctggcctctgatgctctgccttgactctttggcaaatgtcacacagggctacgtattctacgacatctcgcttcattccggcccactagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaatcggtgtctttcttctcttgtattctttttattaattcttttatcccttcgtcatctttctgagcctcccggatttgcgattctagggttggctgcaccgtcaagctggcagggacacctgactgtaccacggtcagcctcaacttctccaattctctgcacaggcggtcttggtcaggccgtatttgagctacattactgtaggccttgcgacttagcgcatcaccgaccacattagctttaccggggtggtcatgaattccaagatcgtaatccttgattagttccaaccatcttctttgcctcatatttaactcggtctgagtgaagatgtacttaagacttttgtgatcggtgtatacttcacatctgttcccgattaaatagtgcctctagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttcggatatctagcaaggtgagaactggggcagtagtcaaccttttcttcattttttgaaagctgtcttcacaggctgcagaccattgaaatttattttccttctttaacagctcggtcataggtctggctagcttagagaatccttcaatgaatcttcgataatatccagctaagtcaaggaagctgcgaatctctgacacattcttgggtgggttccaagcaagtacagcttcaaccttgctgggatctacttcgacaccgttggaggagatcacgtgtccaagaaatgctactcggtctaaccagaattcgcatttcgagaatttagcgaatagttgatgatccctgagcttttccattatcagcctcaggtgttcagcatgttcttccttattcttggagtatatcaggatatcgtcgatgaacaccacgacaaactggtccaggtattccatgaagattttgttcattaagttcatgaagaatgctggagcattggtgagtccgaaggacatcactgtgaactcatatagaccataacgcgttgagaaagcggtcttcgggatatcttcagatctgattttcagttggtggtaacctgatctcaagtcaatttttgagaaaactcttgctcctttaagttgatcgaacaaatcgtcaatctgtggcaacgggtacttgttctttatagttacttcattcagggctctatagtcgattaccattctctcagagccatcctttttcttaaccagaagcactagggctccccaaggggatgagctaggtcgcacataactcttactctccaattcttcgatttgtcttttaacttctgctaactcattagctgccattcggtagggtctttttgcaattggtgcggtgcctggtgccagttctatggtgaactcaatctctcggtctggtggcatactcgttaattcttctggaaatacgtcgggatattcatagactatgggcaccgactccaaggaggtgacttgtaaacaggttaggatagaccgacttgcggtaggggtgttagaggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctagaaagtcaacttcctcaattctaaggttaacttccgggcatatttgagtggcccttatattcctcccaggggaatgtactatcattggtacacgcaaattttgggttttccaaccatttcttttcacaaaagcttgtgatatgaaagaatggaaagctcctgaatcaaatagaactattgcgggtacggagttgacagagaacatacccatcacgacgtctggagcatcctgagcggtctcagcttgaatgtggttcacccggcctcgaccaaagttgttggaagcacgtgaaccttgtccacttgcctgagagctaggacgaggctgagctgccgctggagtaggagttctggcagtgctgccattagcatgccctgagttggtgttggtaggattctgagggcactgtctggcatagtgacccatctggttgcaccggaaacactgaactgctgacggtccctgcggtgacttgaaagaggtaacactgtttggcgcagtattgccactaggggcacgctgctgtggctgaggtgccggacggttcatctgaggacgaggggcgtagcctggctggcggttagcctgagtgaccgactggtgatattgcatgggttgaccgtagcgagggcgaggtgcgcctcgggaagaatttccctgatggttagacttgcgtttcttgtattcttcggtagcctcttttctggcatcttcaagtagaagtgccatgttgatcatatgttgaaaagtggggaagtcatgagcaagcaactggagtctcattccaacagcgatccctttcaagaatttcctgatcttcttcttgtctgtgtccacttcctcaggggcgtaccgagccaacttgttgaacatacttaggtactcattgacactgctgttgccttgcttaagtctgttgaattcctctttcttcatgtcaatagtgctttcaggcacatgagctacacggaaagccgtagcaaactcatcccaagcaatgttagtgggttcagggtgtgcattgcagtaattctcccaccaatctgcagcaggtcctcttagctggtgagaggcgtagagcgtcttctcaacaggagtacactgcactaagttgagttttctatcaacatctttcagccaatcgtcagcctcgacgggctcgacggtctgagagaactctggcggacgagacctcagaaaatctgtcagcttggatctattgttgctcatgtgagggtggccatttccatgcgcattatgctgaaaaccggctacggctgcggctaacccttgcaagatttgtgtctaaactgccattaagtgctgcatgttgttttccacatgaggtggggaagggaggcgttcttctccagaattgtgactagcagtgcggtgagagcggtgagactgttccatttctgcattacgggaagctgtgtgatgcgagcggttactgcgacggggttgctcaacttctgcgttgcgggaagcagtacggtgcgaacggttgctgtggtgagactgctcattagctgactcatgatttgcttctggctcaactctaccatcctcaaaaccaaagcgggctggtgcacgagcagcacggcgggggcggctaaccatctaaactcccagaagagggcggggtaagagtcagataagcacttaggagggcaaggagcaaagtaaatagcaactcagatagcacacactaggcataaactggatttttcatatcataaaaacacctagtacaacgggtgtagacaagtcacagagctacgccgagcttgactgtgcgcacaccacctaggagaaccagactaccaaacaatacccacaacaaacacacgcacgcactacctcgccacgactccaaaagagttggcggcggaacaaaagggcctaacacacggacggctgctgaagactgcctcctctactcctcgtctgcctggctgcttcctgtagtcggctcctcagtcgaagaaacgtcgatcggctgacgcgaagggaccggcggaacctgtcgagggccggcagcagcacgggccgctggcggtgggggagctgggtagtcgaaacggaacacggtggaagaaccaacaacacgcttccgcgcagtgcggataaagcgtgggcctcggcgggaggaagcaactggggtgtgtccgggggtgtaggaagggctaactgggtgtgggtagggagagtacactggtgagtatggcgcacgcgagctgggggagcgcgggccactgggagtgcgggcagagccgcgggagctgtgggaggacaggtggctggcgtggcagaggcggcctgagtcctaggagacagtgtcaactgaggtgacaccctcctcggccagacgggcctccaaagcagcgtagcggcgggcaagggagcggtaagcctcaaggagtaggtcgtgctgagtggcctgagcctccgaaagctcaaccatgcgagtcagcactggctgagactcgctgtaaggacaagggtacctggcgtctgcgtggccagaaggaaggcgtggaagctgccggaaggcagagcccccgagacggtggctgtagtcgtgggccaagcgacgaagcgcagtccaggagaggtcctggtacgcgatctggagagtgggcctggccacggtgaagtggtgtgggcgaaggccagctccgtgtatacctccacgagggtaaaggtacacagagagctcacaacgagggggaacacggtccacggagtaccccgtgtactccggacacgagaagccaacaaagcgggcgaggtcacgaagctgagcaacgtggtgaccctcaccaaaaccgtgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacgtcgggtttcgccctagggccaagcctgtgctctgataccatctcttgtcacgccccgaactagtaccgaccggaactagcccgcgacgctccaaattaacctgttagttgataccagtcccaagaaacagtgctggtatcacaggaagacagattatcacagcaacagaggtctctttattatagagtagaggtacagtcatgttgggctgcggacagatcccgagctcacaactgcattacaaaagggaagcggaagccaggacttggaccaaacaacacaggcgcgacttgggaactaggccgaaaccctaaaactcatcgtagccggcttgctcctggaagaactcctcatcagcaggatccacttcatcttcttcagcaactgggggggattatttatatagagcaagggtgagtacaggagtactcagcaagccatgggaaataagtgtttaatg

SEQ ID NO: 5546 - DNA, 914 bp, Oryza sativa
cgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaaatccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtctgccaatctgccttgcagacgggacaaacagattaagtgcgatcctatcaatgcataatatttttcaagcaacataattaagttcaaaggtggcttgccttgctcgagatcttgggcttgatcctcgaaatcctcgcactgcgggtcttcgggctccgaaactacactcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaagtaaaaggatttaattaaatcctttttgaaaaagaaaagaagagggggagggaaattagacttttcctcgggcggctagggcgtg

SEQ ID NO: 5547 - DNA, 768 bp, Oryza sativa
tacccatgaattcagaaccccagagtccgcacattcttaaatacaaagcactttccttattaaatgttaggtaaaattggcccgtccaaaaaattttccttttaccttgccttaatttattccccaataaatgaatgccccttggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtga

SEQ ID NO: 5548 - DNA, 13273 bp, Oryza sativa
cggtgcacgtcgaagtcggtggagcggtaggtggggacgagcaggagcttgacgcatgtggcggcggcgaaggtccaggccgccgcccgcgccggggaggtggcggcggcggccgccattggggacgagtagatctggtgatctccagagaggggttgcgtttcgggtggttgcggtgatgagacttcagaaaattcgtaactttagggctgtttggtttccggagacttattttaaatccctgtcatatcggatatttgaacattaatttagagtattaaatatacactaattacaaaattcatttcatgagcttggactaactcgcgagacgaatcttttaagtctaattacgccatgattttgataatatgatgctacagtaaacttttgataattatagattaattaggcttaaaaaattcgtctcgtggatcatctcttatttatgaaattagtttttttattagtccatgtttaatactctaaattagcgtccaaacatccgatgtgacatggtctaaaaagttttagccccatctaaacaccccctttgtggtagtacacaggatcgttactggttactcattttcatttatcgccaaattgtgagtaaataagtactccctccgtttcaaaatgtttgacaccgttaattttttaagtacgtgtttaaccattcatcttatttaaaaaatttaagtaattatttattcttttcatatcatttgattcattgttaaatatactttcatgtacacatatagttttatatatttcacaaattttttttaataagatgaacggtcaaacatgtgctaaaaagtcaacggtgtcaaacattttgaaacagagggagtactccggataccagatatatacatattagtagtacgattttgctatatatttgtcgacaaattttctcctaaaaatttgacagatgtaattacagtacaatcgtaatataattacactgtaacttgcatgtaattacactgtaactatagtgtaacttgtatgtaactttcaaaaatgtctctgtaatatgttatttcggtaaaatagagattgtggaaacaaatccttacacatatatgtgtgctgtgattttatttttcttccttaccaaaacaaatcttgtaatagatttaaagattcaaaattaaatgaaacttatttacaagttacactgtagttacatgcaagttacagtgtaattacatataagttacagtgtaattacattacgattgtactataattacatctgtcaaattttttggagaaaatttatcgacgaatatataggtggtcccttagtagtactaaacaaccgtgttaagtacaaagaattgcacccccgccattatttacatggtattgtactcaattaactataagagaatcgttgaacggttttaaccagccatccgcgtccacgtaggaagcgtccaggtatatctgcgcctgctgctccgtcagcggtttggcatatggtactctaccggtcatgttggcgcccacacccgtacacatgtattcaccgtagaacatcgtgctgttaaaacaaataaaaccgtagtatacatgtttagaaacatacagctaatataaaatgaaacggaagtagtagtagaaagaatacgtacgcatctcgttgcgggtcgtcccagtcgctccaaccctcggcacaatgataccgggcatgtccgtgtgcgcgaagaccacgcgggagtagggcctccatgcacggcccaataaaatcagcccactgccggtgatgcgacaattgacaaaggcaaagcccgtgtcatcggccgcgtattcacggccttgtgcacatattgcaccgttgatcccatcgcttgtagctaccgagttcaaaatacacttctgaaaaacgcacagaaacttggttagatgcatggcaagtttgttactcactcaatgaaaataaaacgtaactagaaccatcgaagatttgtgtggtacgtacctcataaaatgatctgccgttgccaaagataaaatcaatcgaaccttcaataaaacaatcactaaagtaatgacggcctaaatcatcaaataatgtatcttggtagctatacatgccgcaacccaaaacgctgcttgatcacctgaaactctaattgctacagcctgtccgtcacgatcacccggctttggagctggggatgcattctacacagaatgaatcagtagataaactaaacccttctgccgtatacataattaagcaaattaagttttgtgagcacaagaacataccttaaaactgatgttgttcgttacaaatcctgtagcaaaaacatcaacggtggcgctgtaaaatgtgcctgtattttttgcgctattgttccaaacgatgatcgtcgactcaaaaccttgtccttggaatgttacattaggctttgaaaagttcactgtcaccttttcactgtgcaaaagaaagtgtacatcccttaaacaatgcatgaatgtatccagcagaattagcagtccaataaattaatgcaaaacacttacatgtatgtgccggagttgattcaaacgacacttcttgtcaatctattttcgggaatcgcatcgacggctgattgcacacagctgaagttgcagcatccattggaatcaacgcaataaatagataaagcagctgcatcactaggaggctggaaattagcacatgggttattcctaaccgaagaatcagtgaaaacaggtaagcagagtatagcaactataactactatgcaacacactccagcagaacttattaacccaccgggcatacataaagatcatatcggctgaacctctagtgtatacccaccgggcatacataaagatcatatcggctgaacctctagtgtatagttgtatgaacccctttgcctcacgatatcgattaagctcaaggctagatatgtgccatcctctaatagctcaatcattcactcgaacctgttgatagattatataacttgtgattgactcctcaatcacctttggtatggccatgcacttccataatctgcaacatcgaggggtccagagatatctctccataggaggggcaaatcccatcttgattattcatatcccactatacatgtttcatagcatactcgaaaactacttttataactacccaattacggagtagcgtttagcagtccctaagtaagctactacacatgttgagaaccatgataatctcaggtctaaggattcaacatcaacactcaatgagatcactgatgacacaacacatatggctcttgcagtgtctcatgttgggtctacctaacaacatgttcaccaacatatgtccacattattaatttggtatctctataccatgatccatgagacataatcatcaattaatacatgtgctgatcatataaacatatttgttccacatatgatatttgatcagggatcctttagaaatagtaacaaacaacataaaaagtctcatgaaagaatcacatattcattaaccaataaggagttatctatttcaaggaacaatgtcggataaatatgtaaacataatatgtgatacaatcatctctatgattgcctctagggcatatcactaacatgaagtagagacagaaagtgtgttacacgccatagagaacatgtggtatggtcttggtgtcttttttcttggagaatgttagtagcataatttggcttttggttaggtcattttagacaggccaaattatatagaatagttggtgtaattgttttagtggtttgcttaagaattggttagcttgacaagggcaggaatttgtgatgcatcgggaggtgtacgagttgctggggagctgcagaaactagagaagaaggttaggacttgggaggctgcaattctcagattttgtcagttcaagcagctagcatgcagcgatggagcttttgccgattcaatggatgtgaggcttcagtggttgattttatgtggctggggttggatgcatggctatgtttgatgatatgcctgttgaagtctagccacacaggatcacattgttgccagagtaaggggagacaaattctgaaacttgggctggagcagcgttgcaggatagaggcgactttcggctgaggcgtgtatacgtctgcatggaagctgtcgtttaaaaatgacggttttgattagatagaattaatcacggatttacctagagttttctatatatgcagtacagtgtattcctttactatatactatggattttgcacttggtagggctctggaacaattatcatcctatattattttcttctactgttttcatcgtacttttactcttgtttctttggccaaatcctagttatctagggtgcagatgatctttactggtttgcgctgaaaatcagtcgggttcttccacgaaagtgaagatctttgctagtttgcttgaaaactagtcgttcgtcgtcacgaaagcacaacggttttcattgttgttgcgtgaatcaattttacgtgtcaacagagaacagatggtgttgttggtgttatgcgtgggaggtttttataagtgaaatattggatgaaaaaaaaaacaacgttaacttgcaggcatgctaaacagccattgcttcatttttgttcgatcccgtagcccgatatgagaaatcaagccgtgaaagtaagatagtattgcatatacttaagaagtaagatcacattaggttgttcaccggccaattccctcgaaaataaaaattgttcaccgcccatgaccatatatatatatagcatgttcaggtctgcatcttcttcccaattacttgatgatgcatatcttcagcctgtggcgtcaaatcttactaaattaactgaagaagtaggagaagccggtggcgtatactaaaatataacctatacgtggaacttgcttgatcatgtccatcagccgtcctgcatctcgtcttactaaatcagcacgaagaagcataacaggagaaggcgagtgggcgagtggcaatcccacataatccataatcgcatcacaagggctcgtgcgcgcccatggcacgtgttgtcttggttcactacaacgtacactctttgtcatcacgttggtgtgatccataccacccataacctcatctctcctgccgtgttttcagaacaaagtgtttgttagtagtagacggcaatgggagtccgattccaatctgaaagaccacggatcaatccatggtgcacttcttcctcccgagcgcgcgccctttgctagcacttcttcaaaaattgacggtgcaggttgggccttccgggccttgaggagagaattggttttccgttcggtcccttcctcatttacacgtgggccagaatttcaaggggcagcccagctttggatttccttgtctcgtccacagctgctgaacagtcgtgcatctttctttctttctctttgaaaaacaatgtatttatttatttaaagaagttcagaagaacaatatactccttccgtcccatccagttttgcaaaggagccccttaacaatgggcagattacactttagctcaacattttgtagtaaaggacttaagaagaaaagaaaaaaaaaacaattgagtcctgctcgaactgcctctgtcttcaacgtcgacgacgaaactttgaatcctaacatcggcggaggttggatccaagtgagctccaagtgagctccacaagatgacgccaccgcacaatccttaacggggcctctcatagatgatagatggaggttgaggagatggcaaacaaataacaacttcagctacgccgaagggcgacgcgggcggcgaaacctcgccgtcgcctcctcactctcctcctctcccccaccttgccgccgcctgagcagccgccggcaaagccgggcgactgcgaagatggcggcggcggggctcccttctccctcactcccggtcagccggttggggcgccgacgacaccaaagagcgagagcgtggtcctggcaacgacagccaaatccggcgccgttcggtttggatccggccccttggccagatctgggttgggacgcgcgggtcggcggcggtgtggcgcgtgggccacgcggaggcggcagagtgcacggaggcggcggccgcggcagcgccgcgggagacgcccatgcgaaggtggtggggtagaggtccgcggctccggcgacgggcaggcgccagatccggtcgccccgcttggccgaggcgaccggcgacgggctcggtcgatgccggcgccgctccacggacctggcaggggggtggctggcggcggcgatggtggcggatgtagcggcgacgaagttggcgacgaaggcggcggactacggcgcgtgccgcgacgccggccctcgtcaagaaccttgccgccatgagggaggcgcggcgcccgtcaattgtacgccgtgcccgtgacgccttcctccatggcgccggcgacccgcactgtgcgctgcaccttcaggtccgcgccacccaggccggtctggacggttggcggctggcgatggtggaggctgacggtggcgactggacggtggtggctgatggtggcggctggacgggggtggcggtggcggtggtggtggcggtggcgatggtggctggcgatggcggctggcgacggtggtggctgtggcgctggcagtggcggctgtcgacggtggtgcaaggccatcatccgaggctgacggtgcgtcatcgtcggcagcggcatgtggagacggggaaggaggagtccgggtgcgggcgcgctgtcaagaactgtgggcggtggccttggccgaatttctaaagggacaatgttgttgatcgatgaagatccttcttgtgcggattagtggtgtgggtttggacagggaatcgcgggcgaaagccttgccgagccgtttggccggctgacgacggcgacgccgtttggcatcgttcccctccttggaggcgtcattttagattacccctctccttttctaaccatattctccgggtgaaaaccttgcttccttccgaacgagcggtggcggcgatccacgtcgcgtcctccttgggggcaccgctttggagaaacctcttcgtgcaaggattgtcaatggtctatgcattggcttcgaacttcagtcctaggctttgacgaggccttctagctccactttttgttttgcttttcttagtttgtgtcctctcttttcctgtttggtgtgttcaacttgtcttgaactacactctcttctggagtggaattttgtaataattggctgtagctctttttgagcaaaggccgagatattatattccattatctaaaaagctacgccgaataagaaacccaccagaagttttgataggggtcgacgccaaagcagataatccaaagaagccagccccatccataccaccggcaaggatagcaagagtaacaccactaactgcaaaagaaactgaggggcatccccgattagggcctccacgcatgggaggttgagaccatctcagcaaaacttgaaaccttcagccgtgtaattgatcttcactggaggtcaagaagaagaccacctcctttgtatagaactcgtcggagaaatcgagaaaggttggcgcaacctttttttcccagatctaaaagtatctcatccaacggctgggagaagaaacccggcaaagaggtgaccaatcactggctaaaaaaccggtgatgctcaccacaccaccaagacgaggagcgtcgaagccgacggacaccttgagcagtaaaagatggatgataacgagaagaactcgaactaacacgatgacctgaccaaacgagaaagcaagactactacttacactactagatgagaagagacatccgacccccctttcatccatcgttggtggtgatccaccggagaggaggaagaggggtcggagaatgaacgaggcgactgtagcggagattcgcaaaagctggagtggccgaggtctctcaaattctcagcagtatctttttggggctccgaacagtcgcgcatcagaacccacccacccccaaatatggactatgggcatttaacattttgttaagcacaacaatagcaacagaattcatagaaacaatcagacgcagccttgccagcaaactgtattagctgatgcctggaaatggcatgatgctacccacagcctcccaatacaatacatgggtagagtaagattaaggaggaggagggggaggtggacctatccatgcaacttaggctaattgtattaatgtaccaactggtacacgatgtcgctggttaactttgaaatggcctcgttgtacatgttctccgagctcaccgggttcttgtgggcgcttccctcaaacaacattatatcacagttgccgggctcgtccgaggcccggtgcagtttgtagaacgaggtaacggcggggcgcccgacacgcaggtcgtcgatggcgctggccacgagatcgtccatgtcctggtagtacttgatgcagagcttgagctcctctaccagctcggtgaggacgcgtaccgtggacgtcacgttgcgcatcgtgatgttggccgcggcgatggcgaggccacgcttgtccgtggcggaggcgcctgccggatcagccgagagcacgcccaagcagtagccatagttggaagttgcggtgcatgtctcgttgatgagagatggggaacccaccgtgagaccgggggctattgcggcggcgaggaggagtgtagcgatgatgggatgcatcgggaattctcaggccggggagaagctaatgatgcttttttgtggtttggctcctccaggtacactgagatttatagaagagaaaggaccttcaaaaggaaactgatcaatgtaataaattctaaattcaatgcgattgatcatgaaaatcgactctttaatgtacttccggctatattccaattctttcctcaataaattgccacctcctttaaatgggtgtacattgtgaataatcacaaatgtgtttgtgccgcgtgcaaacgtccgcacgtgaaacagaacatcccctcgtgcgacccttcgctctagtacgtgcctacgtgctctcctgcctgctccccacgcatcgtgcaagagtgacatttataagttcagggggagaaaacccatatagcattattggaaaatcagacttagtactcatttacagcaaacatgaaattatagatttgaatcatatttaacgcaggagtatagtattttactaatttccttgtgaagcagatttcataaaaaaaaactcatggaggccacttgaaccgggggaggctaatgggcgatcgatcgccagggcgattgcccagtgatcggtttcccccctccccctatactcctccctcttgttcccttcctcctccccttcttctctttccactgcagtgcaccacacaatttttttaaaaaaacaaaagttagaaaaatttatatatagaaatactatataaaaaaatttgaattcaaattcaaatttgaatcgggtatgtaaacttttaacttataaactttgggtctataaactttaggtgtataaactttagatgtatagaaatactatatatagaaaatatttgaattcaaattcaaatttgaatcggatataattcaaattcaaatttgaatcgggtatataaacttttgacttataaactttaggtctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaatagaaaagtaatgcggtgccaaaaaaggaaaccaggtggaggggtggagggagggaggggggaggggatcgatcgctgccccatccccagggcgatcgatcgccgaacaacattctcgcttgaaccgtggctacctgacggcccacatgcatagtagagtaaggaaataagttcactttattcccttacctagtggcataatctgattcgtatccttaaaccacaatatcagatatgttgaccctcctaagtcctaactattaaaaccggtgcaatttgactctgtcggcggttggagggtggtttccttgacgtggtgactacgtagcggcattgacttggtcttcatcttacgtgacgttgacgtgacgcttatgtgatactacctccgtcctaaaatataagaagttttaggcttgggcacgagcattaaaaaagtaggtttgattaaatggaagagggttgtgattagttgagaagagaaagtatgtgaagaatttgaatggtgaaaggttatgattggttgagaatgaatgtaggtgaaaaagttatatacttttggacaaactttgaatgctaaaaattgttatatttttgaacgaatggagtattagaattaaaaaaaatatgtgagacccatttgtcattcacaaaagaaatattgtgggacccacacgtcatcctctctttctccttcccttcttcctcctccctctctctctcccttctctctctttctatttctctcccctttcgccttttgcagggagagctggagcagcggcgaagctccgacatcttgaccgaccggatggcgatggtgacatgccattgctccccgctgccttcatgtcccggagctcggggtatgagaagtgcgacgagtggaagtagcacgaggaatggaacaaagtcgacggcttggtgccattgtcggacatagcaactccgttgtcttatcctcccacctgggctctttcctcagcccgaccaactctggcaacgtctttacaacaccgctcgtcgtcgccatggtcggcctcgacgtacggcttaacgacgtccaggtagaacaggtccgggccaggatcgaagctaaccttgtgttgtgccgctttggtaagcacccggcatggccctcctctggaacctcccgcacgccaggaacaccatgaggacaacgaaggagcaccaacaccgcgtcggacagcgcgacgcccgtggcgacgacgacaagtggcatgctcttactcccttcctggttgctgcctcctgcactgcaccgtctgtgcgccatggtggtgttcccccttctgtggtcgactctaccagcgacggggtccgggaaccgtgcgttcttgtgcggtggcggcaggtgggcacgagccagcgccgaagagacaccacctctatggcgatgccgatgctgctgccgcctatccaagcaacaacctcatagaggagacgatgagagagagagagagagaggaagaaggtaaggagaaagggaggatgatgtgtgggtctcacatgttagtgtctcccggctcccgcaatattccttgttgtgagcgataaatgggtcccatatatttttttcattctaataccacataagcaccacgtcaacgccacgtaggacaaagacaatgtctacaccaccacgtagttgccacgatagcgaaacggcctttcaaaatcatcgagggagtcaaataacatcgattttaatagttggggtcgacacagtgactagttaaggtagtcaaagtgaacttattcttagagtaagcacatcaggcctcatcgcactcgtataagcatagtagagcccaatggctgcatacatagacaaatccaaaagcccagagccacttcccacttggaaaaagtacaccgaaggtcccccaacttgtcatggagttacaaaatcgtcctccaaccataaaaccagatatctagcgtcccttaactaataaaaaccggccacaataggtcctttggtggttttgacaccggttttatcctacgtggcggctgattcagccatgtcaggctgagtcatctatcttccccttcttctcttcctcggttcctcctctctctctgcacctgtaggtcggttggcggagcgagggggaaaaggaggagcgcggcgccgcgatggcggccgccggcggcggccacagtggggatgcccgacggcagcccggcggagctccacgacgcgggcgtgcagcgaccttgcgcgggcgtcgacagggaggcgcaggcgtgtgcaggcgtcgcgggcggctggaaggcgcgaacgacgcgggcatcgacagggcgaggcgggagaggaggaggacggcggcgcgacggcggccggcggtgggcggtgggcacgaaggtcaagctcccagccctcaaccgagctcgagcagaagggaggtggtgctcaccgacgctagttcatggtgctgttcattttctcagctcgatactctcccgctcgtcaagctccactacttgaccgaacaaatcgcggtcacgctgactcaaaacagagcgagcagaaaaccatgggaggagggaaaatagctaacaaactaacagaaagtaaataagagtataagatcaaggcaagatcaaatcccaactgacataagttcatttatttaacacataccaccttctccggcaccacggcagcatcatgatgggccagatcaccccacggcgatggcggcagcgccgctttccgccgctgacattccaatggacggtgcaccccatcgagttgtggagctggttcggcgtctccggcggtgagcagctgagcttggcgtccgctacaccaaggtctagctggtcggcgagttcctccagcgaagcggttcaactacggcactgtcattgccaattcgctgctgagctacccgaggaaatccggcgacgccgtcaacgagatgactagcctgtccaacctcaccgaggagctcacgctctacgtccccaccgttccggagccattcccacgtggacggttcgggtggccattccttcagctcaagatattctcgcttggatcgattgtcggtcgagcctcgccagcgtcgtttctagggacgccagttgcagaaggacgcagtggctgatgaacccgcagcggcgctgcctaccgtcttcatgggcgcctgggcggcgacatcgtcaccggccactcgtcggtggatgcggcgtcagagctggagctgctcccgtcgacggagtccgtgaacaccgtctcgctcggggcctccctcacattccgtcctgctgccgtcacgtctccataaagccatcgccgccctgtcgagcgagcgtgcggcgg

SEQ ID NO: 5549 - DNA, 5246 bp, Oryza sativa
ccgcgcgcccgtcttggccccgtcgcttacgcgctgaagaagacaagagaagtgaagaaaataaaagagaaaagagaagaaaagggaaaaaaagagatgaccacgtgggtccacgctgactcagccgccacgtagaataaaaccggggtcaaaaccatcgaaggagctattgtgactggttttgattagttaagggacgccggatatccgattttgcggttagaggatgattttgtaactcgatgacaaagttgaggaacctttggtgtactttttcccttcccactttcatgcggcctgcagattgcagatccaactcttcggccttctattccttcaaccgcggcagcccatatattcttgccacacaactatatataggcttgaatgcttgattacatttatgacccatgaatgaagccatgtgcctgcatgcaactaaccgccatcaaatgtgttaggtttctcttcttagcgtctaaattaagctgaaacaactgatctgatccttctttccccgacgctagtcgctagatgctggttcggttaggttgttgtatcttgtgctaaagaggccagtacatgaaaggtatgcatgtcaagttgtcaacacgataagttgcaaattattgtctagctaactcctaatggagctttttaataggtggatagcactaacaaaaaaaatcatcctttctgcaagggacaaatgtgattatggtgttaacatttgaccgactaatagtgaatttgatttaagatgcattttgttttacctagaactcattctctaatatatctagcgaagaataaacacgtgatatcgttattgtgattttgatttaagatgcattttgttttacctataactcaatctctaatctagcgaagaataaacacgtgacatcgttattgtgccacctcgattaatgattattgagtaaattacagtttaggcctaatttttccctagtgcaacatgtgaccttttatcagttttggaccaccctttatcctgacttttcacttttgacttgttaattttactacgtggcactttggttcataaaactttctttcttatctattaacatctagctcatcctatgctaaactaaccgtgggagttgtttcttctttgtatgattaaagtacaattctttgtatgcttgctgcagcccgtgcctcgcaagatccaagcaaatttacatataaagtaagatttaagacaaacttggcatgttaattaagagatacggagtaccgtacgcgtgtagaattagaatcaatctctagctagggcctttacatgcaaacagactcaaaagagttttgtccgatttcctaaaccaattaactagagttagagatgaattaggctataatacacatatataaataaagcagcgggcaacgaaccactgtagaaccgtaatttggatgcgtttttgttgatatgaagatagatgctagcggcgagcgacggaaatccgaagcagcgggtcaagccgtgcggctgcacagtgagccgtatttgggtgatgcacacgtcagcaaccagaaaagcatgatggcatgtgcacggatttttatttgattttgaaataataacacaataaaaaatgaaagaagagttcatgtagaacacaattaaagattaattgaaatccgtaataaaaaataaaatagatttagaaactagaaaaatcaaatataagagttcaagtaaaaatacattttacgaacaactgaaattaggaataaaaaaataagaaatattagaagaataattcatatagacacagtatgagattaataaaaaatatgagattaataaggaatattaaaagaagagtgcatataagagctcaatatgagattaataaaaatttggaataaaaataaataaatccgaaattagcaaaagaaaataaaagaagagttcaagtagaaatacaatttaaaattagctgaaattcgaaattaaaaataagcaatattgaaagaagaatccatataaaaacccaatacgagattaattaaaatttagaataaaaaataaaataatatccaaaattagaaaatttaaaagagagttcaagtaggaatacaattttgaaacaactgaaattgaaaataaaaaataaaaacattaaaagaacacaatacggtaataactattttttttaaaaaaatctgaaattagaaaaagaaaaaaaagatttcaattagtaatacaatttataaataactaaattttttgataaaaataaagattattgaaataaaaaaccatctaaaacacataacgagataaattaaataacatgcctataaaagagtagagtggtggcggttgatacgacatataaaaattgttaataaaacaccaaatagaatcctaatgacgattaaaaggagggacgtcaagcaggccgtgaagcaaacgagtaaggcggttgccgggacgtctagaaagaaaaaaaaacaaaccccattgataatcatattcgatttttaaatctcaatgacaataaaaaggagaagcagcgggcggggtgcataagagtatacttgcagagccgccgacggctgacgggacttctagaaaataaaaaatgaattccaacgatatttatgttcgatttttagaatcataatgacaataaagaatagacggcggacgggctatagaggggcatagtggcatcgtttgatgggacttctaaaaaatataaaaaatggaactacaagtccaatttttaaaggttcgaacttctaaaaagtaaaaaaaaaacactaataatcatgttcgattttaaaatctcaatgacaataaagaaggaatgctgcgggcgagctatagaggagtacaatggcaaagccatagacattttggcgagacttcttgaaagtaaaattgaacccagacaataattatgttcgatttttaaaatctcaatgacaataaagagaagagacattagacgggccgtagaggagtataatgacaacgtttgacaagacatctagaaattataaaaatgaaacccaacatgacactaaactctaaaaactataaaatccaatttttaaaggtttcaagaagaataaaaagaaatagtggtagatcaagcaagcaaataaagaaggagatgacataaggggtagcaactggtgtgacttttaaaaactatataattagaaacacgagatgataagggttggtctttcaaagtcttaagataataagatagctatctaataaattttaagtaaaatcatataaaaaatatataattttgtttgggtgctagccgcgcaattgcacgggccatccagctagttatattgatttactcaatataatgagcacattacatatgttgatgatgatcggaatctgaattcagagatgccgtattgtgcgcgacggcacattagaggggtccaccagccagccaccgttttgccataatgaaggattccttgggccgattttcgggaggaatatggcaaccaccctacatccataggaaaacaaccaaatagtcttgtgttaggcatgaataccagtgacatctaattctccatttaatgtatgaacaaaaatggtgaatggacccaacgaaggggtagagaacgagacaaacctttattgtcgcaaaggtcaggttgttagcatacttgattgtgaatctggtgtaagaaaacaacattcacctctaatcaggtcaagaagaaattttagcaaactaagctaccaattgtaagaagtactatttttttcccattctcttttttcatcttcatattttgttaaacatagtgtcaattttatgtctaatttcgttcatattaaaaatgaaagtgactaataaatgatgatgcaatcgattgttttcagagataagaccagatggggatgcaagacgataggaaaatcacttaaccctgcagcctggccatcaaggtgccatgctctccaatcatcaacaatggaaaagtttaatgatcttatccatgcctgcgtgcctgagaatggcacaatagggtcgtggtctccgctgcacccacataagtttttttttttttacagagcattaagcgtaagcgatcaggaagattcaaaacaatatgtaaataagaaatgagcctgctgaaaatattgattatgctaattgaacctgtacacaagagcacggtaacccctggtggtgacgttgaaatggcattctatgctgcttggaagatcacgtgtgtaaggaagacccgtagggcaccttatccattccgtcaccgttccctatttggaaggtgatttattattgacttgtagattaattagcccctccgttttaaattatttatcgctttaattttgttctaagttaaacatttctaattttgactatcaatttataaaaaatcaataatagtttagcaacatatgaactatatattctgaaaacatttctcatggtgaatctggaaacatagtattatgttgttaaactatataaatttttaaaaattgctagtcaaagttagtaatttttgacaaagagagaatagtaaaaggctcacgaccaagagataaggaagtttacctcctttatcccgagagcagctctggtggcattgtcgtttgcccagaagtaagacaggtagtatcggtatgcctaaaagcaaaatttggcaatcgtttgtaaagaaaactcaatggaaatgtaggtgctttctcctcattcgaattacatttgcaagaaattaaaaatccaaaacacaataaatagtgacttacagcaaaacaactgaaaggaggttcaacaggtgggtcacctaaccaatagtgctcctcggttagagacttcctattggaagcatctcttcctggcattggccatggccagtcaaagggacatgctggttccaatacttctgacatgagctgtggagaaggtatatatatagatgacaaagctagctagacggtaagttcagacaataagggcaatatatatatatatatatatatatatatatatatatatatatatatatatatatatatatatatatatagatatatatagatgtcaaagcttacattgttaatggtctgcattacgtcagtgcatggtttgttggttgggttttcataatcccctttacaatttgccagggcacccttttgataaatagaaggggaaaagaataagtatcttcactgacattacatcgtt

SEQ ID NO: 5550 - DNA, 7022 bp, Oryza sativa
tttgccagggcagccttttgataaatagaaggggaaaagaataagtatcttcactgacattacatcgttaggattttagtgggctacacttcagtaaaaaaatataagattacctcatacaattggtcagatatcactccaaatgaatgagagtatggaaccctagagttcacatcaatcttatctcctgcactaggattgccgactagataaccctgaataaaagcaacaagagttaacaagctagatacatatataatttctattttgtcatctaagtgattatctgcacactagaaaatacaacctttaaattaatgattggatgacgcatttcttcaattcctgaagcacaatacaattgtcattaatgaatcacatacaaaactataattaagagctcaagaacataaatctttatgctcttataaaataataattaagccgtgattgtaagccctgcaactatcttttaacttacatatcaatttgtcaacgtaactcactacaaatggtttttttaaaccacgtaaatggtcaaaattactcattctctattgatatatgtattttctctaatttcatctgatagtctagtcaatcgtgctcctagccactcaccttcagaaagtcacttatccacacttacttcggtgacaggcactctcatcttctcattctaaccgttagcctccttaattaaccgcctccatcctaaacttgtaaaccctccccgaccagtctatgtggacatcctctgcatggcctccaacacggtttctagggcaacccatgggccatggcatgaaactatttccaccggatagaaaaagttcaaaaaacattaaaatttatttatttttgtgaacttagcaaatttattcaaatttggaatttgatcaaatgttgaatcattccattccgaaattcctgatccccccgatagaaatttacgaaccaaaatagtaaaccctacttagtgttagctgtgaaagatccagggggtctctattgcatccctatctatgtacatgtaggttcccgactgttggactataaaatccaatatgcagggcaagggctcccgcctccattggaaggagcccaagcttgaataccgggtagaagaggagttgaggagaggatagatggtagtgagaaaatgcatggaacgggggagagagcaacgacaagttacgttattgcccttggttcgttatatgtaagtgacatttcctcaagggtattttagtcatctaaattacattagttaagataacaacctaataataggattattccccaacaccgactagcccaccccaatgagaggtttccctgtaaacagcatggccctgatccactacatcttcgactcttcatcccatgtcatctcatgtgtactcctagcaaagggggccatgtggtgagacacggatctgcggcgctgtctcacggaaggtcagaagttgaagacgtataaatcctttttgcatttatgaatgatttaagattttgatgtttgtctatgtgcattctggcatcatatatatttgagaatggagatactaattttaaaatatgtcgcttgctagcatcacgaagagaaaacacatggatttaccttcagagagatactgcgtgataagaggaaccacctttccggcgtatgaatcccctccaatatagaacggattggaaaggtactttggatgatcatccagccactgcataaagagacaaaatctcaacattttttattaatggaagtttatagtagacgctagcttgctttgtctcaacctttcgtagaaatttcacaatttgcatagaagatgatatgtctccaacatcataacctttgggatcgtgcgcatatgaaaaaccggaaccaacgggcgagtccacgaagagaatgcttgccaactagaaatgtccaatcaaccacaaaccaaatggagcagcatcaaagacagttaaataaatttctcataaacataattatgtatatgtagctctcccacatatatattcagcagaaaaattgatgactgagtgtaagtgggttaatatatgaacccatctatagacttaattgggtaaaataaaatgtattgatatacacagacctacttatagactaattcgcttctatatcagtgctgatatacaaatattttgctctcaccttcgtccaggaatacggattatactccaaccgcggaaccgtgccgccgctgtaacgttccgcgacaaacattacagggcctgagaaaaaaaaaaacatggcactgctcatcatgaaccccattatcccagtcgcctctcccaattgcaacctgcgaatacatcgatgatgtccgagttgcgaatgcacgggctacgaacctatttcgtacacgaagccgctgaagaccgagcaccgcggccctcccgacagccacagcagcacgacgtcgctgcgagggctccgctccgactccacgaagtagtagaagagctccgtcccggtctcctcctccacgcccacgtacctgcagtttcatgtgatctcttgaatcgatcagagattcaggctcagagtacgcctctgcaaagaagcagagcaatgagcattctttggtgtgtgagggtgttcagttcacttacccggtctccaggtagaagggtagaggaccatcgaatcccggcaggtgggtgaccaccgtcgccgcttgggcaggcggcggcggcggcagcagcagcacaagggcgaggcaagcgacgaggcgcagcagcagagagaggtggcactggcagtgtccgtcggcatgcagccagagaagcttcaaggccatgcttccctggtccgttgatgattcagtctgttctaaaataaatatgcactagtactgtactactttttctttccctcgagtttgttaggtaggatgtgtggtgaggaaccgaggatcgtccatccgtatcgttagttgggttgtcatgtttttctccccttcatatggtccgtgcctgtggagcccgaggtctttgcattggagcaagttctataatatagtgggtcctgaactcctgatatagtgggtcctgattacggttaagacagttataactcatttcatgacgatttcacctgacttatgggtccttccatccgtgtactcgcgcctaattggtcggaggtgtgtttcctcacatgatgggtgtgttttctccttaaaatacccacatacacatatttcattaacactagtgaaattgattagtaataatctctaccactaagttggatactgtcagggttacggatgagacatacatcctatcctatgattaaccaagtatactggattggtataccccatatcttatgatttgtttccgtatgcgataaggaaatatataaaatattacggaaaatacccttacaggctagtaactatcagaatcctactcggaaaagatagggataattctatatcgtggagggtttgttgtctccgggttctacttgaagactaaggcaattcacagtataaaaggcataccccttgaggagttcatgatcatcgaatcatagcgccagcacacccaccatagtctatgaagccagaggacgccagccaaagccgtcgggagatctcgttgaatcatctcgacaaggatctcgccggtattgtcggatccatctgttctctttgtattctatggttttccatatcaatcccatataaactggattagggctattacttcacgagggggctaaaccagtataatccttatcttttatacgttatgatgtcgtatcgtgtagaaccttgtaccaacgtactccaataccctatttatccggtctacagatatcccccgtcgacagataccatattttatttcattatatgcagatattggcggttagatattatgatttaaggactgtcaacaccagattcagtactcaccattgcagccacaaacagcaagaggcatgggaaaagcaagagggtagaagattgcaattgctctgttcatcccccttcatctctttctttcatcctcacatctatggccaaaaaagctccaggtcagggattgcaattcctctctgtctcaaattgcaacggaggaagagcacgtgaagatgacaacgattgtgccattgccgcggattggtgaaaggaggcgaagagggatcatcagcgcacggtgcgggatgaggaatctcgcgaatcgtgactgccgctgccacaggagagaggggagcgatcgggaaagtagccactggatcaaccactgttgttgaccatgaaccctaggccgcctaatcgccggcgtccaccgatccggaaatgaagaggatggagaggagagggagagaggggcggtaccgggcgtagagggcggctgtcggcttcccctcgccttagagtggccagatctgccagcgaagaggccgaagtcaccggatccggcggtcccggcctcctcgttggcggatgcggcggcggaagcgagaggatggtgacggcaatggcccgcgtgctgggcggcggcaggcacggcagcagagagtgcgcgggggaggtcatcacttgcgggaagaagagaatgagggaggcggcacgcggtggcggccattgcttgggcaggagatagagcggagcgagagaaggagaggaggcaaatgaatggtggcggctagggttcgaggaagggggttagggttgtttttgttttgcaaaaacactcttaatcttctagttttcagagcacggttcgattttccaatttttcgcttcttcgtatataatattgttttctacagaggacctgtaagtaagcacgcaaaagttagaactaaggacctataacaaattatcaggtaaatcaaggacgtttttgcaaaatcgccaagtgagtacacggacgcaggagagctcacgaaaactacccgccatctagcgcctcactgacgcgtcgacacgcgctggtggccacgccagcgccaaacacagaggaagcgttaatcctagctagtttgaagtattccaatgtgcaagttcatcgcgcgcgtatcacgtggttaaactattggagcagcgactattagttggtactaatagctgtcgacgtgtgacgggtcccaaaactaatgattcggtaaccgacatatttagactatatcaagccctgaatcagtagattgatacaggttcaacaatctggatcttcattgcatacgtttgatcaagactccagaggagatgttattacaaaatatatgagtatttacaaacttgtggctaactaatacagcagaagctatatgatgactcaactctgtcgttttgctatagaattaaaccatctaacaatactagacttcaagactaggtttaaagggaactaacttctgtgattgaactcccggcttcgataagaactccaaatggactctgaaaaaggtggggcttgaagcaagggtgagtacaacgtactcagcaagctattatattcaatatgaatgtatgaattagtagtatttgagtagggctatgattacttgcagaaagcagagaatataggaggagaaatcctgcaatgcgtttgatgcaacagtatttaataaaatctggaattaagtttctaaccaaataccatatgagtctcggtactcaattccatgagcacggctattcgaatagtttcatgaatattctactgcagtagatgtacgctttacccatagtccacgacttgccaatattcattagcttagtcatggcacaatattaggttattaacaatagtggcacctgttccatgaactctagtccccatgcgctctgaacgtaacgttatcagcagcgagaggagttctggcgttcccggggtttttagagagaactggatgagagaccccacgtcatctcaaccaggtttccataaaatcacacacacagatcatgagcgaaaatcaatatatttacctgcgcctcggtaaatatcataagatgccctgctcggcataagattgcctcctgcgcgaggacttacaaaaggaaccactgtacagaggtaccacattgttaattaacataatatctaggtctgtccccattctagaagctacggtcgtactcgttcgtttgacataagtatttggtggcaattatatcgaccgggacagtactagccacccagaaatcaaccaaatcttacgtattgtcccaatctaagttcattaaattttatgcatattctaactaagcatggctaagcaaaagctagcatataactggttcgctatatgttcagattatgcattcaaaatcatgtatggctagtgtatagaatataatatagaatgtagggtatttatgctcaaagggaaggaataataacttgccttgctccaacgcaaataaatccgagataggcaacctgattatccgatcctcgaaataccacaggttaccatccaaaataaaatagactctactaagaaagatgaagaaccaatttcaataaaatccataaaatagtaagaaagagataaacggttatgtgggctaaggtttagggtatagtctatctcttttatagggtatatggattactgtgttgatattttatgcggaggttctagagggttggaggctagaggggattaagcaactactcttgcttatatttcatgtgtgggtttgattagtaggaggatgggaagtatactggatgattgaactagttgaacagatatatagcaagtatcggctgatggtaggttttggtaggatcatacctagggtttagtatttttgggtagcatatcggctagactctatattttatgtgtaggttctggtagacagaaagtaggtggctaagagtatggtggatagatagtattgtagagggtatgtgtagcgcccgttccgtcgtggcgcctagcgggaaaattatctcttaaaaaccataattgcaaatttgtttctttgcttgttgtctagtgtccg

SEQ ID NO: 5551 - DNA, 1335 bp, Oryza sativa
  unsure (1)..(1335): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtcccctgtcccaaatctttttttttcgaggggacagacagggagctcctgcaattcactatagaagaagagagttgatccagtttataagggaaaccggacccaaaaaccttacaacaacacggttaattaaaggaaaaccagcaaaaaccccgacattgacaaaccgaacctaagtacagccgtccaacaagagataaactcctaaaacgaagcctttaagaaggttacgccgacaacgacgacatcgtccgatcctaacgaatctaggttttcacccggagaaaactcttgaagtggagttgaacgagggctccagtagcaacgccttcaagaaggtgaacggcgtccaagggtgtcgccgttgctagcaccgagagcggagcaagactttcgccttggagcacccatcaaccatagcatccacgacaggagccaccaaatgtcacctgcacaccgaggatacctgcgatattcacaccacctgcacgacgaccggactccaaccaccccgttcccacccgaggacgcgccggatctgggcaaggagccagatccggctgtcttcctctccaccaacgccggccgacgcctagaggggcgccggaggacgccagtggcagccgcggggtgcctgcgtgctctggccaccaccggccgccgccggatccgggtgcgccaccgccggatccgcggcctccaccattgccaccccaacgccgtcaccatccccgccgccatcacccacaacaccaccccgcgcaactcacctcgaccgccaccgtcgcccgtccccgccgccagcccatcccgtcagatccggccggaacggcgcggatctggcggacaccgccgtcgccactccgggcggctccccaggccgcccgagcgcgaggagacgaggagcgccccgccgccgccgtccttgtggctgcgcggcttcgccggcggccgctcgggcgacggcgaggcggagaagggggtgggggtgggggaga

SEQ ID NO: 5552 - DNA, 1927 bp, Oryza sativa
tcaagagcatgaatcgtgcaagatgcggtaagaaagctggcttaaactttcagtttctggctaccggtgaacgtcaagacatgaatccatgatcaatggcactattactctcattggcttctgatgcatatatctttcttgagatcaacatctagcgctgctctgctcaattaccgaatggcctttacgtggtactacttaaaactccaaataatccagaacgatacacaaatcataatttcgcagcagatcaatatatatctgtatatttaccagtacaattttgtagcaatatatgccaacaagccacatagaaaagaagggagcgaaggcgaaaggcaaaagtgctgttcagaaggcagcacgccttgcttccactcaacgctcccacttccagaaaacagctagcacccacgttcaaagacataccacgtacggagtataaaaaaagcgcgagatgagattccaagctggctactcgcccactaaaccacgttgcatgcgtaacatgcaaggcactggacaaaatccttccaagtaaagcataaaaaatttaacatatcatcgaaaaatcttttattatagctgaatgtagtccacgatgctaaatttctaattatgcgcgaatcacgatgattaatagacagtatcaatccatggttgccggtgtcgatggcggcggcgagagggacgcagcgacggcgagggcgatggtcgccagcttcgcgaactcggcgtcctccggggccagcggcgacgcgtcgtcggcctcgccgaacgcgtcctcgcacgtccctggcgcgtccagcgccgcgctgagctgcgtcaccgcgtcctgggtggcctcgtccccgcccctggcgatgtcctcggcggtctccccgagctggtccacggcgtccgagtacacctccgcgcacacgccgaggcggtccttcctcctcgcgtccttctccgcggctctcagcgcggcgatgcgcgcggacgtggcgttggcggccttctccgcgatcctggccgcgatggcggcgaggccgcgcgcgtcggccgcggtggcgctggcgctgtcggcctggaaggccttgatgcagtcgttgtaggtgacgtacttgtggccggcggcgacggacttgcatgtgtcctgcaacacggaggactcgcaggtagacaatccgagcatgaggaggagcaccgggacgagcagacgcctcatggtcgctgggattgggtcgacggccggcgatggtgagcttgcgtaggttgggagcttgggattgtgttgtggcggcggcgtacgttctcgcggcttgtcgcgtagacgtcgactgcgtgtagacggtttcgatcagaagctagcgtgcgagacctgggcattttaatacgcgggcaagatttgataataccataatagttgtcttaataatttataagtttgctaaaataaaataatgttgtaccagaccctacttgtcatcgtcaagacattatggtattttgagaagtttgattcgatcttgtctacctttttatgatctgtgcttcctttttttgggacacaaatgttatcttaaaaaaaaagtatctgtttacatatatgggttattattgaagtagaagattttagcaaaccggattaaacgtactatggatatagataataaacttatgtctagacccgtaatactagtctactataatatataatatgtgttgtctgtctaaatccatactactagccaattaggatatgtgcttcctatccatattctacatgttcagattatagtattatgttatatctaatccgattttatattactagtatatattttatgagaatgtagtaatacaatatggaactacacgtgtactttgcttggaagttggaacttgggatcacagtttcaacctgggaaaatatgtagtg

SEQ ID NO: 5553 - DNA, 11095 bp, Oryza sativa
agtcaaacttgtctgcaacttgctgttcaccaagaacatgcatagtatatcgtaatccgatcgaaagcagaaagaggaaatttgagttctttataagttttttttcttctgagttctgacaactggaaagtaaaaaatattagcagcaagtgacacaggtgatcgacgttacgcaaggtttggggccaaaaggagccgacgtttcgtttcgctttgccttttccttctcgttttttcttttgtgccgtggacaccaagcttgatcgaggcttgtacgagaatgctgtttgatgctgcaaccaagagattaacttgtagactgtcagagtgtatcgtgttaagtcttactgaatactgagaattatttgtcgttgttattctacctgcgtggctgtatgagtagtttcttagtttttgggccgtcctggtcaaggcccattaatattttcgacatctaataagtttgtgaaagaatcataccaacaacatcagagtggcgcagcggaagcgtggtgggcccataacccacaggtcccaggatcgaaacctggctctgataatttagttgagctgtttttctttaaactttctcggttttctttctgctttttggtttttatcttgcatctactgttttaatctttctcggtttttgttttgcatctactgttttaaactttatcctttttggttttgcttccgtttttgtttaaactttttcggtttttatttttgcatctatttggtttttattttgcatctactgttttaaactttatcctttttggttttgcttccgtttttatttagactttttcggtttttatttttgcatctatttggtttttattttgcatctacaattttaaactttctgctttttggtttttatcttgcatctactgttttaatcttgcatctactattttaagctttctcggtttttactttgcatctactgttttaaactttctactttttggtttttatttgcatctactgttttaaactttctcggtttttattttgcatctaatccagtgctctctctctctctctctcttttaatccagttgcttacgtgtccggttcaattgcaacgggactctgcaactcgggctgtagcctcttaagagaacaaaagaataacttcttttatcacaccgaatgcacttgtggtatggtagataactccgaccacagggtccatcaaacagcaagcaacaaatttcggtgatacatcgtgattggaatgtgttttcaacaagtgatgttcaagtatgatgcaacaccagtagtaaaatcagggaggccaatggataccttattgcattccagaaaaatggaaaagaaagacagtaagcatctccatggtcatcgtacaatcagcagagcacgttccagaattatcagaagaagaaaaagaccaacccatgaagaatggattggtacaagcagctccatacaaaagaatacattacatcacgaaaaggttactccaaaaattgccaacacactgtagaactgaatgtgtcaacatatgaatgatgttcccagtagtaatttggggagagaacgatggcataatgcaatggtcaagaggggtgagttatcacaagaggtttacatctccgaaaattgccatcacgctgtacaactgaatgtgtcaacatgttcccaccccagtagcaacttggggtgggaaagatggcctaatgcaatggtcaagaggggtgagttatcacaaattagtgcgaggctgggttcccagcaaggcaaagcagcatgctcgtgttgctaaccagagaccatattagtgcctgacaatccatgcgagttgccacatccatgagtacatcattccgacaccacagtagagtgacaccattatgagaggtaggaaaggaaatctgctgccaaatacatagtggtggaatacttgagaccataattctatagcaacaattcctaaaagatagctaaaactgatccacccaatgaagctatttttcctgaccacgctgcctgattcatttactttcttcccttcttgaggagattttgcagcaaaatgggaagaaaatcctacccacatgagggtagcataggtcaacagaagcataacctttataggatattcttggttctcaaacaacaatgggaacaatgaataacatgaaactgcaaaacaaaaaaatgtatgtcaaagcaaaacaaacaatatataatcagcacttcataagtcattgttaaactggtagttcaggttgtcttgaggcaaaattacacgaaattttgctccagttgctaccatagaatgacacaatgagttattaaaatatagttatgaaatggtgttcaactccaactgtccaacaagttagcaaactaagaaatggcaggatattacagcaatagctcattatacatgttaagcagtatgtgactatgtgtctccatagtgaacagattttacgtaagtgaaagtgcagaacagatgaacgccactggttcatcaaaatacaatttcagttataaaaataagaaaaactgcacgccattttcattattaaagctagaagtactatggtttgcagcagtggactataccactataaatactacctccgtcccaaaatatagtaatttttggctatgaatctggacacacaattgtctagattcatagctaaaaatgcttacatgttgggacggagggagtacaaaacaatgttgtatcacatggttggcttttccctttttccccattttcttggtcagtgtgcaaaagatggtgtctgttccgaatagtttaattaggtattttctattggcttaggtcttgaaccatcacctgatatgagttattcacatggtaaccagtaccccaatgctttctaactctttttttgtgaatatagtactccctccatttcagaatgtaagatatttggttttgtcctaagtcaaacttttccaagtttatagaaaaatgtaataatatttagaacactaaattaatttcattaaatcctccattgaatatatttttaataatatatttgtttggtgtttaaaaatgttgctacgcttttttttataaaaaaaacttggtcaaacttgaagaagtttgacttacgacaaaaccaaaacatcttacagcctgaaacagagggagtatgtattatggtgaaaggagtgtatcaatcagaaagagatgtttttctaagaaaattgtgaaacagtaggtattacagtaaaagcaagtaggagtttaagcaagagttaacggtgactcaactgactcaaagtctcaaacatacctattgacaacacaaaataatgcttcgcgtcctccaagctatccatggcaattagggcaagcggaatagtgaaatggagtgatgccttctcatgtacatgccatccaaacataaacccacatgtagttgcatatgacacccatctaataatgtgccttggctggggtttagagaatgctttcatgaggcaaggagacatagcaagtatgaccaataaaaatgtagttattggagtgacctgcaatccgtaagttcattaaaacaaattattaaaccattgagatagccattctcccttggaaatatataagaattcatagtggtagagagaaccttgggaagaacagcaaaaggagacgaattaccaacaagccccccggtaaatgaagcttcaggtatctggatgttgaagcctagtcttctaagaagaaacgcgaagatcttgtcaagtaaaatgtagaatacccaaaaatttggcgcccaataagcatggcacaggcctcgaccaaagggaaacaaccggttaaagagctgttgcatctgcaagattatttgttgcaatgagtaagacaatattgtgccaattatgcaacctacgtgcacaaactgatagggaactacttaattataaacttcaccgatcttctaattctgaacacttgatgaactacaggaaaaatcctgaaatcctctcaagaaataatttcctacttttaagtgaactgatgattacagatggattacagtatctaaacaaaaaaaaaacataccaattcgtccattccaaaggtaaattaaccgagcaaaactcacctgcccatagtacaggaagggcacaaatgcagcagcaaacacagcagccacaccagcccccatcagcaccaaccttcccaatcccctcaccacaccccggccacagcaataatgccggaaaagatacacgaagtagaccggcgccgccactaggaacaggtgcttcgagcacagcagagcagcaaaaacgactccgccggcgagatccctcccctgctcaaggaagtgcagcgacagcagcagcagccccatcaggaacccgttgtactggaagtgtacgtggtccacggcgagcagcgccggcgaccagaggacgagcgcgagggagaggaacggccgccgccgccgccgcgtgagcgcgtccgtggccagcaggaggacggaggagaggaggaggaggaggtcggagaaggcgacggtgaggcggaggtagaggaggtaggcgaaggagggcggcgcgtcggggacggggagggagacgagggaggcgtcgacgaggggcgccgggagggcgaggaggcgggagaagtaggcgaagaagggcgggtagtcgagcgtccacaaactctgacgtcgtttctcgatccaacggtagtttctaagtttccactatatatggtttgcaccacatattttcccgtttcaacctttgtgcctgttggtgaaaaccactctaaaacattgtgctggtatttttccaggtcgggcttccaaagttttctaatgtgggccttaacactaaagaatcgattttgctatatctcactcgaaagattttttcttatctctcactcgattttctcactcaaatttacagtgcattttcttgtaagttacagtgtaatttatgaaacttacactgtaacttttgtaagttacactgtaatttttgaatcttcacatgtaaattttaaattttatatttgatttggtctttttcttgaggatatggtaatttaatgttcattatggtgtttcttaattgttttttgctttttattatatctatcagattttaatacaaagattaaaaatctgtatgatacgattataaaaatctttcgaaagatgtataggtactcccgaattgcagatgatttgggccatccaaccggtgctggctgctgaagcccaactcaattacgcaaaggcgacatccatgacgacttggcgtagaaggcccaatcgccaggccgcggctccggttacagccgtgacgacgaagcggtggctgtgcgcagatcggagttgcggcagcggcggcggcgatggcgatccggaacttctggtcgatggccgcggcggccgtcgggttccggctcgttctcgtgctcttcggcggggacctccacctcgcctcccgccccgaggtctccacccccctcacctccatccgccgccgtaagcgctcccttgctcccctgcctcctcgtcccagacttgagctgtgctgtgttgtcgccgtaattggactaatagcttgttttcctgtgtgttttgcagtggcggaagggtactggctgaagcaggcttccatgtcgccctactccggttcgttccacacatcttaatcttgcttgattacttttttttgggggggacaactgaagtcgtgaattgttgagctcagtatagggatggaattactagctacatgagagcacttttaaaagtaaagtaaattgattgggtgctacttcttctagtaagctccattaagcatgaactgctgcaagcccgcactaatggggtgtgttaaaaaaaataagcgcaaaattgccataccttttacttagcaaataattgtgcaggtatttgtcattgttataggtttatccatgatgttttagtagggtctctttgcaatgtgtttttcttgtagcatgaactggaagtgattattcagcacggtgaatgttttgtctttcaggttcaatgtatcatggttcccctttgcttctattggttcttggtccattgactaacaaaaggtgatcaattccttgtctatgatgcttctctgatcgcaattggttgcactactgcagctatatgctttgacaggattggtttattttatcacaatatcagatcaatgtttgaaatactcacatccttgtatttcatggtattacaggtctgttggacatcatgatcatatatattgcaggtaaataagttgttatgtaattttttccattacacctaggatctgtgtctctattctctaacagtattagccacttgatttccatggatgaaaaggattttctatgatgattttttaaattatgttcttattatttttatgttaccatgtaatgattcagaccaaataaaaaaaatgaagcctccaatgtactccattatctttttgaactatgttggagatcttgtaatttatattacactcatgaatgcaagacagtttgatttttgtggccgtagattttatagctgccatgcttatccgagcaactggtcgtagactccaaatagcacgcaacagaaacttgaagtcacttgagctcacagaggcagtgagtaattcaggtgagcactatagttgaggacctacagttttgtgtccctccttgcagaatatgctttattggatactgacctagttgttcttagtttgttgacactagttatctacttgtttttaccaatggagtagcatacagagcttcttgcagaattatattatcaaagcttcaaatatttcattgactcattgaattgtcattctttattgtagagccaatctagtctttcataatagagatgcacggaattgctatgaaacaacttattttcagattaatacatcatttcggaatgatttttttttaaagatgactgtgattctagcaacttataaggtgtaaaattgaaacgttatacttgaatcaaaattagtgattcttcatttactaatgatagtctgatgctttcatcttgtgattacttaatgtttgttatgcagctacttattgttcttattgatactgttcctgcagttaacgtaagtgcaggagatattgcttccctcatatatttgtggaacccctgggcaatagttacttgtgtgggttcatgtacttcacctatcgagaatttaatggttgtgataatgatatatggagcctgttcacgtaagtgcaactcaaattcgtgtttctcttcaacatgttctgctatttttaaattttcagtagaatcatttttgttatgtaaaaagggccttcatttggcaaagcatcagtagcaacaatttcatgaagacagtatctatcttttgagtgacatagaagtctaacaagttctcatgctgtttaaaacttggaatgtctctaatttttaggtcttgctcctcttgctgcctttggatatgttatggctacacatctctctctttatcctgcaattctcattgtaccggtttgtgtcacaagctttgtttgtactcttatattcatctatttgataatgccttccattacctgtatagtcagctattgagaacaaagttctttttccagatcattcttttattgggatatggtccagatgctcctccaacaaaagtatttcgtataaaaagctcaagtgccagtaaaactgacgtatcagacaatgataaaagttctagctcaagagatgttcaacaattcttgtggaaaccagttttccacttcatattgtggatgcttttctggacattttatgtgttgctattgagcagcatagttctaaataaagtgggtggtcttcaggagatgtttgaaaagtaagatactcaactctttgttagtagaatatatatgcttctttggtactcatgaaaatttgtgtttgagtgagatggggggactgtgctagtttatgttactttccctcactaaagataagttttgaaaggaggaacgaggacagattttcttaaggagtactgtttctggtattagcatgtttgatcttatgctagtaacaccatgttgctctatccactccaacatgtcaactttgttgtgccttagttcatacttagttcttttcatttgaaatcaattggttttatttgccattacctattgacttgtgctgtgtttctgcaggacatatggttttatccttaccgttaaggacctatcgccaaatattggtgtattatggtgagttttgatcaaattatgtaactaactcaatgatattccatttgtctcattaaaggggttgtgcaggtacttctttgctgaagtctttgactttttcagaagcttcttccttatagtcttcaatatgaacattgtttttatggtattaccattggcaatccgtctgaagcatcgtccatgcttccttgccttcatttacacagcaattgtcgcaatattgaaatcgtatccatcggtaagtacacattacatgataatacctataaatttagtccctcggttgtgtaaaatttcatcaaactgtttttgttgtgttgtcctgatttttttcccacaagttcattgataccatattatgatttatcttgaaggtcggagattcagctctttatcttggtcttttgggcctatttgctaatgaattagcaggtgcttaacatttcttttaacatattttgaatgactcctagtcctctagaaaactaatggtttagttttacactacaacactaatggtttctctttacattttgtagagatgcaattcactttcttcttgttttttggatatatcggagtctctctccttagccctgtcatgcacaacctgtggatctggagggtatctccctctcccatccttcccctctcttagtattgtgtgccactgatactaacatgacaataatttcaggggactggcaatgcaaatttctactttgccactggtttggcttacacttgccttcaggtaaccaatatgttccgcattatttgttgtgctatgcttgccatggccagtacttagctaagcactcttgcgttttacaacttctctagaatgattagtgctgaatgttatcgtaagatgataaaacgtttatcctaagtcctactatgcattttcctttctaaacttgaatctaaattgtttttgccacttttttgcagaccgtgttggttgtagagagtgtaagttcaatgataaagcatgacaggaagctaagattacttgttacagcttgatttcattctctttaaattcaacaactttgacgctttaatggttttgcttggtctcccggatacaagcgtgtttttttgggcagagtttggagtatatgtagtttattatttttgtagtatatgtattgttacgattgttatttgtaccgcccgtgtttgtaaaatatggaccacaaatcatgtaacccagtagactactagaaagacaccaggtttccccctcgaactgtgcccttttgatctggcgtggtgagattggtgattggtacattacatttgtaccatcagtttgtcaggtcaagacaaattaacatggcatggactggtacctttgttttcggttgctaaatgaaatagtacaagtactttggttcgttcttttttcccatcctggtaaatccaaggtctcagttattcagatgttgcagtttatatatttattactaacatttgtctgctctgcagggctttttaccctttaattcctttacagagatatattcattattggggcctcgggggtcccaggtccatcgataccactaccgtgctaataataagtgtactgagcttcattcatggtcacaccaacaaaatctgtgtagttgctgcaggtactgttttagtcagcataagcgatatcgctaaccaccaacgcttcacttatatacggaattgggctagctgctagcaagcttgttggctgcccaagtgccatcctctccaagcagtttctgttagttgcgaaaagccatgcttgtgttatgtcagtccttgcgttgttacacggctcgtattttacttacgtccgtttgagatgctaggacgcttattaaagtgtaaaagattgctctagcgagacgagagaagttggtggccaaactaactcggctgctaatggccgtcgtccatggtgtcagtgtcactcacgcttccgcttccagtgatccactttcatctgcaagtggaagaagactggtgcatatggtcatcgtcttcgtcgtcgtttcggcgtttatcgactttaataccaagttagcaactgttttgtcacagttagggatgaaaacggagtggatacggacggataatgctcataccatattcgtttcatattctttaccggatacgaaaacgaatacggatagctcgaatacggaaacaaatacagattatctcgaatacgaataagaatcgaatatgatcggacacaaatacggaaacaattttttctcggaacacgaaaaccaactcaacttctaatagaaacaaatatcaacatatataattagctcattttatataaaataaggtataatttataaatattttttaaaatttaaataatattaatagtatggactagtgttaagagataaactactattaaaatctataaaggtatattttataaaggtatattgaaggttatagagttagaaagatatggggtatgtctcatgggtcctgcggatatccgaattattatccgtatccgacggaaacctggtaccatattcgtattcatatccgggagaaaacattcgtattcgtatccgaactatccaagaattatccgatccgaaaggtatccgtatccgtttttgtccggagccgacggaaactatccgctccgttttcatccctagtcacagtagcttgattcagaatcccagtcccttcgtaagttccgggagaggaacaatcatgcgctggacaaaacgatcccattcaagcagtttttctctcccg

SEQ ID NO: 5554 - DNA, 12499 bp, Oryza sativa
cccccccccccccccccccaaaacgagaagcagcgccaatcagattcccctacaaccccacgcgtttcctcataatcgctacagctgatgcacagggacagggtgaagctttcacaaatttggatcgaacggggccttggttttccttccaagctggtcatggatgattcaatgcctctgcacgcttggtcccgctcagccgtagcgtccgagtccgacctcgctgctgttgctgcaactacgtgtctcagtggctgcagggaggcaggcggtccgtggacgtggagagaaagccctgcttcccgtgcaatgcaaaaatgtccaacgtgcaagcgtacacacaccggtgatgggcgtacggtcaaaccggctcacttcaacgtgccataaatactcggcgccaccgatacgcaggcgctaccacaactcgacatggcaacgagagacgacacattggtacgcacgcggcacgcaccatctgccgatcgatccgccaggcccatcgttttggctgatttgagaaaaaaaaagaaacgatatatctataaataaaaaataattcatgactaaaacttttatacatttgtaaaagtaagttgaaaaataaactatgatgaaaaaaattttaaaattaactttaaatttaagatcaaaaatttaaattttagttgatataaatataaactagcacggtggcccgcgcagattgcgcggctagcatcattatattttctctcatataataacatatatgttctctcattatgttattcaaatatattaaaatgacaacatagttttaaattttgcaacaactttacaaaactactaatatgtaatattcatattgtattttatatacgtgttagttattaattatttttaatatcaaattttagttatttgtaaatcatatatattcctatatggactctagactcgtcttttaatatttattttttttaattccgaattttctgtaaattgtatatctatatagactctatgctcttcttataatattatttactttttatttataattttttattatttctaattgtatttctatgtgtactctaaactcatctttcaatattctttaatttttaattttgaatttcagttacttctaaattgtattcctatattgactttaaactcttcttcccatgtttttcttaatttcgaatttttgttatttgtaaattgtatttttatacggactctaaactctacttttaattttattatgtttattccaaattttagttagttttaaattcctatatggactctacactctacttctaatattccttattttttaattccgaatttctattttattcttaattgtatttctatatggactctatactctacttctaatattccttatttttaattccgaatttcagttatttcctaattgtatttctatatggactctatactctacttctaatattccttatttttaattccgaatttcagttatttcttaattgtatttctatatagactttatactctacttctaatattccttacatttaattcctaattttaattatttcctaattgtatttctatatggactctaatctcctcttctaatataccttattttttaattccgaatttcaactatttctaaattgtatttctatatggactctactctcctcttctaatattccttattttttaatttcgaattttagctatttctaaattgtatttctatatggactctgccttttctttttctccgattaatgtgagaatttctaggccatgagagcgaacgtggaggctcctttttctattcctttaataatataatagatataagtataagcgaaaagatgagagagttttttttttcactgcacggcacggcaccacgcgaggggaggcgactcttccctacgaaccgaagggcacgagacgagcggcgagcggacgatttcggtaggaaggcggagtaaatgagagcattcaaggtgaagtgcgcggttgggtgcagctggtcgccgcccctgcctgcgtggttaaaaccgacgacggcacagcaacgctgcgatcactgctcaaacccgtcaatccaattcaatgctacgcgacggtgcctcttccttgggtggcagtcaccaccagtcggttgtgtttggtggtagcagcagcagtagcagcagattagcagtggtagtagcagatttagcgttagtagtagcaggctagaaaatgatggtagtgggctggtggcgacgagctaacacgatcagtctggctgtgcgagaagaagccgagagcatggcgagacgatcgaattggttttggcatttgttcaggtatcgcgatgcaagtacttaatccgatgattggtcaccaggtccacatccgaggagccaccaacgctaacgagatcggagatctcagagactcacatactcccttaattcctaagtataagcactttttacactgtatagcagagattaaagataggagggaagatttcttttcagtcattttgttgatcgaatttcgaattttaaatcgcttgattctcgtcacttgtttggttgaaaatgttttgattcccgtgcactgaaatccgcgtaccaaaaaatagttgtatttaggaagtgagggagtatacatgataaaacctgaattcatattccccgggaaagaaaaaaatctgaattcagtatatgctactaggagggattggcaatttggcaccattgcaccaagcctccagcccaccaaccatatccaatgataacaaggaccaccgggcaggctacccaacttagcaagatcctcgactccatgacagagacaagccaggagcatgctacggtagcaacaaacaaagggaaaaaaaaactaaaactgtctacatactagatccaactaggatcactaatccattctctcagtaatgtcctaaactttttttttgttacactcttcaactgggcacaagaaaggatcaccacaacgaacaaacctgaagtggtgtgtcctcagttcgcaggggattggacacgtttttgactgcaagcctacgacgcactagggcactaagccacggccatggatccattccacccaacacaagtgattcagaatccacacatctgcacaggctgcaggcgcaccaccaggcttcagagtagccgcgaccagatcagctataaaccacaaggaaaaaggagcaaacagcacggcgtggcatcctgccgtgtgcgattcgcccggtttccccctccagaaaattgcctctccagaaaacgaacgaatgaccagtctccagtggttacaatctgagcttgaataccgccaaaatttgcgaggattgatgcgaggacaggaggagaatgggaagagagaatggcgacgatgttgtccaaatcgatggaaggttcagagttcagagacgttaagctcatctggggctggaattttttttctctttacaaaatagtcctagtaaaaaaaatgtggaaggaaattgacaaaaaaaacctcgtgaggtcctgtaattacagggggctagttctatacgcctacgatccaacggtacagcgtgacgaagcccggctcgtcgtcgtccaccccgcgcggcgccgacatcaccgccgcctccgggtcccaccgccacgagtcctcctgccggttgctgtggtggctctggctccaccgcgcgctccaccgcccgctccaccggccggagagggacgaggcggaggaggcgaggcggtccacgtactcgcgcagccatccccgcgaccccgccgcctccgccagcgcctcgccgggggccggcgtcacggaaccggtcgttgacttggccgccgcggggcgcgcgatgcgggacacgacggcctccacctcctcgtccacgcggtagtcgaaggagccgagcgagtaggtgcgccggtcgtcggccgcggcggaggagcggcggttgctgatgctgccgatctcgacgcggaagctcctcgagttgttgctgctccgcgagtcgaggggatcctgttgcgccgcgttggaggcggcggcggcggcggcggtggggagtggcgggtgcgggagcgagacggtggcgcggcagagcgggcaggacggggtggtgcggagccaggcgtcgacgcaggaggcgtggaacgcgtggcggcacgccgggagcagccgcagctcggcctcgggcgcgaacggcgagaggcagacggcgcagtcgggggagctcttgggcagcgccgccagcgcagacgccatggtgaacagcggcagcgacgcgatcagccgctccttctcgtcgtcgacctcctccccaccccccgccgccgcctccccctcatggctcctccccaccgccgacgcggcggtagcctccccagcctcgacggcggacgccgtcgtcgcgcgttgggccgccgccgacgccctgggcagcgggctcggaaccgggtgcgacggccgcgcgaggcagcggaggaggaagtggatcgacacggaggcgaagaagacgaaggcgaggagcgcggtgatgatgagaagcgacggggagaggttgagcgaagacgacgacggcgccggcgacggcaatgagggcggaatggtggcggcgagcgggtcgccgccgatggccggcggcgcgggcggcggcagggaggccatgggggggaaggagacggtgtgtttaaggctcggccctgcgtgtggtctcgcgcctttatttatgggttttggggtgcgcggcgttggcacggagagcgagcgaaatcggagcgcaaataccaggtgattagccgtgagacgagtagaagtagagcacacacaagcacacacatcactagagaccaggtcggagattactttccggtgagtgaacatgtccagttttttctctctactttccttgttcatctgtgatttgtgtctctgactttggttgctttttctgaccttgattgttctcagtgtcatttctctgtgtcgagatgtggtttttggaggtgtaggacatgagttgtatccgtctcgttcttctctgattaataacatacaaattggagtacatctcaatttttattaacactttttttaactgctaaacgatactcttttcaaaaatattttatataatggccgttctaaaatattaatttaaatatatttttattgtttataataaataaaactttattaattaggtgctgatgatttttttgtttagcatatttttacttaatctttatcttcatcaaactcaaacggcaccatattgttcccttcattacattttaatcgttggtagtttatcttatttttgcctcgtagacaaagcacatcattgtagtacaagtaactttgagaaagatgatgtactaccgtgaaatgggcacaaatttacttcagattaaagtggtactccaaaagatcagctaatgctctacttcatgtcctttgatcatatcactatatattttagcccagagtaatcccggttacaggtttatcagcctacgtgctgcacgaacgacaaaactaaatattggcgctggcgggtgtcaccgtgcaatgtagccgtcaggttaccatctgtcacaacgagaacaaggataaaaaacagaagagagaaagaaatggtttcagctagctatggcttcctgcatttctgaaacgaggcccgagtacatagatcaaaagccgtttgctttgacgctttgttgcctgtatatatctagaatgtttgttggtcgaacaatctgtggggcttgctcaagtagtagctttcaactctaaaagagagccagcctcatagttcttccggatgaagctcaagctaacatgagcgtcacatcaacaaaaaaaaaaatcacgaggttgatttaatttactgcagagctttctgaaaacatatcgaatgatcgaactgtacagtaaccgcaccgacagagaattcgttgagagcccattcaattcagctagacatgaatacatggacacacattaaaaatcattggtacatatatacatgtacgtgtatgtacctctgtttctacacgcatgcatgccaaggccatagtgtccatggaaatttatacagatcattgaaagttgctttcattttaatccatgcattgggtattcttaccaactagataaaacggcgtggatcgttgtcagagagagcaaaggtaccgtggccagcgtaatgggcttcctgtacgcatgctgtacgcgccttcaatatctcatttccgagaatttatgaacttcatcagacacgcatcaaccatgtcggccccttgatccactacactttatggtgtatccaatgggagaaaaaaaaactccaaaactacactccacttaaaatgtctcatgtcggattttttttaagaactgttggatttaatttgttgaacggttgattagccacagctttggatggtgcatgaatcggagttcagagcctcctttcgtaacacaagaatttcgggggaatttaggtcttgtttagttcccataacataaactttttacccatcacatcgaatgtttgacacacgcatggagtattaaatgtggaaaaaaatcaactaaatagtttgtgtataaattgcaaaatgaatcttttaaacataattgtgccatgatttgacaatgtggtgctacagtaaacatttgctaatgatggattaattaggcttaataaattcgtctcgcggttttctggcggaatctgtaatttgttttgttattagattacgtttaatactttaaatgtgtgtccgtatatccgatgtgacaaccaaatctaaaatttttccccaactagataaggccttaatctaatacgggaattttttttttcgtctcattatacacgaaatgatcggattgcgttgttaattaaggaatgatgatttggagacatgaggaattttgactttggattagtaaactcactcgcaaattccccttgcacatgcatagagaggtcgttggcgttgggggtaggagtatcgtgcagctgacaataattacaggtaccacgctgaccattaataataaatttattatagcatatacgagcaagcaagcctcacgtacgtctatcactatactttgcccttcaggagcaaatgtggattcgagcttcgtcacaccagcaggttgattaactggctcacatgcacgacgatgccatgattccgggaacgagcaagcatggatgcatgaataatctttcaaaaaacaaaaaagaagaagacgatgcaaacatggatgaatgcaacgcagatgtgttgttgatcgaccatatcgagctcggatcgagcggagcgtgtcggcggatttcactgtgttctgtattgatgatttgtgattggaacagtggatttaatttgcatgtctggttgagcaatcacatgtgtcactcgcattaacaaccaaccgatctatacaaaatgttttagcgcgcgagattagttgcccatgatgtctctcgtacatgcactccactagttccaccgctatgtacagtgcgtgcttcatgtagaagttgatgatggaatttaatttgtcaacgaattctcgcagaaaacctttactacagtactctctactactccttagctagtagtaacagtggaagttggtgcaacggctgcatgtactggcacggtcacactgcacgcacggggccacgaggatttaacggcgccctggcattaaccggctcgccgcctgcacggacgtcattcgacccaatctcccgacagctagcttttacagcaaaacgaagcacaatattacgccacaatgtcaagaacggcaaatccgatcgggttgggtcctcatggcgttgtgcgaatcaaggagcaccggacgcgcgcgcagagctagctactctctccgtcctaaaataagtgcagttttagcactgttcacatctaatgtttaaccgtttatcttatttaaaaaaataatatgattaatatttttattattattatatgataaaacatgaatagtattttatgtgtgattattttttaaaattttttttgaatgagacggatggtcaaaacgctaaacatgaatatctatggctgtatttattttgggacggagtaagtacaagcgagacgaccatcgcattcagggccgaggaggtcacgaggagtcatcaggagagtagtgtggtgtggtgtggtggtagcggtatggaggaggcaggctgcttgcacgtactgaaacactcgtgcgatgcgtggtaagtggtggggtggagcacactgcacatccacaaatataaggaggaatacaatataataggtcttaacccgcctcttttacataacaactgtctttaaatatatggtgcaaatcacaacctagataaaaacttatgtaaccccaagtgaaaggacgtttaattttttttagaaaaatcacacatatagataataaggtgatgttacaatgacgtaaataattttgtccaaacttgacttcatttgtgagatataaaagtagtaatatatctcagacacaaagttaagttcggacacgaattttacataattgtgttacatcatctcatccatttatgtgattattttgaatggatttagactacttttttattagtgtttacacaaattttcacctaaattgagtttccaccacatatttacccctttatcaccgatatttcttgcttgatctgcatcagaggcaatagctagtcttctatccacattaaagattacactatttggccagcttgtcaaaaaattagagagccaaatctatctttcactccaacaatatgcctattacactctccaatatgatattgggtcctacatgtcactctctgtttacttctttctccctcatctttccactcccctcgacataacagcatgcggcgtggccgacggcaacgaggtggccgaggcgagatgaagcgccgtggtgttgtgggtggcgggaatcaataaggggcgggcaagcagacaatagatcgggccaagtgcactactgctagtggccggtggaaagggctggtgacacacctcaatgtgggcaaccacgctccgcctcccaaacttccctgactcctcccatcaaccccaacgttgtgtgctcccctacagtgccactgacgagatcatgcatctcctctttctctccccctttttgggtagcactggtggtggaaatcggcgtcgagaacaggagacgaccctccagacaacggcgatggcgtgcaacaatggatggcggtcacagcggagggactcgagacgacaacggagacgtccgcagtgaatggcggaactctagacgatgaaggcgacgatggtgtggccagagcgaatggtgaccctaacgacgacaatgatgatcgcaacatgtactcaatctgggtgcagtgacggagagtgtgtggggacaaagagagaaggagggaattgaaacaaaattggcgggcatggggtccacgattggtaaatcagttttggctagccgcccacaagaaggaggaatgaggcggcttggccatgggttggctaggccggctcggctcggttgggacgtgtgcctagctgggcctttagctcggctggaggagagaagtggtgtaagtttggccaagccattcggttgacaaggctgttagagttcattttttttttcataattgttaaattttagcttgggaatgagatagccatattgtttgcgatgctcttaactaagactttttttaagggtagtgtctctcctaatatatatacacttaaagacatgcatgcgatgatctcaccaaaattttattaaactgtaatatgcataattattcataattactcaacatgatttaaattctaggtagagtcatgcaccagaactctcaccccacaccaccagccgctttcccagtttgcatcggtctggtccatgctgatgcttatgcatgcatggctgcttccatatctccggcccgctgtttcatcgttgcttgcacgagtcgtggcggcactaccaacccgcttgttccgcggtctaaatatgtgtttttgaaggacgtactgtgacctaatgatgcaacataattaaagaaacactacacatgtaactagctctctctgatgttacacgcacattattatttggtttttagagtagtacgttgggtcagcttaggtctactgaaagtaaatttatacgcatgtgatgtgtgtcccagggaccgtgtttcgtctctatcacttttgtaccaccaaccttgccatttgtgcagaaaaatcaagtctactttgtctcagatccctggggtttagggtggatctatatgcaggttaattacataagttacggttcttgagaagctgagatgccttgagacacactacagccttgttctttctcctaccaatcccgtggagaccggccgtccaaagtaagcaatgactagtagcagccatcaaatcacagctatttgtctcaagcacaagaacaaacaagaatagattaattgtgacttggtctagtttaatccatcaatgccatggggcaatggaaccgggaggagttcaggaatattgtagctgcaggttcttctcctatataggtacttaaaaatatatacatgggctaggagacttggtgtttctttaatttcttctcatgttgcttgcaaagtgtcctagggattgaggatagaggtgatacgaaacaccttcatttgttgcatgatcgagagtagccaattgttttataggagctattaacggtaaaaaattgttgctatcgatggcagcaaaactagccgctcgctggtagtagtaataaatagtcagagataatgagatatactccatggagacaggctttgaaaaaagcaagcagagatcatgcaccctggctgcctgttggcctaaaatatcaatggaaaaaacacaaatttggaactgaacatgtcacttgattactagctatactatattgtattttctagcctaatccagaaactcctgaagtgtcatttgatttgattatcagttggctgcctgttattcagggggtaaattttttgttagttctggaccaagtacttcagtttaaagtttgttctcttgtgtgatttcttatgtgcaaccatctgaggtgggactagggaaggtgttagcaagtagcatcacctgattaccccactgcaaaagtgttcttttccaatatttacacgggacctggctgaaccactgtcattcaacagttcagttctaccctttacacttggatagcaaaactgcaagaagatggaactgtttaccactttgatatggagccaatgcaagtaaagcacaatccctgcatgcaagttgcaacatatgccatgtggattcctggtgcatgcccaatcttaaggctgcagttcttgtgcaggcattcagattcaggcaagcaggcagtgatttggtgctgaaactgatgagctcttcttgttcggctgcacctaccatgcctagtcatgactcatgagatcgccttgtccctcttctcatttgctcatccctgatgccatattgccatgatgagcgtgaggagcaagctgccttgccgccttctttgctctgtcgccttttgattcctctatctcatcaagactatgatgtcatgatgagaattgacaagaagaatcaacgatccatatgatactcgaacaaaaagatcactgctctggttatcgcctttctcctttctcctatccaatgagggaagaagactataaaagtgtctgaaaccgaatccaatagtagtagtctttcattctgcagaatgatccaccctgcttcgtcgtggttattctaactcaatcaacctgaaacgttgacagacaggaacgtcagaacgtgtttacatggcattccgataatcaaatccgggttaggttcagtgtaaacccagaagtctttccattagattatccgattcttgacccataagcacagaattttatcctaagctgacatggtaacagcttcatggatggtgattaatttgctgaggtgcacccggccaacgcggcttaggcaataacctgacacataagtacataaccaaaattacactcattagcaaacacataatcacacgtgatattacctttctcaaattgaaaataaatacagtcgtaatcagaaatctccatctgaattgagctagtacaggttccgtagaagggtagatacaaatccgggtgatgtctcatgtgacctacctcccttccattccatgacatcacagctagctcatacaagagctttcatacgtttggatcgacatggaaaattaagggaccaggttgactataccttgcgttgttacatgccgctggtccatgcaagttaggtggtgtttggttggagggactaaagttgagctaaactttagt

SEQ ID NO: 5555 - DNA, 5368 bp, Oryza sativa
ttctttccgaatagcattgctccctggataggaaatgccattagaacagagcgtgatacgcagcaacattcacacacacacacacacacacacacacacacacacacacacacacacacacacacaagagagtgttcagaataaaagaatgtgtgaccaagaagcacctttaaatacagtacagcaagctcagcctgaagcccgtcagccatctggatgagggcatgatctggtttatttttgagtatcttgatacgcacgatattcccatacattgagaaaaggttgaagagcttatcctcatcaattttctgcatggaaggattaacccataaaactaagatattggtaaagtgaatttgggagagtttatagctagtgaaatcttacatcagtgttcagattgctaactagaagtgtgcaacggtcattgatgccagacactccaggaggcaatgttccaccaaaagcagcagcgatcattgctgccttactcatctggtatggagaaatattaaaataacaaagtgcagcagatgctttgtatgagatgtccatgctaacctaagacaagcatagatagaagcagtaaaaactaaacgcggctattatctgcagggtttaaggattcataatacatacctgtgcatacggatctgtgtacagcagagagacgatcaaaagaaataagttaaacatgttttatcaaatatagaaaaaatggataacaaacaaatcaaggaacagtggaatgtcttacctccaggttgctggaaaccaaacaaactgcttggatcattataactaggctgttccaaacagaaacaatggaggtgagatacttcagcatagcagatcgaattgtccacataacaataattgaaagtaaacagataatataaaataacaatagaacaaaatgagttgaggacatacctgagatgatcttgagcgttgttctgtaggcaaagatggatttgtgaaatctctgaacaaggaaaacaaaatgagttgaattttcaagctccatagaaaattgacaatgaacaaaacaatattgcagttataaattaggtatctgatacctagatctatcgttgttgtagtgaacttgcaattcgctgagactgcagattcaacagaacaagttagattcaggagagctaagtgtgaaaactaagtatatggtgtagcaattgctacaggccttacttagaatattgaatgtctagctggcagcaaccatcatatatgttccgtccctgagattatgttattttccaaaagagtgagtttaaaagcagcataagaaatgaacaggaaacctacatgtaaagcaccataagctgtatattgaacaggaaacctacatgtaaagcaccataagcttgtattgcactttgacgtgactgatattgtatgagggtttgaaagcctgcaccaccaaaaaagatcaccatagcaaacaagtcttttaattcagcatgtagtaaacatatcgtcattccagcaaaaaaaaatgcactaaaaacatggctgtgaatattataaataatttaattttttttgaacgactatgcagttgagagaactatgaaatacgcctcataatctgcatgctatctggcaaggaaaacactgcattaaatgcaagaatagagtgagaatgagaggtagaaagaatctgaccggctgacttttgaaatgtgactatcttctccacaaatccatagggagaaaacacttgatgaagcacttcaatggttatagggtaaagcatatgatgaatggttactaacagaattcggttaggttcttcctgaggcccagcagcagacgagtaccgagaaagaaaagaggagagagatagaagaatgaataaagaagaataggcacatctagttggaacagaagagaaagcagagagatagaaggaatgcaaactaatcaatcagtggggacaaatgaataggtacatggaaaataataatgctattgaaatcaagatgttttgacaaaaatgttttttttctttttgtaatatgtgaagactatcacatgctaggtggtaaaacaagagaaaactgtatctagcagctacactaaataaaagccttatcctgcatcccatgtgtcaatgcctgaaatatacaccttgccaacaaaaactgacaatcatacagttatgagaacttagtcttccagcttatagccaaaaaccttggagcatgctaaggattgattactgttataagagaaggcacatttttcttgcaccagtaataactgataaagttctccatgtatttttcttgtaacagaaactcattctctgttaggttggtataataaaacttattattacaatatcgtatatcatagaagaacaaaccatcactccaaacaaaactaaactctagaatagagggaaaactcaaagtccacaatcatgaaagcatacctgatcaggatttcgtccatgagagctctgatcagtagtcaattcttggtgggatgaatattgcaagtaaacatttcttcccctaatatatggcataaaagcacatttaaaattacataataatatgagtatcatatctgtatctatattatcaaagaaaacataacaaaattatgggaaacaatgaaacttcaccatcatattatcatatgcaacatacaaatggcacaactctttcctatagcagataagtgcaacagcttcaaaagaaaatatataaacagaagtcattagcacctatattcagtgaagctgatctataagcagtcttaagaaatggctgtttttcccccaacaaacatagcttgtccgaacaattattctaacaaaaagtcaaaataatactattataccagaagagatgcccttgggatgcaacaacacctggtctaagaacaagcttaccttacactgggttgaattgtattgtagtattggatcacattcacagcagaagctaaatcctccatctggacgagagcctttaacagcagcacaaccacattacaaccacgcatgtccatttataacaactcaaacagaaaaaaaaaaagtagaagccgagatcaaacctggttcttagcacgcagcatgacgagcttggcgacagtgccgaacggctgcaccacctggagcagttcgctctgtatgcaacagaaagaccacagaaaatatcaaaaaaaaaatcgtactccgacaagcagctcatgaactgcaaaagcgccagcatctcttcacctcggagatctcatgcccgacgttccgtatgtggatcaccttggagggctcggccatcctcccgcaccacgcccgcacgcaactctgaccacacgcacacacacccaatcaaaaacccacccacgcaaagcaaacgaacgaattaatcgatccaccgaaccaatcgaaccgtagaatcgatgagccaaacaggagaggaggaccgcgaagggtacctccgaactagggtttaggcggtgggggcggagccgcggaggagctagggtttagccttgcgcgcgcgacgaagggggattggcgagataagatgaggcggcgcaggagaaggagaagtggaggggtggatgcagtggcagggtgggtcagatttggggagtccgcaatacgcacggaagaggaggagacagcatagcacccgcttggattaactcgggagaccgcgacaccggcagccaatgccgccaaatcacggagcaggaacatttgctaaaattgacgtaagtagatggatctcctcggaaagtcgatgatttttttaaaaaaaataaaacgtataaacgtatgcgctcatcgcgtacgtacgatctatgaatatagagcacattttatcctataaaaatatctctagaaaaccggacagatatattttaagatttacgaaatcactaccgatgaatacatcatttgccactaaaaaattaaccataaatactatttatgtgaagtctataacttaaatttgggtgggctggttttaccacaataaactaatcgggctgcgggaggccagattccttaacattaaaaacatagcaagcgattagagcgagattaattaaatattaccctaaaaaattgaaaaaatagattaatataacttttaaagtaactttttttagaaaactttaaaacaaatataccgtttaacagtttaaaaaacgtgcgtgtgaaaaaaggagataggtgagttaggaaagaagggaaggaacacagttaataattgatttcgtgctagaagatcagcagtgcttctgctgatttgctgctgttaatgatatcatggcgttcttctacagtaaagcctgtattgatcgagccatcggcttcacgccgcgacgagccttaaataattcgacaaacaggctgtcagttacaaattttatttcagtctggaatataatttttttttagaattacacagtacaacgcatacactcacccctataaacgcacgcatgcaaagcctacccctataagcatcttcaaagactgcgccgacaagattaacaaagtcatcacaggcgcctccctgggtatgtcgcctaccactaaaagcacagagccggtgttactgaggctctttataaccactaggctacaggccctttcgtagtctagaatataaatttgatggcacaatcatcatgtaacatatactcaaataaatcaaatgatgtatcagacagaatcacaaaatctgtttttttaaagtttgcctaacaaaaattaagatcagatatgacaacctaaaatgaaaccataatggcacatctccaaaaagaaaaacatgcagaaacagaggagccgtatcctctgcgtttcggttccacagaccacaatagaaatactactgcaggagttattatctagcttcaatagactttgaacatcgtatagtagaggggaaaatgacagtcaattgagtggtccaaagtacgagaagccctttacaacacatagatttccactaatcttacagccttatgcacgcctcctttaaaaaacaaaatcgacaatgcaatcagagaagaattcttaagggggcgtattctctgcccaaacctgtatgtattctggtggttcaatgaggaaaatctcagcggtttaggtattgactacaagttcagcccaccattagtctatggcaattatgaggaaaccaactgaaatatacatgaggaagacgggatacagggccagagcctttctccttgggttaactgcagcactcatgaatggatatgcagcccaggaactccatgccaatgtgacggtcactacgatgatctttagtatgacattgtccttcagcatgcaaactagagctcc

SEQ ID NO: 5556 - DNA, 11849 bp, Oryza sativa
ggacatagggtgtgttgtcgagaagaaaactgcataatgctatgtcaacagagagattaaaataactgaaacccccaaaacaaaataatttggtcagtttcaaactgtggtgattgaatggggcaaacaaatacacgaggagatcattaaaccattatgatttcttccatatggcgaatcaaacatctagacagctccccaccaatgcatcatcagttcttgaattctctgaatgagaagtgttgcattttggtttcttctagatgcccacccactatcagtaattaccaaaataattaatgcaggttaccagactctaatcaacaacgatcatatctccgcacctacattagtttacttgctatgacacttttcctattcatatcaagttagacatttggatattgacaacgacctagtatgttgaaagacaacatagatgttaggtaacgatccagtatgctaccatattgcggaatagaaaatataaattgtacccaaaatcccaaattgtcaaagttctgcataaccagtatacaatcagttcatttaacgatattcttgccttagaaatgactatcggaggtagaactaagtagccacacttaagcaatcagaccatttaagccatgcctagcatttaaccttagctgagcagacaaaacgatacaattaatcggacacagcactgtgacttgcaagtgattgctctactatcaccatgaacccagtacctattcaactattgtaaatattaaagcagagcttccatatgaatggttagaaccgatatttgccttgaacatcgaatgtatcatctggttcaataatgtatagtccaatctacattataatacgcgtagcatcatgaaacctaagagatcgaatacttcgcaggcaacaccagcatttccagatccatacaaagtcaatcagccagcggatctggttgtcgaaggagagtaggtaccttcttgacggaggcggaccaggagagtgtgaggccgaggaaaacgatgaagaagaagggcccccagagatcccaatccctgagcgccttgccggggtcctcgcggtaggggttggggaagacgacgagcttgaggttgctgacgatgcgggcgaggtcgcgcttgacggtgtcccacacgggctcggtgagcgtgttgggcggggggccgaagccgtcggaggcgatggggacggagacggaagcgggcggcgcctggggcacgatgatggggacggacgcgccggggagggagggcttggcgggggccgggagcggggccggggaggtggagaccgggatggaggcgcgcggcggggacggcggccgcgccgggagaacggtggcggagggcgccgcgtaaatgaggctctcgatctcgtccatgtcggactgcgccgacgacgggtggagcgggatcgtgtcgccgtggttgtgcgacatggcggtggcggtggtggatctggcgcgtcggtggcgcggcggagagagatctcgcgggagtgcgtgctgggtttgggaggagagttggggtggggaggtgcggatttgcgggtgggtgcgtacctgcctgccggcctgcgactgtggactccaccggggggctttgcttgggaggagggagacgcgggatggcacgtgatacgacgtgagcgttgagagcgcgcccaaagtctggagaagcttaaaattgggataagcggttgataagaaataatctaaaagctagtttttcgattttctgaatttgatactacgggtgtgtttagttcatgctaaaattaaaagtttggttaaaattgaaatgatgtgacagaaaagttggaagtttatgtgtgtaggaaagttctgatgtgatggaaaagttggaagtttgaaaaaaaaagtttaaactaaactcggcctacaactataaattcttaaaatctgactatttgtgaaagtttctccgtagtcgattgcagaggatcctgatcactgaatttaacccgtggaggttctaggagaactgtagcaccctttgccacgctccgaagcgatggtgtggcctacgcattggagacaatggagatctcccgtcccgagcttgagagggattagtgaaaaggactttcaccttagcctcactgcctcagttgctatgttcttctttttaccttttcaaatgaatactccctccgtcccataatataagggattttaagtttttgcttgtaacgttttgaccacttgtcttattcaacaaattttaaaattattatttattttatttgtgacttactttattatctacagtactttaagcacaacttttcgttttttatatttgcaaaataaaattgaataaaacgagtggtcaaacgttgcaatcaaaaactcaaaatcccttatattgtgagacggtgggagtaacattttaaatgaaacaaaacaaagtttttcagtatgtcccaaatttttccattgtctaaaacgtatcctgcaatgtaatggggattcaattgaagtttggtacagcaaaaccaaaacatcggatcctttttttttagatattcacaatgtaaaagtgaaaataagttactgatcaatgcaatatatattgaccgaatatttatttcactacagtctacggcagtcttttacaagacattatttttgacttgtaaccacacaaataaataagcaataaataaattgaacctctatctaacctatggacagctaaggattgaatgggaagcaacacttctcaagggcttgtgaaaaccattgaaaaaagtctagctgttcttcctttacatctgtgggtggtggggcaagcggaagttcggcagggagatgtcgatgaaatgagtctactgcggctgccacgccatcttcattcccaattgctattgccagttccattgttcgtgattttaccttcagcaaggagccaagaaaagggttaactaacaaacacagacatgcatttgctcactaccattcatttatgcagcgacttcacgagataacagcatacttttactgtcctacatgacaaatgagcatacacctacttgaatgcagaggtaataaatcgtttatttcttttcatgtcaacctggcaaagcatgccccgagtgttgtcaggggtgcctttgtcaatactatctcctagtatctcaaaagttatgccacaattttgtagtgaacgtgaagtttagcaattgtttggactcctaatgtactcttttactccctctgtttgtttctctttttttttttacgttggatagttcaaaattgaactaaccaacgtcaaataaaagagaatggagggagtgtcagtttggagggaagtccgctccaagctcttgaggaaataaacacaaaagattataaacataaaataaaatggaagcatagaaacagtactacctcaggatcaagcatgaatcttatagcatttgaaagtgcctcgacagtaagttctgctataggaataggtgcagggccacacccttgtgcatgaattctctcaccccagaagaattgatctccaaaaaatggcactatggtagttgggcactgttaagagtaaagaaataagaaacgacatggagaaatactgccgatagttattgtgaaggaaaatatatgacattttatgcatatttaataagatcttgtatattgaggaaactatgaatacaaggataacatttttcatatggatggagggctgaaaaggccctggttttgttttgtaatcaagtgacatgttttctgctaaaaacatgaaaatatcacattcgaaggctccaatattaatccaacctccatcggtattgaaatatcatttcagtttgtaaagagactagttgcttaccccagctacaagccccgcggctgtggtaccagccccaccatgatgtacctaataaacaaacatataacctgataagtaacatattcgggaacataatgcactactattgaacatcacaagattcacgttaacgaaatttatagttactctgagcaaaagttttcattctattgatgcttgataccatatggtaacattcgtttaaaaaattacacattgtgacgctttcgaccatattataaatacagctaccacattgtttgctcgtaccagcgtattctgtgataccacacaatatatcactgcatattggaggtagcatttaattgttttattttaaaataaagattaaataattctataatggtgtatacaactcggtgaaaaaatcatggttagaaaaaagaaaaaaagagaggaaaggcagtcttctaaatggtggtgttgcaatataaaactaaccactgcagcacagcgaggaaacagccagtcgtgagggcaatcctccaaaatgaagacatcaactggaacttctgaaactgcaattgcaggttgcattcataaatgtacaaggtaggttagttcgttattctgtgtccatcagatgtcaatcccaacattaaacagaacaaaagtcagaccaaatttaatcttctctaaccatatttagtcaagagctacaagaaatgacagtctaccagatttaaaataggttgctacagaacaaccatatttagtcaagagctacaagaaatgacagtctaccagatttaaaataggttgctacagaacaatgcccgcatgtttgaaatctactacctagtacacacatgctccagaataactacatcaagagatagtacgcacattgtaaagattgaaaagaagcacaattagaattcagaaacaacttacaacttccaagatctccccaaccccgactaatgattcctctttgtcctgtttctcttagtgcgtccagaatgacagaagtgacttttttttcatcaccaagaggcttcaaacacaacaaaaaccacattagcagaactatacagttctcataacggaacataagaggaaataattctcatatcaatcccatcatagatgtctcaaagggctgtgagtttaaggctgaaaacttctgagtatctaattttcacaatctaagaagatctatctattatttatgtagccaaaataacatgattcagttcagatgtattaggaaaacttccattggcatattgcaagttatcaaaggattagatggatgaaaaaaaattgccgttcagaaaaacaaacaagggggatgcaacttgcatggtggaatgagaatacaaaaggtattcttatggttagtttttatatgaaaatattgttgtcatacttattgaaattatagtattcaaaacactaggttattgaacagtcttctactcatttttcacatagggatcataccatgctaccaaaaccaatatatattggttttggcccctgttgaagccactgagaaagctcttgcggtggttgatactttgttccaagatttaagaagcaatatcccacaacatccacgagaggaccccaatctgtagatgaaaaaacatgcacacaataagatcctaagatatttgtaaggcatgaaaatcaacaaacaggtcatggtggtataattataaacgagcatgatgatgattcattttgtaaaagctaagtaagttttacatctgcagactgagttgcttgatgcagaaaatatgttgtaggggtccaaagcgcacataggtcaatggggataaatgttatcatgatatttgcgaaacaaaaaaaaaatacatacgctagtatttctttttgtgtgtgtgtggggggggggagggggggcatatattagtgtttctaaccatgctgccatccatatctatatatatggtcagctaccctcacatgcacaaaaaatggaccctgtcaagagggtcctatcactttattgtaatgggctaggatacctaattacttggatttatgtttacaccataaggaagaaaatatatctaccatatacatgagacaaaaaaaatgatgtgcatttcatgttgaagctcaattatgcactaacagataagttgtatcatgaaattttagaaaaaagtttatataaggataccatttggcttcggcattagatgagggctccacatgtatccagtaggtaagtgtgatatagatccatgatatgtgctgaaataggcaataggggccaattttaacttcttcctgaactcatttatgaatcccctggtgccccaccaaattactaaatccaaaatcagataggatagctgaatgtgagaggtaagcatgtcagaatctgattcatttttaaaaaatcaagacagatcaattcgactgttatatacatataatggaaaataacatatctaaattgtggctgcacaactgtgaaaaaggtagaggttgtaccctgtaagttgcactctgaggcattcgtgccaatggatgagggaactcattagttggcctgcctacaaatattgggagttagaaaaaaaggatatatatcaaccttacacaaagagtacaccataaatcttctcaaataaaaaaggaatcagtcatagtgatcgtaggtcctgccatccagctcctatcctcacttcaaaagattgaggataacctacatggatatgtaggagtgcatcctctgcccacgtgtttatgcatgtgagcagttcatctaatgtgaattatactgttatacatccaatgttttatgaagacaatttttactttgcacttttcataacccaaatgaagagtcctcgcagctcactatttggtagagtttacattagaatttcgagtactagttctgttgtttttgtactataactatttggtagagtttccgttagaattacttgagtactgtttcctttgtttcatactatattcaggatattagtctagcatcactaaagaaatttatcgagcagtgtcaaaggtgttcttagtaaaagtttctagcacaatcaatagcaagtgggacatgaaaaggaacgacacaaaaatcttaacagggatagccatgatgataggaaaattataaaatgtttttatgctggcaaggagatagtacagacttacgtccatggaaaagtgaagaagatgtgcaggggtaccccaagtgcctctgcaatatgtagatgtcctgaagtgatataatttgttagaagaatataacacagtacactggtatatcaatattagtatcgtaatatttacaagtcctatgattacagtattttggcataagaccaagcaattgctttgcctttcaaagttaatggatgcatgaccattgaccagtcaagttgatgctttgttaattttttaaagggataaaagctggccaaaactttagtatgtgagcaagtagcgcgtgttcattttaccgtattgacagtggtttaagaaagtttacatggtggtactctttaactgttgcattcatagcaaatgttgaaggcctcagggtaaaggcaagcatacttgatgaaatgggagagataaggctttcaacaagtcaaaacctcggcagtagatccatcgcctcaattgaatgccaaatactaagtagttttaatgactcagaaaacaaaaatatgaagtcagaagctaacagaatttgatgtgcaaaatagtcctatctatctagtacttcttctgtttcacattaagacgttttgggttttgcataggttcatgcatggattcaagtatgtgcttcatatatgtgtccaaattagattcaagtatgtgcttcatatatgtgtccaaattcatatggatgttagtgaatctagatgaacgatggagaggccaaaatgccttataatgtggaacggagggagtacataattaatgcaggtgcgataatggattttcttgagagattataaatttccacatttataggaagaaagcatccaacagctaaaagtatcactaaatacaactctatctttcttacaaagtgcatattgtggcatgcacaactcaataagatttactaaaagaacatgctaaatcaacaaatattataaaaaaaacttataattaacctttggtaaagagaatagagtggtgtcataacagcaaaacccacctaaagcaggaggatttgcaattattgcctgagctctaaaaggtaatccagtgtccaaatcaggttctgtgcatgcaggtagaacagagaaaattatttccttaagctgctttctttgaacagaaatttctgtgggtccagccaggcaaaatcctttgttttttgtcatatctgcagttgaaaatgccctttgtcaaatcaaaagtatagtacaaacatatttataaaaactccgttcaataaataactcataagcactgttatataacttgtgaaaaccattatgcttcatcattagcaaaatggcataacaggattatgacggggcaatgttattttaacaaattcatttttgtggacaatcaagtctaccaaaataagcaaatgcagccttatgagtaaacagtcatatattttgagcaaggcaggtgacaagattaattcagaataagaaaagaaaaacatatggtgtataaaattttccattcctggaggcatagcagtatttatacaatctataaaagcaggagacagcaaatcatacactgagccaatatgcgaggatcaccacccaacgggtaaaaatcaataccagctgacttcacaaaggtacggaaattggcgtgagttgccaatctaacatagtgaccaaactcctgcaggaaatgccaaaatttctattagggaaaattggtttggtgaaactgaaagataccaactttagaaatatacagtccaaagtcacatgtgacaggtacacttaataacatccaatttttgcactatttagatatctagcattttgtcgcccttccgttacttttacccatttttcatattttttggactgaacaacagatgggaaaagacaaaactgcccttgaatcattaagcactcagtctactctacatcatcctggattgatccaatcttgccatctctagccttgctaacggctcccataaccgccatctgctcggggactgtgctatcagcatggaactggttgcatgagcaggtaaatcgactgcggcagcggatagtgatgagggacttgttggagtaatgaggagtaaggattaactcatcatccattattgattgacaagaaaatggtgagacaacctgcgtttgaaaggatttgaactcaggccgatgcactgctcctggcagctccctgccagccgagctagcagccattctcggtgatgagggactagcggagccggctgatggtccaagaccatggctggcatggatttgacaataatgccaccggtgagtggtggtcagggactgtggcagcgccaatggatggtgaactagaactgcaccagttgtgaggaatcaattgcaccgccaccgacgagtggcgatcagggactaccgcagcagcatggaattgtatgcggggatggtggagtcaactgcagcagatggaaagaaagtatggggcagggaagtcgactacggtggcgacggcaggggatcaactgcagcggcaggctggcagtacctagagttcgctccaagtgcaggctctgtggagtttgccagcgaacgagcagtttgtcatccacacagagggtatttcggtacaagagttatctgaagcccatcacttgatggaaatggtagagaactaaatgtttgtaacttcgaatggtattaaagtgaaccaataactctgagtggtatatttttaaaaccaatcttccctttctattaagggggaagcaaatacaagcttgcaaatatattgtaaatccagtatgttatttgatgattgctattaattaagaggattccataagatatcatgagtatatacacttaaaaaataaatacacaaaaacatactacgggtgtaaaaatagtgcaatccaagtcagatatatcaaggtagataagtaaagagtagtgtagctctgtccctctaaaacatttcaaaggctggtagacagcataaacttgtagccatggttcagttatgtgtagtcttgctcataatctcgaccaccactgccaggcaggccgttatgttcacatcatctaaagttatcagaataataatcttgagcacacacttaacaaaatagacctagcatatcaattgtccacaagaactcttgaatggatctctagtgggagtttgcaaattcacttgcctgaagtcgtttagctaaggctataaatggctggacatcccctcgtgttccaactacaagaataacaatcttcaactttgggactgacttgctcaatccaggtgcagcttccacaatatcacgagacagagaaccgaatgcatcaatctctgaaagttcggatgcaataagagcactacgtttcacatctacctccagtgtaccatcattctggatctttaccagattctcaattatctttatctgaaatccaaaataataatgaatagctaaatacatggtaccaacaaaacaagctgaattcaatgccatattgacatataacttccatttttgtaggtaaaatatcacatgagaccctaattatgaataggtaaaacacaaagtagaaacatcagttcttttggaacttgcaagaatcattctatgaagatacaagtgttgcttcctggctgttcacaaatttcaactaaagtcaagctctagtctcaccatgactgtagtaaacactaaacagcatatcaaacgtcagttcatttctagccccattgtaactagctcattgtggatagatgactatatagaatggtaattgcatctagatatcaggctgcaggcagaaactagtatccattgttacattggcaataatacaaacaacggaacagtgtcacatgaagtttctggcatgcatgaaaatactgcatcgtatattgaatgcaaaaaattccaaacgtgtaatagtataacataatatgaacaaccttctcattttccgatagcatatccaacgtgaggtcacacttgagcaacctatcagagtatgatcttacaaaaacatgctcttgccctttagaacaatccgaagtggcagttgtggatttactatgtccaaatcctgtggcagaacagattgcaatgttggcaacaattatatttttagcaaaaaataggcgtatataatgcagtagtatatatctactgtatgaatatttctcagtgaaacacctgcaggtcccagatgttttacaacaataattattatttttttaggtaaacaataatagtgagtatatcttatacaattctccgagctaatgcaattgagaacagtagattgcaagatgccaagataaactctgaggcacataatattaaattattcagccttccagtcttgtaataaagtgagaacatgactagccagtgttgtaagaaagtgagaacatgactagcgtgagctgtaaaatcaaaatcttagtaatgtgatgaaacgaatactcaggccaaaactccatgttatagtaagaacaaaattgaaatggagcaacaaccttgtaaatcagtaagttagctatatctcatcctaacatccttacaccaacactaaagtatagtaaacaactaaacactaccaacttgccctgaacaccccatcggcattcagaattcaaacatgcataaagcttaaaccatctaaaatggctatatatatcacaaatatcatcatacatttgctttggaagtggcaaaatacttaaactggtgaaaatttgtgcgacctgaaagttcccccttcccgaaaatttagcactatatat

SEQ ID NO: 5557 - DNA, 15328 bp, Oryza sativa
gagcgggacttcttccctgcgccggagtcaccgacggccaccttctcctcacagcttaggcgctcagcgtcagcgtcgttcctatttggatgggataggtggacgtagggtatcccgtcgatacccttcccgatggtataccggtatatagcatttccgaaagaaatacaaaaaaacttgtgaggtccacatgatagtggccacctcacctccttgctctacttcccctctcctcacttcgcttccccagctcctcttatctcctacgcgtcgtcgagctcgtggtcaactccattctcaacctcgtcggtgagatgagaagcagaagcatggcccccatcctcatcgagctcttccctatggcgttatccacctcccgtcgtcacttctgtcctccatgacatacctggtcacacgcacgacggatgttgctgacgttttctccgccgctccaggacctgtcactgtcatcctcgactccacctccggcagtgagctccgttatgctagcatcgctgactatcctctactccacgacaacgggcctccaccaccggcctcaactccgtatctccactccaggtcggccaagccccaacaccgcatccgccttctccaactctaggacccgaccactttgtcgaccatgccatgattgcttctccctagctgacagcgcctcaacggatggcctcatctctatcctcctacccatccctaatgacatcaactctatcggttggcccccggtcaaaaaaaaaactctattggttggcccgtcgaccccgcccaactccctcctcgacacgtcaccaaccacgacctgccacaccctctccaccagtctgccccctcacggatctaaggttgtcgccgtcccaggcttctttttcgattgatcggcaactgctcgtcattgtcgttctacagagccaaggaccacgcttcctctagctcgtcttccactcaagctgacgccgtctccacccagcgtaccgagtgcacactatcaacggcgataagaacaagggcaagctcgactacgccgtgcttggagctcaccactggtgctcatcggtacggaggagataaggggaagagaaaggaggatagggaaatagaggaagaaggtggtgtgaccacttatagtgggccacacaagttattttctcttgctaattcggatactacatcagtgaaatcagccatatatactaccacgggacataatttaatctggttttgtaagtcgggggtcaagattttggtattgcggttaagggatacatttaaactcgacaaaaggaacgtcaagtggactcattcttggacaaatttgcaccatgggcttccgtgtcaactgggctgttactatacagcttgagaaatggcccatgagagaaaagcttgttacttctatttgcctctcttgtttctgctacttttggtacgagtgaaacggagaggaaacaaacaaccggtgactggtagatgtgatgggcaatgcgccgaacgccgatgcctcgtcaccacttggctttacagcgcaacagctgctcgctttcactggccatttcttttttccaggccgggatagctactggccgccgctacaggacgaggcgacgaaaaggcagccggtgtccggcgccaagtcatcgcgttttgcaggcgatgggaacggtccgcaccgcgtggcgtggagaacttgagatgcttctaggctgccgtccaggtgtgggcttcaggatgggcagctcgccgtataaaaaaaagttcatccgataggatgcaggatcagttgtgcccgccggcaagcgacggcatccagtggaaaaaaaaacaaatgctacgggtacagccgtacaaacctgcaacgtactgctccgtagcacctctttggggaaacgagctgcatttgccggcacagcaaaatcataggtatgctaatataaatcttatcaaaatttaataatggtaaaattttagtaaattaataatattgctaaaatcttaattatcaattttaacaaaaaaatagtatgttgatagtgtcatcaatctgaacatgctcatactcaaggtgggttcgtaacaagtggtgccatctaggaagtcggaaccggaaatcagcttggtgagggcagtatatgcatattgtagaagccatagctcgacggtgagagtaatagacgaagcgttaaagccatatgttaagaacgcgttgacgagaagctcgagtttgaggttatggccgtcgtcaccagatcaagcccctggttaatggagaagcgcaagagataacacataaataaatagttaaaagataaaacctagtaaaaggttttagagtggtcttattctacttctaagaactttcattggtcatgcctttatacaactagtgtctctataggttttgatgaaaagaaagatgcttctacatgctagaattatgtttcacattcactactgactactgtttactgcatatacctttagctttggttaattcaagctatcaagcatatgtgaaaccaattaagacaatttcttcctccttctcacaatggtattccttttagcagtttcaaatactatgtattttcatttccaagatcaaaaccatggttttattgtaaaaaaattgttattcccttttcattaatcaaccgtatcgaaaccaacaaaatattgcatttatgccttactccaccgttctaaaatatagcaatctaaaattggattagacttaatactatgaatccagattagaggaagtaagttcgtttcttaaaacatttttttatacttccattttcctgttccatgtactccaggggtaatggataaaggctgtgtttatttgttttggcaaaaaaaatttgatgtatacggacacacatttgaagtattaaacgtagattaataacaaaataaattacaaattccgcctgtaaacatcgagacaaatatattaagcctaattaatccgtcattagcaaatgtttactgtagcaccacattgtcaaatcatgacgtaattaggctcaaagattcgtctcgcaatttacatgtaaactgtgcaattggtttttttcattcacatttaatgctgctatgtatgtatccaaatatttgatataacgtaaaaattgaaagtttgaaggtaattaaacacaaccaaaaattgcaaatggataaggcagttacttctagagtccttgttccagatacctgtaccttatacaagaagccacagtacgatccagcagacaaagcccccacacctgatcccatcttatctccttcctgtttaccctgcacggcacccattatccaacttaacaatccaatgggccgtccgtccgtcccgtccctgacctgcctccccctgccggcgcggcgcggcgcggcggattccatcaaaaccaaaccagtctccgaaacctccccaccattaacctctaaaccataaagtccccccgtctcatgtcgtctcatcactcacttataatcacccccatccacttaatcacgctctcaacgctgctgtgtcacgtcacgtcacgcgcggctccgtaataagaccaccaacctcctcctcctccctcccacgtttggagctctcgtctcgtctcgcggcctcgagccctcgaccaaccaaccacccgcttcttctctcccgtctcccgaaacctccgagagctcagaagaaaaaagaagaaaaaaaagagaaaaaaaaactggtggaaactggaaggtttgcggcggaaacgagggggagggatggtggcgaggagggcgtaagcggggggtgggggtgaggcggatgatggcgtcgagggtgatggcgtcgtcgtcgccgtcgcacacggcatcggatctcgcgcggttcccggcggggaggggtgggggcgggagcgcggggctggggtcgatgaacgtggaggagatcctccgcggcatctacgccgacatgccgacgccggcgctgcccctcgtcggcggtgacaggccgatgtcgccgctcccggcgccggatgtcgccgccgcgccgcggacggcggaggaggtctggaaggagataactggtgcgggcgtcgccgccgccgccggcggcgtggtgccccctgctgctgctgctgctgctgccccggccgtcgtcgctggcgctggcgctggcaccggcgcggagatgacgctggaggactttctggcgagggagggcgcggtgaaggaagacgaggctgtggtcaccgatccctcggcggccaaggggcaggtggtgatggggttcctgaacggggcagaggtcaccggaggcgtcaccggcggcaggagcaggaagaggcacctgatggatccgatggaccgcgccgcgatgcagcggcagaagcgaatgatcaaaaatcgcgagtcggcggcgaggtcacgggagaggaagcaggtgggtgtggaaactgtgcatttttacaagctttcgttcgccctaggaatttgagttatactgagaaggctgacgtcttctttttgttggtgaaggcctatattgctgagctcgagtcgctggtcacgcaactcgaggaggagaacgccaagatgttcaaagaacaggtacttctccgagaccccgacatttctcgtgtgcttgtttgatgttggaaacttgaatgtggggattcgtgtgttgagaattgaaccgtgtctccattgtttattgagcttaaacttgcagaaatgtttctgttaaatctctaggtgagtaggcatgtgaccatgaacatgttagaactgcaacagagttgggctgtggagccaaaatgaattgcaagtagtattcgtttttgttagccatctgcttaggatgccatttgccgtggtaaattttttaaaggaaaatgcttcgcatacaacaatcatatactagtgcaccaagcagcacacgctgttcggctgttcggtacagcggccacgctacagccaattgctacaccaagcagcacagccgctgcactaagcttgctgccgcacagcgctgcatcaagcagccgaacacggcatatgcatattaaaactcatctcattcgctgcctttgatgtattctcgcttttccttcttggaaaaggtctccctataaaatttgtagtgtgtacagaagttgtctgaaagaagtgttattcactatactcaccttttgttcttgtctccatttcccctgtccattttaatttagaatttcatactgtgcctacacggttacggctggattgtgcatgacttgcttataactaatcaaggatggcataagttactcttcttggtcttctagcaatttccttacgataaactccctcgcatgtgtttcaggaggagcaacatcagaaacgacttaaagaggtaagctttgtaagatggtgttgcctttaattatctagtgctttagagcatttgtgttaagtgccatatcccaaaaaaaacttcacccacaacgcatgccctggaggggaaaaaagaacatcgtcttgtgaaaatcttgtaatcaatcctggatcagccttcatataggaacatacagtacagaacacaatactgggtaagtatacactggattattccgtattcgttggatatgatactccaaacaggagatgctttttagccttcccactagcctgcaccaagtggcttggcaaacaaacaataggtgatgctgacacctttcgatggcatcagcacaagtgcacaacacatgttgagttttgagattgtctacctcatccatttctttcttgggagcctgttcaactcattatagatgcattgcatgtatatatgtctgattaaaaaggcctgagcctgcagttccgtgcttttccaccacggcacagcttgccaggttgaagcagtatatagttataaattgtcttcttttgtcactatcagggaggttgggttgagagggagatgctttgtcaatttggttgtataagttgcatcgtaggcacagttgagcccacatcttgcttaggaacagttcgcctccatttggctttgcatactatagttgtcttccatttagttttcagccagcataggatttcagatttcttctaattttgcctttcctgcctggattgtatatattgatttatatatatcttgacgacctgcctctcatcgttggtgcagaggccgaattccattatccaaaaaaaaaaaaaaatcttttgcaaatctatatgctcattaactcattcattaggttcatcgatcatgcttatctgaagaaatctgtttactttatgcagctcaaggaaatggttgttccagtcatcattaggaaaacgtcagcacgagatcttagaagaacaaactcgatggagtggtagacgtgagccaagctcagttgccatccccatacagtttatgtagcatttgctcctgttttgtcaattcttctgttttatcggcagtagcctagttgcggtgaatacatgagtatttaggtgacacgaagcttaaatgtctggagtcatatgctacggaggggagagtgcgtacgagctacaaaagcaatcatatgtgtagggaggggagagtgcatatgagctataaaagccatgttccaatttgtcgcgggagtgtattctgtcccatttgttgtctgtttcattttcagtttaacaattaggtgtagtgaggaagaattacgagtactgagtagtactaaacagggtgactctaggtatgctgatatgatatctagttaggcattacttctgattctctgtttggtgccacgactcaaattgtctgtacatacacgttggatgtaaagtcacattatcaagtgaaatcatgatgtatttcctccagaattttttttgactgaatttcttacagaatttgggatggctgaagtatcatagcgaaaggcagaatcagaaagatacaatcggtgacatgtgactgtactttcaggtcgaatttcgtaagccagcgcagctctttagcgtattttggagtattatgattctgattaattggcaatcatctgtgacgtaaaattcaaatgattcgttaagggtaactaaatgttacagttcatatatagtaaattagagtatggttcctctcgtgaagtgattccaaaaggccccctactgactttttttttatataaaaatgggggcggaaaagaacatgatcagttgcatcaacacaccaaacattagctacagaaattctaatgcagatgaaagggtaagtaatcactgtccatccttgattcagtttggcaaggagacgctaaaatcacctctaaaaacgaatattggcttctgctagcttccagccgtcagacattacccgattactgatagacaatcctgcctaacatcagcaacgaagacacttccagattcgcaccatccagccacaacatctgtattcgcacactgcaagttcgccagcaacgtcgttaatgctctcataggggctagcttaacagggttacagggaatatatatcgcagcaagattttgccgatgcacacaaaaacattatactataagttattaatgcgagaggctagcttgctcccacttataacaggactagggattacctttgaaaaacccaaccagttggagtcccctcgaaatgagaaagctcgctcgtttcccttccaaagtccacatgtaatctgcagtgaaattatacgtatcaaagaataaatgtttacatcacaaatcacaagcaaaataattgcatatgtgctcatcaactatggtgtaacaacaactaattaagttactcactagactaaatagtccaacgtgaactgcagccttgtgcagaagagttaacagccgtatataatctattaaaaaacatatatcaaaagctgcttccagagaaacaattatagtgtttttgtctatgttactgaaattcacgtgtgaaattggcaatgagcacatgataagctaatgcatagctgatgttcttaaaattaagcattctatctacctaaacacaggttgccaccatgcaaatgaaattagtcgctaataactccgagatgcatagaattttaagcgagcttgaaaaaaaaaattatcccacatacctcataatcaacaccttggacataaatgaaagattcatcaactgatgaaaatgaaaggcctgtaatctgtgtaggaaggtaaatattttatcacatcatggaacatttcaccctcaatgcaggtattatgattcttctatgaagaactgtggttgaaatttaacttctttatatcagctacagaaagcaatgtcacaaggcgggctaaagtagatcgaacctcatacttggagcacccaacccatcttgacaaggctgaccacctgcatacaatagatcttcaattaaatccagattgatccacggtggtaacttctattataatctgagtatcttgttggtaccagatacagaagtacaaaattaaaagaaatacaaattactccaggatagcaaggacatgcaactattcatcggatctttcaaactaaaagaagcaagcaacccaacctgcgaggatcatagatggttacagtacgatctgttccaccaacagcaattggtccagaaggagaactacagagagagtatatgatgcctccaatagggccagaaatgcggtgtatgcatccaccattattgctcgttctcaagtcccatatgctcagctgcaaactaaccgccataagaagagagtacagagaagaaagtttatacagggacggtggattgattttgagtctaacctgagaaccttcagcgattgctagcattgaaccactttcattcacttgtggcatgcactgggcaaagctaaatgaagatggataccataacctgcagtttcaattttttacatgctaagtcagaaatattttgacattacaaataaatttcagcatgcatatactagaagatattatacagtaattataatatggtcatatggatgctgatagatgggggttatctgtttcattcacaaggcttactttgaatatagcaaggcaaaggtcagatataacccatatggatgttaatttttcgtttcatgtaaaatcgcaagtggtcgatacattgtgctttagcaactttcaaaaacaacaaagtcagtcagacaataatctgtcatgaaggcaatatcctggtaagaggaaacttacgtacgtaaactgcgaacatgaatgtcctggtcgtagatatcaatgcacttacacaattcacgagcaacagctacctggaaagaatataagttgtacctggttatgtggtaatgcaagtgctctacatattgatgcttatgctaaaagtataaaagccaataggaaatgcactgtccctgtgtataaagtttttgctaacaaagataacatgtggattttgtttgtaggcaataataccgtggattggtgcattggactaaaacataacccagcccaacttccttctccgacaccacaatcacgaggtggtactgaataggaggccctgtcaatgtctgagcaagtttagtagcgatatgttcatacatcgctaatgagaaagatgcaaatatgggatttctttcatgttttcaattatccatgccatgttgaagacaagacagaaagttaccatcagccaccgtatctaaccgagatacaataagatgaccataagagtcaactgttccaagaatcaaacagccatcacctggtaaagtggtaatgccacaaagaagggtgtgaaataaactgtggaatatgtgccgttttaattttaccaagactaaaagaagaacaaactgaaagccgaattggaattgataaataaatttattcggtaaattacaatataaacatataattttatcctcagcacttaacaaccttgctttgtgtataactgtatatatcgttctagtactttgcctagtgcctgtgactggcaattgcatttacaaacctaagttagaaccaaccaaatagtcaactcgtatagcaaatccaacaagctaaaattaaaatgacagatcactaaaactgaaatggctaggaagttacaggcgcatgagacagtgcttggtgaaaattagtactagttgccaagcaattatattgaagcaagagcagttactataaaatttcctcaagatataatataattaaatactccctcaattccaaaatataaggcataaccaccctaacccaaagaccaagaaaataattattatcttgtagtttggatcatcctaataaatacaatgcatgcatccaatagaattagagaacatgagagtggaggatttaaaaaagtaataatttaatggagaaggggtaatagttaattgcctacatgcatgtatgccttatattatggaacatctagaaaaagtagttgtgtcttatattatagaatggagggagtacaatataatgtacggtcgttgtttatgctctttgtaagccatagtttcagcaggcaaagcggaatatgccaactcaaacagaagagtatatatcaacacattcataacaggttttgatggctatttcagcctatgttatgttaagtgaacagcagaactactgaactacaacattttaatctgcgaaataagagatggttctatattgttgtgagatactgaagattgcaccttcaccctctgcaagaactacactctggatctctgaacgatgtgggcagcgatccaccactgacgagcttatgacctttcatttagcaactgaatgtaagagagcaatcaaggaccaaaatcgtaaaatggaagtccctatggaagcctagagtttgtacctctgcattgataggaatcaagaggctctccttgcccttggacaacatctcaccctccatggctatctgttcagctccaagatgaaagagaaatgggaatcaaacttgagaaccgcatcaaattacttcccaaatgtaattacacgccaactaccaccaccagcaaaaccaaaacgaacaggagagctatgtccttaaattctctcgccatcctgcgccaacctgcaagagcgactaagaactagacagcccgcacgacaattcctgatcccacagcattcgtgaaatcgtgaccccttgccgcgatacagttgtacgaacagaaaggaacgaggagccagtacgagggtgacctcctcacctcaatcttgtagacgcggcagccggaggcgaggtaggcggagcaggaggagccggcggcattgacctgcgagatggggggaaccgaacagcgcgaatcctcagagccctgggtttagggttttggaggcgcggcgccaacgagagagaggaaggacgcgtacgtggacggcgaggcgggtgggctggaggctgccgggcgaggggtcggagagcagggacggcggcacggccgccttccggaggctccgcggcgccagcatcgccgccggccgccgcagctttttcccgccgccgctatctcctccgtcttgggtgggaccgcctcactaaccgacacggtttcaccacttcacaaaatcacactaactccttgtaaaaaaacaaaaaaacaaccacactaaactccccccattcaaaaacactaaccggagatagttatctcatgataaagatgctggaaacgtctcccgaactgcgtccatcttgcaaaaggatactggtacagtcaataggtcacagtttcccaaggattttgtttgtttttgttctttcttcgcttatgtgccaaacagtttcccaaggattttgtttgtttttgctctttcttcgcttatgtgttatctgtaatgcgatttttgcaggaggttctttaaaccagaaagctttgtagtgcttggaagaaacacgttctttcatatgttgctgttcacgaatcgaagccagagcctggagcgccggttgctgatctagtgtggaacaaagttgggttacaccacacttgcccctttctggtttgccgggttttggtgcgaccagagatgtaaggcgatgactcgtacgctttcttgcggctacgcatttgtaaagtaaaacggccgattttccagtagtcccaaactttcgccgaacagaatgtccctagtgcacatgctttcacgaaaccatcctgtcggctgccgcaactttgaacttgcaagatagcaagaacacaattttctgattcaaatgcaatattacatggcacagcgttggaacaatgacattagttttgaagctcttataaattattagatgttgcaaactggcaccccagattttttcttttaaaaaaagagagattctggaagtgttagtacatggctcaaggtgaccaatgatctttaggtctaggatttctctgcgaccgaagtatggacatctgatcatcaaaccaccctgtagtattctgtattcctgccaaaaaattccgcgatccaagtctgggcatctgatcatcagatccttagatcttgtagtatttctgcccaaagaaaatgaataagaaatgacaggagggttacatgtttgatacaactataatatactactacgtagcgtttacttctttaaagacacgactgtttgttttcatataaacaccagggaaaagaatactgctgggaacttctaacagatcattagatcaacaacacatgcaaaatagtgacttttgtgaagatagctcaggcagagtagagataaaacctatgcctttcctgtgctacctcctgttattgctttgcagattttcagttggggaaaaagaatggtaaatttacagaacaggacatagaaggattattgcacatcagtcgtggacgaaaagtttttctctcgcaatataatttcatatttattccattgccttttatctgattaagaatggtaaaggtggaaagaattgaaagattgtatagacatgtcaaccagtcatgtacagtactcgtgtgcttaacggaatgtagcatctatgttggtcatcagataaggtatcattttgctgttcctatgaacttcacgcaattaagaattatagagagattgagggacaacgattgtataaagggtagtaatctgttggtgtttactcttcctaagaagtctgatggtgataataatcatagatagctttcgtcctgcagatcaatttgggaggaccaaattgcaggtgcttgaatatgtagagtaggttagtattactcgaggcaaataattagcttcaaaatcagttgtcatatattatgtccacggtgccattaattttctgtctccttttatttattatactactgttttcactcgatatccagagaccatcactattctaaacaggtcgaaagctaatgttactctttttttttttgcttcatcatttgcatctaaagtaataatttgttctactttcctaccaaggattgcatctttttagaaccaactctcttcaaatcagttctagaaagcataatgtcagtcggctctatataatataggttcacttataaaaatgttatacatggcataatatcgagtttcctctttctatcttccagtaacgtgcagggtgtttcactacattttcattgctaataatcacaatcctatatatcctacagtaacagaacccagcccaactcatattatgcaaatgaggaagataatcatccacaagataaacccctaaatcatccacaaaataatctgtaggcagtaggctaagagttcaaatgagatgtttcttaacaacataactatatgaaacagcgttccaactctctatgaattgcaaaataataaagctggtagaaagtatacctcaatgccttgcagtgcttttttggcttcagcattgcttttgaagtgatcatagaccggcttcaaaccaaaaacataaggtaaaaccatttcagaataaaatattgttttcagtaagaacaatggccgaaagaaatcaagcacactcaaataaactattccatccgttttatattgtttctccttaactgccatgtgcaaaatcccagtaataagtctaagaaagagttaatgagaaatgcccgtgtatgactgcatgcatgctataattatttaaattcttttacatcatcaaagtaggatacatcatgggaatattgtaataactacactcttattttactcaatagaaaaatatattaaaatgacacctcatgagagaaaggacaacactgtgaaacagggcatgctgttgtgcaaatatgtacactgtttcataatatattatttctttcatgttagagcaacttatcaagaacaggggttactgtcaggaaaagaattactgcatgtggtgatccgttggaatagtgagccacattcttgagaagtgaaaacaaatagtactattttcttttttctattttgtttggtgagggcttcattgctaatgcatgcatcttcttgctcctttcgatatgcaattcctagcggaatttcagtccacaattgaacctagattttggagttaattctttcgaaaaaaataaaaaaaacagcatgtggagccagttgttcatcttaggccttcctatgtgaagcatatagatcttagcagtagaatttgtaacaaaccctgtattgggcatcttccaggtgagacaatttattgatctcaaaattgtcaatcatagcaaatgcagagaaatctcaaaatggcagcacccaggcaaaagaaagatgactgccaggcaagagagaaaaaggttacctgcaatattttgattaatgaatttgcgagagccagcttcatgtcaccaggatgcagaaccccacttacataatcagcagtaagctcctccatgctcaggaacgtcctgtatatttatagtcaatatatagtcatcacaatgaaatgcaatgatagtatcatctcctgacactggtactagcacatggatcttttgtgaatgaattcatttagttgtgacttgtttaatgcctgactaattgtcgagttgtcatgaactggatgaatgcattctactggtcaattacatgattataagcatttgtcaggaaacatggagaagtgacttggagagaatcttacttgttaccaccatcctctttctcccgaaccacctcaaactttccataccatggtaagatgatatattttatgtactccaaacatggattggcttctgctaattttggagggcagaaagcatgttttatttttctactgatatcaacctgcaatacactaaacgtatattgaacagactcatttg

SEQ ID NO: 5558 - DNA, 33461 bp, Oryza sativa
actattctattcaatatatatttgcatctaactgaaccatgcaaattgtaccattactcttgcatagcccataggcatggaaagtcaactatttttgcccatcttcctgaaccaagatgggctaccttacactatagttatgttggcctataaatagtgagcaagagttgcaagaacctttcactagctcttgtattaaatatttgaaataaaattataaaacaatgcaaccaatagaatattaacaaagctgaacatactaataacacaatacgaaccgtagaatcatccatgaagatggctaggaatgggttcctcctatgttcttcttcaggatattgtaataaattaggaagcttttctgaactttatgttaaggatgtgtgtctgagtatgctttggtatacccgtgcatgtgtgtcagcatgtatgtgttcgacataaattaccattatataaggaccaaataccaaattagaccactcatccacaataaaacagattggaatatcaactagatagaacatctaaagatactgtgtgacactgcaactggcttgttccgcctttttacacgcttgcagtattctctagctaacaaattggcctcatgttgatccatgcccaagagccatatgtcaacctgaatacaaaatgtacatgaattcatagatgtacatgaataatgcttttaaaaagttcgatataaaaactatacatgtcaggaaaaatatagaagcatattgagactactaatttactggatatggtggttgcagaatttattatacagacctgcacagtaacagtttagtgaaactgaacacgtgcatcatctaaacaagaaccaacacaaagctatgctatgccatagaaaatatagatcaaatatgcctcgcgcacaagaatctatgaggtccaaaatcaatgggaagcaagcaaggttggactagtctatgactccatatcaatataactacacttggtgacaaacagagatggtgacaaacaaacatcctaaggttcaggggcaacgctacattgtatgaaggtggtacgcatgcaccatggtaaatcaagattttgctagtaaataaactcatatctgtggcatgttacttcgaaattgcataaggttgatatatttctaaagagggaaaaaaaaccttctgaaataatatggtagcacactgaaaagaaaggtaaaatatatcagcagcagtgaattcttcaattagatctctcccacaacacctgtgggtaaacagaaatgaaacgacttgtacattcaaatgatccttcatttgatttgacgaccaaatttaaaggttgacaagtaacagtacacatttttacaaatgatccaaacaggaatatacctttttattatactcacagtggtttttcttgcaacatctatggcaagtggccaatattcatcagcaagccgacttatttcatctgacaaccacactatctctaccctatcaagggccataccagctgctttccacatctcaatattgtacaagccaatagtccgcatttcacttagattgccaccaatattacggttcatctgggcaatccagtctgccattaggattttaactttgtaaccagatttaaccatcttattaacagaaagagtcgttatgatcccctgcagcatgagaatagatcagtgcaaaactcagagtgaacatcgcattacaaacttgagcaatttgtcagtataattggcatgatggcatcatctcaaaataaaaatggttaaatgggtaatttaaaatagcaaatgaattggctgagtaccactcaaacaaaagttaatattttccacagcccattgacctacaacatcagcacaagaaccatccaccctgaaagcttattatcatcaggataaagggaacaacggtatattcacagttcactaaattacacttcgatccaaccgatatttatggtccagggaaatccctcctagctgtatttgaacaccttttgtttgcatgagattgatgatataacagtgtatgccaaaagatactccctccttcccaaaatataagcatttttggacttgtctccgagatgctactttgaccaacaatatctatataaaaataagatgttttaaatgatagtttgcttaatgataaatctagtaacatcaattttacatgattgatctttttaaattttttactattaatagtcaaaattaaaattgtttgacttgacactatactaaacatgcttatatttcgggacgggggggagtagtagagaatctagtactgatggcttcagcagtgcattggcaaaaagagcttgggaaatcattaagaaaaaaattgacaccctgagcaggaaagatttcactagaaagtggatttattaggtaaatcaaatcgtacatacaggtccaaattttccaaatagtgttcgagaaaagatatacaattcagtggtgtagcatgactgcatgaagccaaaccaagagggatccttaacccaataccattacatagttatacaagtgccaaattaacaaccccaccccccacacccaatcaaaaaaaaaaagaagaggaagagcttatactgttggaggaaattagagattgcgaacaaaggcgcggaagcaagtcatcttcttaagagcccctgcctgaatgtcgttagaaaaagactatcaagtagagtgctagatgcaagaacgtcgttaataacaggcatgtagcatcttcaccctacggtattgtcaggccactccaccctataatctttccgaatatttcactaataggaagacttaagaatgttctagaatcgttcagataatcctaagccatcacattttttcaatgaaacatgctagttcaactttactccctgaatccaagtgatgtaaaaaagcaaagttctttagttcttttaaattgcattgcaacccaaatgattgtacatttagtttttctttttccatctccaaagtccaaacttcaagttgttactgttgtgaggggttgtaaggcattgatgattgctccctgaaagataaaaccagtctaaaacatattcattcatgattcatcaaaattttaattttttgaaatccattacagactaaaagtgtattatcttcatcagactatcctcgttcttccttgggaggactacaatacagttgatgtggataattcattcatagaaatttaccagtttcagtatgcagaatttaaaaatgctaccacgaaaaatatattcgttcatatacctgggatatgcgcataaagggggtgggatcacaccaaacatagcaaacgggggcagatttcttctttagcagtaactcaagctcgctgtctttgacacggtcctccccaatgctctttagtgttgcgaacctctgatcaaaactcccctcaacagtatccctggatgtaaacaatcgtaacattacaaagcttgggtcaagattgaagttcagaagagcaaggttacctaatagagtcgacggcagaatcggctgaagtcatagtgttgacattatagcactgcttgctccagttttgttctgagattaagtccagccttggcggagctcctctgttagtagcaaaataatcaggttgcggtgagaaagatgtattttttttccttccccaatttcatcataacaactcatgagatttaacattcttttccgagcatgagtgagtttatctactccaaccacaccgaaaatcgatcccactcctagatgaaacaggcacggagatcttacccgctattattttgtaggtggggccgttcttcgcggaatatttccggttgtgccgacctgctgtggaggcgacgaagcagcgccggtaagtcggagcggcggcgcggcggcgtcgaggccggtgttcgcttccatgctttgcccacaaggccaaacgcccgcgctatcattgtctccgctccacacggtagcgccaaatcatggagcgtcaccgaccggctaatccggtcgcagcctcctccgccgccgccgacgccgccgccgccgtcgaactcccgccgtcgcctaggggtttcgttgggtcggggggcgggccgaactctcgttcgggtggtctctgttgctcggccgtacgctcgcctcggaagttgacaagcggcccatgtacggcccagggtgtgcgttcagccggcgaacgcatcttggcccattacctgctttttcctcacgtgcacgatatggagaaaaggtcggtaataaggtctcgtttgtcacatatctagctccaacttacctggagccggagttgtgccaaacagtctagatcctctgattttaggagcggagttggtagagctgctccacaaaattgtattacgagggtggagctgagtttttctgctccacagcttcactccacccaaaaaacccactaccctttaattttttagtgtatttacactaaaataccccttcctaccccatctcctcccgttctctctcctcctacgtcttcctcggtagacaccaacggcggtagcggcgggcgggtggcgtggcggcaagggccacaggcaacggtgggggtaggtgcacgggtggcagtggcgcggggtcgacgcacgtgcggtggcagccgcggcggcgggtggcgcatgggctgagcgggagcggcggctgcggtccacgagcagcgcacgggtggtggtcagctcacgagcagaccggcgccggcgggacgggcggcggcatcggcagtgcatgggctgagcagcagcagcgacacctatcaggtgtttaacaaaataccaacaagggacgtggtggagtggagctaaccatcaagccaaacactttctattccacttcaactcctataggagccagctctaactggagttggagtttagagtttggagctaaaccatcaatgctatagcttcttactgctggagtactacctgataaaatacagtgtgatagttgttacaaccgggtagtatgcttactactagcaataagttattaaaatacttctttttttgcttttgtatgcataacaatctcctcggataacatttaatgtgaaccccgctttacttaccaatttaggtattaaatattgtgatgtctgctagtaactattagagaaaatttcctatctagcataaaaaaaaattgctcttccctctatagcacccaaacttcaaaagttccctattgttctatattcaacacttccgttagttttaagggtgacggtgttaagtagcatgaggaaagacggttttgcccttctgtatttgaaacattttttccctttatctgttcacagtttttttgttctttatttttttcatttagtgtccagatgtctgtacatctttttttcattttgttcacagtttttttaccctttctacatctaaaaattttacagaaatttgacagcatgtctgcaacaacagcatgtttgcaacacaataatgaaccaaataaattttagagagcatccaaattcacatcctgggattagccggccgagcaggcctagggatggcctcctgtgccgccggcgctggccgtccgggggagcccgccggcgccaatggctgcccagggggtcgccatcctcgccgcccggctgattcgccgtcctcgccgccggccatgggggccgcccgggcgctggcctcccgtgccgccggcgctgccctcccatgccgcgacgggctggcttcccgtgccgccggcgatggccgtccaggggagcccgccggcgccaatggccgcccggggggtcgccatcctcgccgcatggctgattcgccgtcctcgccgcccagggggtcgccatccatgggggcggcggcaatgtagggttttgctgaaaagcgcgcgcgggttgggaaaaccaggtcgtggttgcgctctgtcccggagaaagagcgacgaaaaaaattcctgagggtgggtccatgcttgttttgacggtggaggctaacgggattaacggaagtgttagatagggaacaaaaattttgatggtgcatagatagggaacttttgaaagttgggtgctatagagggaagagcaatttttttttatgctagatagggaattttctctaactattattggttgatattgggattcatcttactattaagttgataaataaacatcgtggttacctttacccatggtggagggtgagatagggtagggaaaacggatggacaatttgttatttatttttgaaaaactacaatttggtatttgtgaagagtgcataatggcaaattctgaagaagtgtgcgacatgaaagaatgaaaccaattagtagtaacaaactttttgtgcatgtagcttttttccttatagaaaacgtagtggtataagtgcaattacctttaaggcatgaacacagatgttttaaaaaaaacatgaacacagaaccgtctcaaaggcagaagcctggctgaaagagcagtagaggctgtatggtgcacgacaatccgtttgccattctgcgtgtagtttgtacgagtcgccagacgatcccaacagggcaacgcaactggcgtgtctctatagtggacagaaacagggcattgctacattcctacactacgtgctaccctgtatagcagcacttgcccatctcattgatattatccctttttattatatataccattgagtttatcaatatttatacaatatgtcatcgggtcaagtctttttttaattttttttccaaaataaccttacaagcatacaagattgacaattgatttttgagaaaatcacgattttttgtgtagccttgttagacaacatagaagaattacaaatttgaaaactacacaaaataaattacaaacatatccttgatgccaaagtcattgatatcgagggcctattataaacaagtttttttttaaaaaataatatatgtttagtcgccagccaatcccaacaggtaatgcaacagccgtgcatgtctctgtagtggagagagaggacgatcaaaagcgctacattcctatactactcctaccccgtcttaaaaaaagattaatcctgggtataaatctggacacatattatgtgtgtttagatttctagctagacttatatttagattttttttttaatggatgctacgctgaataaatagccctttccgatctgagacccaacaccggccaccactatcgaaagatctcgatcgatctcaatccttatctgaagccacacggcatatcctactccactgtccacctcaatcgtcactcgacgacggcgacggcgaaatcaggaatttttactcccccgccacatatgctgatcaacgcaaataaatgaactaacgcctgattagtgcccaagtcaaaggtttccgttaagtttattacacggacccaattcatgcatgcgctgatcgctggtcgaccaaacgagtggaacgatcctcccgggcggctgtgatgactgatgagagatgtcgtcatggcgaggaaacgaacgacgcccatcgccaacttggcgaccactcgccccaccaacaccacacacccaagccagccatgatgcgaaacgagcgggacacccgctcacgctgtcgcctttgctggtgcaggagccaagcaccccattctccttggaccatcacccacgactgtgtttagttcacactgaagtttaaaaatttggttgaaactggtacgatgtaatagaaaaattgtgtgtgtatacaagatttgatgcgatgaaaaattaaaagttaaaaaaaatctttagaactaaacagggcccatgtttcgtttcccctcctctcgccatcggtgaatgatcccaagcgtgcgacgcccacggcgctgtctcgcgatctctctcacgcgtggatcacagcaccacgacggggcggttgcaaaaccgtagctagcctagctagccggccacaaaaacaaaaaattcggtcatattctctcgtgggtcgcatggtgcagtccagctcggaggcaaggtgatacatattcttctcttctcacccgggtcacactcgtgcgtgggtccaggtacactctctccacctttcgctttgttctttcctttgttaccactttctttcctctactagctgtgcctgtagtagtgtagtgtagtgtactgctgctgcaaagacatggcgaaagaacacgaacctaacggcgacgcttttttactcatcaaaaggcaggacaggcacatgtgaggtgatgctcctcccgctgtgcacacaactactgtgtgtctgtctacatctaatgcgccattgaaggggcgcatattgggcgccacttgtgctagtaccaggtaatgattatgtgtacacttgtatgtatatcatgggcgtcgctgtggccactaaaaacattctccagatgagacaaggactggtgatcttgatgaatcttgaggtgagagagagattgatagagacaaaacttacaggactcgagcaagaatgcctggacagtgtagccaacggaatatatatgctggataacagaagaatggagggaacctttcacagttgtgttggcaatggcacagcagatacatcatcacagtatggagtatggatcagtggatgatatgtggctccttacctctatcatgcatgagggcacataaaaacatgctttcctgcatatacgtctagttcaaggctacaacaagcacaattacaaccgagaaaacaagaaaaaaaaatgcaaacatcaactagtaacctatccccagacatctgaactcttttcttgcccttcttcagtttttccttcttccaacaattattcacatgccaatttcgtgtcgaaactgctcaaacaaatagcgaaagcctggaaggcagagagaggatagcggtagtccattgtgaacatatcccttgcaacttttccaaactgcagaataaccttttcggggtcggctggaccaggttgcgaaggagttggagcaccagcaggaggagggcttggtgcagcaaccagctggaaattcttcactgaggcaatggtgacacggccacggaagttcaggcaccagcactgtagctgctcatgccatctcgggggcttgttacggagcactaagggcctctccttgatttcaccattgtcatcaccacccattatagaaccactgatgtcagagaagcgagcactactgaaatccatggatgggtccatgatggacttagagaaggaggtggtgctccggaatgattgagagaaggaggtggtgctgcgaaatgagtcctccagagctcgaggtacaatttgctcaggctggccagggactatgccaccaggctccaccgaggaggcaggtatggagtgcatcatgcaacgcatccgtctaggacctcttgtgccaaggacatttagttcatagctcacctgagctatgttataagtaacagaaggaaccttcggagaaactttcgttgagttaaatctcttgctggtccttccgacgtgagggactacagccccattgtaagggggctgtgtgtcataaattataaattttgtgccaaggaaatttgacctggaaatgacagtgctagggtttatatattatgaaacaagcaaaatggaaaataaccatcttcaatgaacatgataattacctcaattttccaatattagttctgctcgaccttgagatgttgccagaaaccattgaaatagtgtactctgtgcaagttgttttacggtgtcttttagcggctaagacgaatttcccaccttccgcagtaacaactgcacaaagagaatgattcagcaaatttgattaactgaagtcagataatgcgggcacttggtcatttcataagaaaaataaatctcatggttgcaaggcctttgttttgcgggaaatgtggaacaatgactcaatcattcaaacattggaagttctttaagaatgaacaactttcccgtccttaggcatatgcacaaaaggaaagaaagataaagctaataagggatgcaaagtgcgggagagtaacataccgttgctaaggcacagatagagatggtaggtggattttgatctattcctctttatataacattgaatcataccatctcgaggaccaggctgaaaaaacacaaacaataatctatcaagctcaagcatgaaaaaagatagccactgctcatacttagaacctcactcaacaactttgatttaaaatttataaaactgaagggtgagaactaatctttcttatttacctgctttatagagaccggaaaggtaagtttcccacaaaactctgggctcaacacagtctctttacacatttccctccatgtcctacaaacagctgcaaagcagacgacattccttcgggatggccatgtactctcatcagcctccagtctccgtatgacctcacggaggagttcgggcggaagacttgcccagcggctctctgggattatagcaggtgagtcatcgagctcatccaatgagctctgagtcttccctttgtgatgcccagtaagtccataaagacttgcaagggtcacctcaaagctccttcttgacaagcttccaaaaccatcccggacatcgcgaactatgctacgaaacgacatctaaaccagccaatgccagataataaggcatacgatgccctacaaaatatgacctgccaattgcaaataggaaagagtggttaacaatccatttaactaaactttggtagaaaaatgagcaagagtttaccacacctcctttgaaaatggttagaaggttagatactgtacacatagaagcaaccgctactagcagtccctgcaaaaaacaaaagattcttgattagataacatgtgaagtatgtactagatgaatttgactggcacatgcttagaatgatataccgctaaatcaacctagaccttgtaacaaccaacaaccaagtacacctatcctagccagcagttaaaggggaataatcaagtccatcaccagcacatactttcctcctacgtatatacacaccaagcatcactttgggcacaagaaaactatgattcttttcaaattgaggaaattgctatcccaccactgaaattaacacggtttgccaaccacatgacacatccttctgcaactaaaataaagaactttccatggaagaggactgagcaacagaacattattacacatattaaaatcgcctgtagattgctgttgcatttcgaggtggaaatcttgcggtttacatgacaacccataccctagactaggaatataataaagatccattatttatctccaatttttttatagacaagttgataaatttgatatggtctacgcttagatacaggcctaactaaatacgcttcccttcgtcaactactgcaatgcgaccggcaaagaaaaacaagaactgtgacagagacagtgaaggaaggagaaaaagaaaacccgcaagttcacatttcctctcgaaatttctcctgaacaacaccatatctaccaaatcgcacccctacgatgtaccgatccggccagccaagaaggtcccgaaaacccagccctcctccaccgaggcagctactcaccgaacaaccataagccccagaaccgcaaacaaaccaagcccaaatcaggtaagccagacaagagcactcacattcggccgagtgggagccccgccgccgccgcctcaaacctgtccgctgcacagagctctcactctcacaaacccgaagtgcccgctcctctcgggcaaggcaactccacccggcaacgcggcggagggggagacgaggagttgcagtggtgggcgggcgcgagcgaagaacagcaagaggaagaagaagaagaagaagaagaagaagaaggcgaggagtagaggagaagagaggaaagggaaggcgggtgtggggaagaaggctacaggctcgggccgcttttgtttatccgcgctgcggtgcggtgcggtgcggtacggtggtgggggtgggtcaagctgaccgcgccttttccgttccgtcgggggactctctaacggcgttccgtcactccacgacacgtcaggtggcagcgcgtacttggccctgccttggcttggcttgccccggcgctcacgccaccaaaagcggtgggcctggtgcgacggacggacggatggatggggtggatgggtgggtggggggaatgtgtgcgtgcaacgtgcaccgttgaacagatgccaccggaacgcatcgccggaggggagttgaagtattgcaatttgcaaagttttttctctttgttcttaaaaaaaagttttttctcttcaaaacaggacagacacttagtgaaactttcatgtacgagttattctttaggggacaccaaggaggacttatataatgatttaactataagaacaagttggaattttaaaatggtttagttaaggactaagtagtagtagaacttgtatggacaaccatgaaactcaggtctgaccttgttgctaccgatagtagtaggagtacgtactttttttttagaacttaggagtacgtacttggattgcagttgttaatgacgatgtctttttaacagctggatggacttgataacagtatgatgtcatgagcagagtatgacacttcaataggaagattatccgatagcaaatgatcaggtgattagaaaatcttttatttaatgtaataaaacatttcaacctttacttaaagagttacaaccaattattagaaaattcacgaccatagaaaaccctaaaggaccgtgatgaattttagccgaccgttgaggacgcttttaactgcgtttcatgagggtcaattaattgtatgctcgagtatttcaacagtggtgctggtggttagcatccaagtacactttattctgtttttgcttgagttcattgtgttgatcgtaaaggcatgttgcatactcctaatataacggtctctacattttagcctgcgtagaggatcagctgatcacctaatcaaacggcaatcccttgtgcaattgattgttccatcatgatcctattttgagtattttcagtaggcacgctgtgtgacactcgacggcactttgggcgcaaagtagtgagtggcagttgctttcagcattgtatatatctagagaagtatagctaaaacactgcacagcatgtccagtactatagttatatacgcacaggccccagaaaagtacctacagcgacttggaaatcagaatctaaacgtacgcttaaagttgtgacaaagagaagcacacaatacgtcgccactatgccactactccatccaccaaacatttttcatatgcgaaaaaaagaaatccatttttttttctgatcgtaggggaatccaccaaacagcattgtacagtcgactcgtacgtatggcttgtgacttgtctataagagatagcagtacaatgtgcgcatattttctttttgctgacccttgaagtctgaattctgaacactgcactcaagagcgcagaaaaaacgagccggcctagctcactatacggccgtaacatgcgggtacacgttttgactagagaatacacacacggtgagatcgacaaaaattactgggactagcatagctgaggaaaaattggctttgggagcagtaaaaagtaaaaaagcctcccactttttcagtctccggcgaggcgacacgcgctctgttccggtattcttgcctctgaacctttgcagccagtcgatgcgcgggtgagtactccgtcagtgtagtttttttttttttaagaactcggtagtgtagtgtgaggagtgtttgaatggggtggatgggagaaaatactactagtaaaacatgtgaattatggtacgattatttaaatacttattattttaaacttaaaatttaaaatggtatggttatttaatcaatttttaatagaatttgtttggacgggagaagtacgacgtcggttgttcagttcagttcagccggagacagcgaggcggcaagtcgtcacgacacggcgccctcacggcgcgcgcggcgccatcgccgttagctcagcgggagagcacacgggcgcgcgcggccaggaagcttccggccggcgagcaggcctgccgcgcgcgtgcgctgcgttcagtgaccggagatgtcagtcactcactcaggtgaggggccagattagatttggatcaaatgagacggcagtttttaatgtcgcggcccggggcgaggttttggtggcgcgtttctgtcagtgatctgaacatcatggcataatgataaacaaggacaggcctatttaagccttaattcgccgtgtttctgaaaaggaaaaaaaaaacaacagaacttcaggtttcgagaaacagtggcgttgtgcgagacgtgccgtacagaaaaggatttggcgaccaaaggatctgatagattatcagatggttggatgaaatcatcggcttcgtcatttcaaccactacaccatgtaaacaattccatctgcttgcgtctgcgctaactaaaactccttcgaggtcgtcgcacgaatcaggccggggcagacgataagatggccgtacgcaattgccagcaatcctgatggaaattaaaacaggaaaagataaacgcaagcaactggtttatcatctcgatttctcttcattatcttctcttgtagagaatgtagttagtcaaacttcttgtttacaaacaaatgatttggttctggactgctgcagctaaaccctttgctcgtattgtcaaatcttgcagcttgtgtagcatatgctgtcagattaaaagatgcgttggtttcatgcttctgtacccttgcatacgacttttctgcttttaaccgatacgtttgtgtcaagatgaaaagaagaaggcgaaaggcagattgatgcccccatgcttctttttattcaacggcgagatccgtggaagccagggcacctccctactactactacttctacacagcagtataaacgtttgcagcataggcaccacatccacaagaacgtagagctcaccatctctttttctccctttttctgatggcgataaaaggttagacttttggagaagaagaacgaggcaatatataaaacacagagaaagaaaatgccaagaggggcaatacatatattcgtcaggtacaaccacctattcaggctgaggacatctgtgccgaccaaagcttacttttttttcatctgcactgcatcccaattgagtcactgagttgcctttcgcttttgtgaaagctgcgtggttgtaataagcgtcgtagatcatcatcagatggcgtttttcgaatactcaaatgcgtttcgtgtgcataagaaattgccactataacgtcgacgaaagcggtagttcgaattggattcgaacttcttcctatccatgccagcgtccagaacacaagacaacaaaagggtacgtgttactgagaggaggacaaaaggcggaggagggcggcaagatggcgtttcgtcacacataaaaacaaagatcattctaatattactatcagacatgcaaatcaaggataaatcatgtcacgtcaccctataaaatggaagaagcaaagaaggtaaacggaaatggaaggcattagtcatacgaactcctggcttttagacgaaaaggattatttgggtgccaacaaacttggaaatcgtaatgacatatcagttaataatacagctatgttatacttagtcctgttttatacaaacgaataaacgatcccttcatgaggcgttgcttttggaattttgaccgagataggagatttcacgaaaaaaatattttcaaggcctgagcaattttcagaaaattaattgtagatttatagaatttacataggagctaagcctctctctacttgttggcttaagccacaacaacataattaaatattaaaacttaatattagagttgattctaggtttttatttaatcgtaatctattttccagtctttaaatcttaacttttaaaagctatcacagataaataatttacctagaaattaatttgggttgttttgttctttttcccggttaccaggtactctgtctatcccatttaaaaagaatatagtaatacgtatggtatgttacatcctatatttttttttgggggcaattgtaaatttaccgctactttaaatcgttattacaaaactgccactaaaaaattacaaaaataccactagaactgtcatttgagtggcatccttacaatattgaaaaaaccggtgacaaatttgcaaatgccccatattttttgattttgctatatatttgtcgacaaattttttcccaaaaatttgacagatgtaattacagtacaatcgtagtgtaattacactgtaacttgtatgtaattacactgtaactatagtgtaacttgtatgtaactttcaaaaatctctccgtaacatgttattttggtaaaatggaggtcgtgggaacaaattctttcacatatgtgtgtgctataatttgttttcttcctcaccaaaacaaatcttgtaatagatctaacgattcaaaattatgtgaaacttacatataagttacattgtagttacatgtaagttacagtgtaattacactacgattatactataattacatctgtcaaatttttgaagaaaaatttgtcgacaaacatataggtagtcccgatatttttttatgggacagaacagccgaaacatctaaaatttacaatcagcagaaagctgaatcgtgctatcctggcccacctaattaggccacacaagtctgaaagggtccactttgactcccttaaaagtaacctgaatctaatccgtgaccctcaaccgcaaaactggatagaacgacttcccaaactattgaaaccggtgcaatttgacttccttaacggttttggatggtggtttcactgacgtggtgcttacgtggcggtgttgatctagtctggtcttgatgtggcgcttaggtggcatttaattaaaaacatatatgtgggacccatttgtcaaaaaaaaaagtggggcccactgacatgtcatcctctctctttcttcttcctccccctctttctcccttctctctttctctccccttccaccgtccacggggagcacggctggagcggcggcagggcgggggccgaagtgctggcggtcggcgggagctgaagcggcggcaggtaggagctaacgcgggtggtggcggaggagaaggaggcggcgacaagaggggcttgagtggcggcggcggtggaaaccgccccacgccacagacctccaacgaggcagctgcggctgcggctgcctctgactagcgcgctggattattcccagcctccgtcagctccagcccacttccgccaccgctccagctagctcccgtgtcagctcccgccggccgtcaccactctggctctcgacggcggggaggagcctcgacgacgggaacaggtcagcgacgccgaacctaatcgccttcttctgcgcctcgcccagcgtctccaggaactcctcacgccaccggaagccgcactccccatgatggcgcgcagcgtcaagtcggtcagcgtcccgatgatctgcctgctcacgttcagtgccggcagcggcggcgatggcgccaacgagcacacccgccaaagagtatcctcaccgtggtgccgatggagtccctcactgtacgcccagccatagaggtcgaagcccttgggctaggcgccaggagaaggccgagctccatcctcgcctttggccatgatggtatgcatgtagcgatgcctgccttgggatgaaggcgaggcatatcatcaccttctcgacatgatttttgatgagcaggaagtaatcgagctatacagctatacacatcctcttgcttgctcgccttctcctatgctgctacattggtgtgtttgttgtactgctgctcgactctgccgaggctgacccgtggagcattgtgggggttggccggattgccgggctgggttcgtggactgcatcctcggagaccgccgccatcacgcatgcggatacgccgaggtcaaggtcgatggcgatggggaagctggcgcccgcccgctgctaccgcgtcagccatcgccgccgccgccgccgccactccggctcccgcttgccgtcgccgcccttgcatgcagattacgctacgagagagaaggtgaagagaaatgggggagataaagagagagaacgtggagagagggagggggaaggagagagtgaatgacatgtaggcccacatgtcagtggggcccacaatattttttatgtgtgaatcacatgtgggtccatagattttttttaattctaatatcacgtgggacgaaaactaggtcaacatcgccacgtcagcgccacatcagcaaaaccaccctccaaaaccaccaagggagtcaaattgcactggtttcaatagtttagggagtcgttctatccggttttgcggttgagagacatatattagattcgggttacttttaagggagtcaaagtgaacttattccagtctgaaagtagggatctgaaagtctcaatttgtgcaaattaggcctattaataaagcccattgggcttccaggcgattgtcgcgtgggcgccgcaaccgagacacagcaaaaggccttaaggccgcatctcaccaccaggaaaaaacgcgagcgcatctgaagccgaagcgacaccagcggtgttagcctacccgcagcttggcgagttcagttgggtaagctagggtttaggtctcggcgcgcggcggaggggaggaggaggcgatggcggcggcggcggcggcagcggcggctgaggaggagatcgcggtgaaggagccgctggatctgatcaggctcagcctcgacgagcgcatctacgtcaagctcaggtccgaccgcgagctccgcggcaagctccatgtatgtaaacgctcctgcttctcctcctattgtttgttcttcgaatttcgtgctttgcttgtggttggcccttctctgtggaggggaaatacggggaatactctactgttgggaacctgattttgctggcttggtgtgacctgctctcttgtagttacagatgtaaggcgacgactcgctttgtatggggattttggtttgtctggttgataccacggtgataatcctaactagttgtggcaatctatgagccatgtattcatgcggaacaaaattacagtgcctctgtaaaaaaaaaattgtgaggaaggataataagcactcccgtagttgacattgtgtgggaatttgtcgaaattgtgtgtgaactattcaggatagtgggggtagcagtcgagcaggagatgattccaggctttacgtgactctcactttaataaccccttagcatcatggtgaggttgtgcaaatttgtttagattctcatgttggatgtgaatagcaatgctgtatgctgataaaattttcaattgtacattgccttgcaatgtctttggttcatgatactctcaccctttctagtgcatctgtacaatttattctgcattgttgagagctgagatccatattataacataatatggctgggagttgggatggctgttgctgagatgtctttcttgtacctctttatccaggcatacgatcaacatttaaacatgattcttggagatgttgaggagatcgtgacaacagttgagattgacgatgagacatatgaagaaattgtgcgcgtaagtgttttgaccttttgttgcaaattttgtgatcagtacttttgaaagtcatgctataattgttttggttaaccctgaccattgattgatgatggaatatcaatgtggataatatgtttgctttaacccatgcacatgagttgtttggctgccaccttgtgcgtgccactacacatctatattgttgtgcacatttttttctcaaagtacctatggtgcttagactgctgggcatatagtgcttaactgctggtttagtgtaacataattgcggttacatactttttattgggaataatctgatgctttgggacatatttcttactgctatattctgaaatttctggtgaacatgttgatgctgtactaactattgctaaatcgtgtctttttccagaccacaaaacgcactatccccttcctttttgttcgaggtgatggtgtcattttggtttctccacccctccgaacggcatgaagtatgaaggaagctcctgccgattgtcaaccatgagtaatgtgtattttttaatcaatggcatgtgttatgtgctgaagtgctactatttctgatggattctagttttagcatatgatacaattgtgtaacaatttctgatcgaggtgctagtttctactgtcatgttgaatcaaccttttgttaccagattaatcaactcaatcccgaagcactaatatttgttgtggtgatgtcttgcgtaatttttgtagatccacatgccaagaacaccctgttccaatctctattaaaaaagagccagcaagttgtaacatttttacagcgtatatgattcacatcacaacacccagccaaacagggaacgtatcaccgtcccaagacttatcacagccaaacagccaaacagccacacggcagcggtgtctccagggcttgcagaaaagacacattttacatgatcatttcattagctacaaaaagagatctataaactattcactgaccagcaaagtcaatcttcattccagccatgcttgaattcgccccaaatcctcacgcccggtcatgaaattgtatccatctaaagttctaaacagcaagccaacaacacaaaaagttcgacacaaagtattagccaaaaatattcgaatttcttcgggaaacatgaatggatttaactaaatttcaccacatagaaaagaatgaatttagcgaaaattcaccaccatagaaaagagaatgcccgggatcaaaccgaagattcgattcccaatccagcggagagattgggaagaacaaaaaaccttttcatgattcccaatccacatcaagtaggaatatttctggtaactgaaagaggtcaaataaaggagagggtgaaacggccggcgccatcccaagtcgtcttcctccttcgctcaacccgcagaagaacacagattcgaagaggcagaggcggcgaagagacgcgcgagccatgggcgtcaccaaggaggatgtcgaggccgccatcacctcctccctcagcccttccagcctcgtgagtctctcttccctaaaccctcgccgcttatccatcatccttttgccgttctaaaccctaactgccgcttctgctttggttccacggtttcaggtggtgacggatacttccggcgggtaattcctcacccccaaactccaattgttcttcacctttgtataggagtatttaatttgcttgcttccattgttacgaacgaaagagaagagatcttgtgtttggtgactggttgatcgattggtgtgaaggtgcggcgcgagctacgagattgaggtggtgtcggagaagttcgaggggaagcggctgctggagcggcaccggatggtgaacaccgcgctggcgccgcacatggcggagatccacgccgtctccatcaagaaggcgctcacccctgctcaggcgcagccccagccggagccggccgccgataaggcgccccaggcttaagtagttcttgaactcacacctccaaactgttcgatcacatatgcaccacgagtgaaccgatgcacttggtgtagcgtttgtcatgggtgtttgagatgtgcgtcagctctctctgcttgaataatgtgcatacaatggcagaattggaatgatactatgcttgactgcttagaaatttcagtaactttgcgtgcttcccgcgtcatgtgcttggcagttgatcctatttcacaattttgccaataaattgccgtctagataatgatcctatttcgcaactttgccgataaattgtcatctagttaatatttagtcctaggacttggattgttttcccctcgaactaggttgtttgattgtagagataaagtgcagttgcttcatgattgatctagtattgtttattgctgctactataagttgactggctcacagcctgacatagttgctagtatctactaggggttctataatgccacattgttttacttgagcatttagtctctgtatttttggtgaagccgacaaatattaagaataaactattctcactgcttgctggaccaataaaactggatatgatcatacaattgtgtttggtgctaggtgtatgatggcttttagtttatgtgataagtagttctcagctagtttggggacaataaagtggtaactagtttaaaatcatatcgttgtgttgtaagtgcatttgctgcttgcactattaatttcttggagatctgcatgcatgctgacatctgatagaaaatgaaccacttcccttcagcatttgctttgcttctttggtctgtgttggtttcgacttcctttaaagtgaattctatcagaaggcctgtaaaaatgatttttataggttgatgtgttgatactagagatgttcttcactgagatgtttctgtcagaatgctcattgaactgttagatacttctcttagttttggaattggtttcacaattgtttgaaagcttgaagcaataatcaacacagtagatccaaataggcgaaactggtaatgtcagttgggttaatgtgagtccacatgtctctatgttttctgaattcagaagcttatgttcattccttttttttttttggaactgaacttatgttcatcctttgcaacaacttgtagagtgtatgtacggcacctacttgtacatgtgttgtttcaaatgattcgaaactgaaaactttttctagtgtaattctgacttaaaattaattatattttcccctgttctgtttgagcattatatgctatctgtagctttgatgcaaaattccatatggaggctgtcaatctgctctgttcgttaggtttgtacgatccttggtgcttaggacagcatttttttttcgtagacgggttcatctgaaccatatttactgaatggtgtccataaaagaagtccttttttttctttttcgagggaacaacactgatcaccgatcaagtgaacagtataatgcatagtatttgtatttttatagagatgtttaatggcccttacttctggcgacacatatggaggctgcctctatacaaacagtaaaccgaactgtacggcaacactgtttgttctctactgtagcgatctatcttagttcattcgctgcaaatccgacgcctgaaaataccccaaagtcacagatacagtacacctcctaacttcaccgtggatcccaatcccacgccacatcccacgccagcacaggagcgtgagcggttgcagcgagagccgctcgcgtcacttccccgtccatggacggtgctccaagttatggaccaccccgtgcagcatcttcccaaaacgcaccgaccggcacaatattaaccgtgcaaagagccagaatttggccacgaagcgagcaatctcaagtgtggccgggttccgcctcccgcgtcgccagttgtcgatcaggcgcaacggcaacggcaaaggcaaagcagtcgcctccaagaaaaagtccgcatgaactcgcaagaagcgtcggcccgtgcgggggctacgtggtacgtaccgcctccccccgcgacggcatatatgcggtgggtgcgcgcaaacacaacacacgccgagagcccgcgacacggaagacgggagtacggtacgttcgtgtacacccccacacgtaacacgcgtgcgaaatgagcgagccgtacgaaggcgagggggcgaacccgaagcggccggcgccgcggctgaacgagaggatcctctcgtcgctgtcgcggaggtccgtcgccgcgcacccctggcacgacctcgacaccggtgagctcactgagcttttgctctctctctctctctctctctctctctccttctctcacaaacatgcgcccccgcgccgatgaagatcatggcccgccggcctatctgccgatgctaacaccgtggggttttctctgtatttgcaggcgctgacgctccggctgtgttcaacgttgtaagcgccctcgccacatgccacgccacaagggattcttcccttggatttacactcacttgactaacgatgcgtttcttcttggttttgcgtggataggttgtggagatctccaagggaagcaaggtgaagtacgagctcgacaagaaaacggggttcatcatggtctgtaatcaaacactgtatttatacactcacgtcagggaccatatgctctgtggaacttttttaccatttgggctcttgttgtacaggttgatcgggtcttgtactcgtcagtggtttacccccacaactacggcttcatccctcgaacgctctgcgaagacaacgatccaatggatgttctagtgctcatgcaggtgatcatccttcaactgtatatgctgatgctgttataaattgtgcgataatcactgcaacacatgtccaaacgtttaattgcaggagccagtgattcccggctgctttctccgagctagggccatcggactcatgcccatgatcgatcaggtcggttctaccccgcatccattttcaatacaaattcatcgtcaaccgcgactccagcttgaccgattggagctaaatcttcaatgagacagggagagaaggacgacaagatcatagccgtctgcgtggacgatcctgagtaccgccactacaacgatctcagtgagctttcgcctcatcgcgtccaggaaatccggcgtttctttgaagactgtatgttcctactagttctcaaatcgctgcactgaccaatgttttattcttcttcagctaactctgtagtttctgaacttattcagacaagaagaatgaaaacaaggaggtcgccgtgaatgaggtactgcctgtgaccgctgctcgggatgccatccagtattccatgtaagtgatgaactgtccatcagttcagattttagaacgatatattgagtagtttacagtttacacgtgtaacagcaagatgacatctttgcaagtttgcagggatctgtatgctcagtacattgagcacttggggcagtagaccagtagtataacaccagaacaatccttcaccgccattgatcatgtgtttaatagaagtgccaaactaccttgaggtactaaaattttagtgtaaaattttgatacccgcaccgcaggtacactttctgaaggaccgtaaaatatctactcaaaaggggtacccaaaactgaaaaaatattttgccaggaagacaggaagcacaggtttgccttagtgacttgttgtattagtgctttagctgctagagatgcacggtgtatgtattttgtaaataatagtagaaaaggccttagttgctcatgaagctgttccaggcctcaacactattacactgaattttacaaacgtacagtaagacgaataaaagaagtgcctgacgaatcatgcatgttacagtaaggccagggagtccattcgcacgccttgatggtgccagatcgatcaaaccgagcttacttcgcctgtgcagcgtacaaccctttgatctcctccacatcttcgaagcttccaagaaatattggggatctctcgtgaatcttggtaggaacgaggtcaagagcctgcattgccaatgtagcaacaagtttgaacaatgtatcaggattcaagaactcaagatgctaatactaaacatgcatgctgttttaatcaagatgaaatgaatgaagaaataagtacccgttctttgcctgtgaaagactggcctccagcctgctccatcaggaatgacatggggaaaacttcatacagaacactgtaattccaagatttggtgaattcagaattgtttatcaatatgaaattggaagtaccataagcgaagtgagatgccgagagtaggcttaatgtgtaccggagttttccatttgggctcttcttgtctgcagggtacaaaaatactcctccatatagcaacgtacggtggacatcagcaaccatactgcaaatcatcaggaagcaatactgtcactacaatgttaattggtggtgattacatcctattagaaacttttatgaatcacaacagagggtcaaaaaagctcctattaataactacagctaggttatatacattgtcacccaaaaaaaatgatcaccttccaatgtatctcaaggatttaggtgatgaaccatccttagggaacttgcacttctccacaaacctgtaaatgattgttgtagattttagctcaggttcttcaggaagtacactattctgaaaacataagtagcgcgtactttgcggtaggctcgtcccaatttttcgcattcccttcattcactgaataaatcttccctttctttggtatctgcacagagtgaagcatagaacacacatatgagtattttgcccgctcatcagtgtacattaaaagacggaagtatcactactaattgtctcataaacagttagtcaaaaaaaattgtcttataaaccttgatgtctggatgagttaatatgaactccccgagagatggatcaagtgtgaagccattgacaccatttccagtactcagaacaagctgcatcaaattagttacacaggttatattcaggtgagaattatgacatttatagagtaggatggattaggaggtcgattaccgtgcaggaactgccgtacatgcagtatccagcagcaaccatgttttttccaggctgtaacacgtcctcaagagtcacattctccttatctttgatcatgtagatcccaaagatctataaaacaagagaaagaacatgtagtacaggaatccattaaaggtccttctgacgaatcgaatcgagtattgttcgaagacaattcaagttgaccctagagtctagaatccgttaaaagttaagacttgctatcaacttttcactgtcacactcacacaacaccttgctgctgaaattttcagtttttgaaagcagtactcgtgtcctcagaaaagcatgctagcagtaattcacaactgatggaggaatagtatttttcatatgttgctttggccaaaagttctccctttttcacgtcaccatcctagaaggatgccaaaactgcaaattgaacagcgacttgccgttcttccgagttgtcagtgttatcttttcggtttggtggtttcatgtgtacgcaccgttccgatggagacgccacagtcgatgttggaggagccgtcgagtggatcaaagcacacgcaatacctgtaaaaaaaaccggcaccatgcatgtattttgtcaggaaaaacagaacaacagattgctcgaatcaagaagcagagaggtcgcgtttctgatccgaagctacgcacttcccacgcagcgcagggtccacgaacgtcgcttcctcgtcctcctcggagacaagaacgcactgcacgcgatcgcagtgaaaaaccataaatattgagaacactctgagcaaagaaatggtttaaggggagaagagagtgagttcgtacggtgcggccgctgctgacgagagccttgacgaacacctcgttggacagcacgtccagcttcttctgctcctctccctggtcacaccaagcaagtcctcagtcctcactatctcaatctcagagacaagaaactgagaaagatgacagttattgccaggtacacttgcctgaacgttggtctcgccggccagcccgatgagcttggcgagcccggcctgcatgcacaacccgagaagttttgttcagcgtgccaatcagtagagtgagaaccgagagatccgtacgcctaacgatgaaacaacgggaggattcgtgtgaccttgttgacggcggaggcgacgaacttgcagccaagcacgatgtgggagaggaggatggtgaggtcgccgcgtgcctccgggttgcggctctgctcgttcagcacgtaccgcgtgatcgtcatcaggtccgtccggtacgcgtccgcctcgtgatccatctccgcaccactctcctcagctaccgcgccgcgcgctgttcttctcgtctgcttactctgcctcgcgctcttcccttcgcttcgcctcgcctcactctccggctgctcgggtcggctaaaaagcgcgcggtttaagtgttgagtattggtcacacggcgcgggaactgacccggtgaggtgacgtgacgcgggcgcggtgtacgtattgggcgttttttttaggggttttgggaggtagcgaggggagaaagtgaggctgggagccgaggggcgaggagctccaacggaatcggcgcggaggcctatcccctctatccgcgatggctggtagcgcggtgaccgtgtgcgtttgtggtcgtcgcgtttcgccccccaggtgatcgaggcccgagctaagtcgagctactagaggcgagcacggctttgtcctgtaccgccacgtactacggcaacgcagcaagctagcgggggtgtagttgttgttgagcagaggcgccgacgccgacgccgacgtggatggtgcgagattatgaccaagtacgtcgtgttaagctgtgcgcccgatgtgacggcgaaacggttaaccggagagggggtctcgcaaatgggctccaagcctccaactctccaaggtagaagttgtttgcctttaatggcctagcatttacgcgtggaatatggcaccgggttcgacttcgagtgagagctacagggcgggagggggactcgcaggcgactggacgctttaccttcacgctaggctgctcgagcttccggtcagctcggggaagagctgctttaccatggcagtgtttagttttcccctatttctgactttccatcacatcataatacaccaaaaactttactatacataaacttttaactttttttccaaattcccaattttcttcaaacatccaacttttgttagaaataaaacacaccccatttgacttatcctactggattcgtctgcctttcgtatttagtggttcagtgaatagattcatacttttgacaagcatatgcgacggataatccgagtaaaaagtcctgctcatttattgtccgttgaggtaaagcgatggtatatgcaactcagaaagaacttgaaccgaggatttcacacggggctggtcatgaactcatgatcaactcgacatggtacgcaactactatatgcctattaccggcaatgtaatcgagtgtacctttaaaatactgtagtcatagtagagacatcaaataccaatcatatcaataacataaattacgagtagcaaacagagcgtgtactccaacatgctttgagaattcaacaatctatccagtggaaacaagatgttggcgattgctggcgggacatgcagttcaatgaatgtgttagttgctctggaacataaaccctggaaggttccttcatcaccaaagaataatagttttgacagttttactttggcacgattcacggcaattgatcttactgtagaactaaacagtatcggtcggcttctgaaaagggggcaaaaaagtgtggtaagaagtcatacatatggtgaaatttattttacgggaacggacctaaatgaaactagtaaatacagaaaaagtgggttcttatgtccataagcaaaattaacctggagtcttcatcttaaggacaggaaagtccaaacttcagagtatagtacagcattggtttgttttctttgcctgcttgtagaacatctggaagaaaagaaaaacaatatccctcaacaaaattctggagacaaacggtaatcaagataaaacttaacaaacaaaaaatgtaagttaaaaagggtccagcgattctacaactgaaatagacgaatgacagcctagacaaacaggggcttaaggttctatcatattttgctcccgtcacataataaacagactagaattatcataggctacagccaaaaacctggcataagtatagctgtgccataaccaacagattcatatatactatttacataatcaaggatttgcttatacaatatttccatggttggcaatttcttcataatagaaaagaaaaccccactaattcaacagacatatgcgcgtgaaaaatatgtgtagtcctaaacaaatgtacttgaggaatcacagtgagaacaaaaagtaagaagcactcatcaagtaaaaaagcaaacatgaaaacacatgattacctgtgaagcagcactcaggtctgaactcttctcaaccaagctatccaatctttcccctctttggagcacactctcaatagttttatgctgttcaaatattaaaacataaacaatgcacatcagcaagcagttttacccatatgaaaaataagttatgagatatcaattcataacagtagataatatgaattcaagtcaatatcgtaagctccagcacaagatcgggtcattgagtttgttagaacaagaagtgttggtatttaccaatatgaatggcagagctattctataatttttttttctggtaagaaatacttactaggataatttttgtttcatccaagtccctctggattttcattaacttgtcagcctctgcagggtcctacaaaataatgaaatcaagttatctcataagaaaacattcatgcaggatgcagtgcgtgtttaagtactggcagtttggaccaacaaggacaagaagaaaatcacaaacaaaagcagttgtcttaataagtcgaaagcatataatatgttcagacaccaaccaaaagcagcaaataacttatcatatggctaatggacatttctcttttcatccaagaacaagcatagcatatttcaattgagatgatggaagaatacattgtaaaacaaatgaacttcttcagttacacttttctttgtttattgtaaggttcggttgtcctccataaaggagatggtaaaatatcccctgaccccaggtcaatagtgtgtaacaatatttgtagaacatttccattacctctgatcaatgaaaccataaacagattgtatttttgttcatggaaagctttacctgaaactttgtcaaagcatctgtcaagaaaggccactgttgggcagcatctgttgcatcttttgtagcagctttccaagagtccccgaaagccttctggtattcgtcaagtaccttcataaaatgaattctatcaataactggataattaggataattcttaactactgatgtgttgcatcatgaaacttactctagcagatcaaagggtcatggatcattaataaattatctaatcacgtattcacatgtatgtagatgtatgaaagatgacgtagagtggttgcatgaaataaatagaactgaactactcattgactaaaacattgattcaggtgtatacttgttatcaggactcaggagtttcggaatgatatagtgtgccaggtttcagcctcgaagatccattatatagctaggtgaatgaaaaggagttcctagatagaagggtaagcttcaaagtatccgaacacaacaagatgtatgttctgttcaacatagaaccaggccatagaaaattgtacataggttgtttctattaattttcaacaaaccactgcagaaacatattgaacagaagtgaagaaaaaggactgctaatgttgggtgaaataagatgcatcagcttagcatcacccttgtatgcacaacataattttttgtgcctgttcagaagatcaaatgttttatcccactgagaatagcaaggagacaatcccttattgcttgtgaatctgatcctaggtcaaatacaaggatatgcaatacaggaatgtcaagaacaaaggctcataccttattcagaagagaaaatgcacttcgtacaggatagtgatcatccataaatgcaactgcgcaaagaccattcctgttgtgtgagtggaccttgtattctgcaaatatcaggacaacttgtttacatgaccgttcattaacaacagcaaactgaattctcctgatcactagaccgaaaatgaacatcgactgcagattgcacaaacaattgcatcataactcgtcataaacgttggaatcaggtcccatattttcaccagatatccttacgacgaacacaaggtcactcttttcaacgaaatccaacagcgcatcagattgaactaacaggcaacactgcctatccacaaacgagttccatgttgaaacaaacccaacagcgcatcagattgtgaactaacaggcaacactacctatccacaaacaagcaaatagttcccatgaagcccaacaccgtatcagattgaactaacaggcaacgctacctactccatccacaagcaagctaatactgtagttccacagcccgctgatgttccaactatgttggactactatcggatcagcggtaaaagtctatatcccacataatccaagtccatgtgaagaccggatctgagcatcgggtcagaaagcaagcaaaccctaagtgcggaggcagatctgaggaggacgatgggttgtttaccttcgtgctggacggactggcgctggcctggctgggtgcgctgggcgacggtgcgcgcgacgaagacgatgaactcccgcgcggcgccccgctggaagaacccgaagtggctcacgtccgtcgcgttcgccagcaccaccgcctcggggccgcccgacccgccgccgccgccggacgaggatgctcccccgccggaggacgacggcttcagcacgaggagcgccgtgatcttcatctccgctggtgggcgcgagatctgcggcgccgccgatctcgcagcagccgcccgctcctgccgcgtcgatgcgtggatttggcttggggggcggcgatcgtagagaatagggtacgaaaaagaagcttcccttcccttctaatgctgggattcggtcgcacccccactaaccacaacgcgcacgagaataacaacactcccaggactgagtgaatgacagtgggcccggccttgtcagacacacggacgcctttgcatttggagcaaaatgcacaaaaggaaagcggccaattcaaatgaatttcgaaggaaatttcctaataaaaaggaaaactaaaaacgtaacaagaacatcatcagccatgccagaagcaaaaactccaggagaattttcggatttggtgataagtagaattcttcacttccatttcattccaacaccatgggatcacataagagtaaga

SEQ ID NO: 5559 - DNA, 762 bp, Oryza sativa
ggggtgtcacgcggatcgtggttcggttttcctgtgctgtgattggctggctcgttcggtgcatggattctgggacccagcagttgtcacttgcgttcagcgaaatgttgggcccgaaagcgtaattggcctggactgggccgtacctaggcggcgttgttaatgcgcacacaaatcattttttacggtatttttggtttaccagaggttaaaatgtgcattttcacccccaaacagcgaggtgatactatcctcgcatacgtgccttcgctcagggagcttaaacaagctactcagtcccaagggggaaagcataacatccaaaacactacaagtcgttcaaatacaaataaacctttactacgtacacaaaaataagttatcttcaagagagaaaacaaaactagaggtacaatcattaagacccgcaattcggctagtagaaaattcgaaacaaaaagctttcaaactgcacgggcaaacatccttgttgcccggtgaaacccaacacaacaatccattgcatacattaggaatgccctgatgcgatgccattgtctgaaaaaactgaccgactcagacgacctacactgcacactacctggacagatttcttccagtacaccaattgacttcaccttcccaattgccccatggccaacagccctaaggggctactgaaaccatgggacccatgcaaacaatctgcaaatcacgtttcaatcacttgataatggtacaaatttgcccacaaacttaaaa

SEQ ID NO: 5560 - DNA, 2259 bp, Oryza sativa
tcaagtcggtgacctcggaggaaattgtttagcgcggctccgacttcagctttattttttaaaaaaatacattaccaacgtgggtgtagtttatttaaaaagttttagctttacctaaaataaaaataaactggctaaaacactatcataaaataaactcgaaatagagttgtatttggcacaggttcaaataaaaaaataatataaacatatattcttagctctcgaaatttatgaatttaaatttgtaattacagtgatagtgtttgaatgttgttcctattttattaaatatatattttaaaatcactatatttaatttctaaactctaaaattagttagtattaggatttgagatccagaggtgtacgatcgagcactaaattaacaaaaattaacgaagtggacaagcactactcccagaagtctaccacagtaccactacggtgaggatatagatgtagaaccgacaagctgtgtgtgacgtagttctacggtgctagcataggtacacacgtatctctatgtccaagaatcagttcatcacgtaattgctagatctacctaccatgtttcatgtcatcatgtgcgacgcgatattgaagcatgagattccacgagatttaggccctctttgcatcatgtcaaatcgaacatttgaacacctatataaagtattgaatataggctaaacaaataattaattacagtgtttggatcaaagactaaattttagtccctgtcacatcagatatttgatactaagtagaaatattaaacgtagactaatgacaaaactcattccataaccctagactaattcgcgagacgaatctattgagcctaactaattcatgattagcctatataatactacagtaaacatgtgcaaattatagattaattaaacttaaaaattttgtatcgcgaattagcttttatttatgcaattagttttattattagtctataaaatagtgtgcaaaatagaagcggcgtcattatgcatttatgcataaattgtggtacttctcttgctttattgtactttatgcacggattttattttgcataatttgcaaaagaaaaccaaaacttttattgctggaaaatacaaccaatacttattatagaaaagtattccacctccggacttccgcgagtcttagaaaataaagaaacaaatccccaactgccattaagtaataaaaacaattgaaagctaaaactaccacataggttttaacaattaagcccatatacgttacgccgtccataacgaaacaaagttcctctcgtaaccaatttcaagggtgtagcaccgttacatataatatcatgtttcttatgtgatagcatcataaatcaataatggatccagctttaacacatgaagacaacctacgtggggattgatattttttgataatttttttttgttatcagatactttatcattttggcaacgctaaatttactaacatggtgtactgacccaaaataaaaccattttttcgtagaactagacactctcctaagccaaccaccaaaaatatttctaccattttgaggagagggatttaaagcaaagaaaacacatagtcatgcaaaggatcctcttacgaagagagagaaactaccacttctatgtaatgaccgtacaaaacaaacttttttatttgatagtgtaaccacgatcaattattgacaagtaatttagatccaacaatcgcttaccttaacgagatattaagcgagttgttactggacgtgaattcaccgttccaaatccgatgaaatcaatgattgtctttcccgcatactgaggaaactgaaagacgcgaggatagttccctcaaaaaaaaaaaaagacgcgaggataaagcagagcggagctggccgtacctaaaaggctaaaaccaccgttcccgttcgcacacagtttgctgcagcacatagtttccgtctctgcttacgatgattatacttccaaatttcaccaatacaaaaacgtgaatctttgaaagattttacacgtgattacgtgagccgcaccagcgtccaacaagtgatgaatcatcatcatatcggatgatcattgactcgtgccgatgcacgtagagttagctgtacaccttataaaaaagtgatttaagccatgcagggtttggttggtgtggagttgcgaactgccttttctccaagttgtagcaatgtggagtacttcgttgtggataaagtcgtaatggatagtgttg

SEQ ID NO: 5561 - DNA, 4939 bp, Oryza sativa
  unsure (1)..(4939): unsure at all n locations
aaacaaattaaagggggtgcaccactcaaccgtacatgtagtggcacatagaattttcaagccatggtatgcaaagcgtatgatggaaatatgattaaaaattcctactcagtattgtaagtattgtaagacacatcgaaccattgaataagggtgtgtttttgtgaggagaggaaagtagaagaaagcgtatgattaattaaatattaattattttaaacttggaaaatgaattaatatgatttttaaagtaacttttctatagaagatctttacaaaaacacacggctgggaaagtatgtgcgcaaaaaacaagaggtttttctccatgcttcaaaccaacgcaccctaaaactggtggagtatgagtactacatattagaatgtgatccaattcaaaagtcagatagctagtgccataacttctcaaattgaaattttagtacttaggataaatatacaattactccactttcctaaatcccaatgtaaatcataaactagtatcttaaatagaaaagttactttaaaaatcatattaattcattttccaagtttaaaataattaatatttaattaatcatacgctttcttctactttcctctcctcacaaaaacacacccttattcaatggttcgatgtgtcttacaatactgagtatctcttttgttatggctcccttgattttatatttttaagtaggaatttttaatcacatttccatcatacgctttttataccatggcttgaaaattctaggtaccaccacacgtacagttgagtggtgcacccctggcttcgccactggctgtgcgtttggttgggcaagggcaacatgtagagcaaacatgtcgaaacaacgagatcgtagagtaccagtgtctccggtcaatggattgtttggcaatgaacttgcgtcatgaaaacgaactattctagattttgattcactgtccagactccaaacgtcgattttgacgtgcacgaccttttgacacgagctcatgactaaccgcagacgattttgggtatatgttttggagtggcaccgaaaatttttgtgcttcactcgttccaatataaatgcaatctaatacaaatataacatatcttaacactacatatataaatagacatatattaagattcgtattaataaaatatatcacatatgtattatattatgttgtacttatattacaacaaaagtattcgtatgcattaatttttagtacgggttatttttcaaataagttttctaaaagaattaatttgtcaaaatataaggctacaatactactatctgaatcaataactcaatttgagcaatttaccactaatagcacgtacacgcacatgcagagaagctcggttagtcgattaaatttacctacgctgtagtcagcaaatcagtagggcttcaccgctgcccatccactccctctttctctctctctctcttttgagcgattataatgaatatttagaaagtgggagggtgttttatacccgaggaagaaaacacccttccataggacggccctcgcggaggacgtcaaggaagccgcttgtaaaaaatggcagcccccaccccccctatagatggccaaataggtcgcctgggccagcatgattgggcataggccgaggctagtcgggccaggccatcccgaccaacatgttgggctaggtcgtgcctgcgcacgagttgcactcccgacccaagcacgacccaataagactcgggtcgtgccgggccggaccggctagaaagcacgatggctcatcgtgcttctctattaaataagtctatttttcatctctcatctctttggttgcgtcttatatggctagaataagtctatttcctccctcatctctttggaccgtgtcttatatggctgaaataagtctattttgtacacatctttctttgggttgtacctcaaatgtctaaattaagtctatgatggatccctcaactatttttctttggtcgccgagccatgagggcccaccgtgccgagggagcagcccagacacgaccgggccggcacgggccaaattgtcgtgccttgggccagcccgtcgggcgtcgggccatatggccatctatacccgctttctgggagggtggtaggtggggaccaacggtcatctgccatgtaaagaaaagctttgtagggacggcttttttttttctaaaaaaaaaacaccctcccggagagctttgggcgattagttttgtaaatccctcaaacgaaaaattattatggtacataaataatttaaaagataaaaaaattccacgacgctacgagtaggctgaacagaaattcgtcgagaaactgaacttgattttctggcccatataggcaagaataagcaggatcatgggcctcctaaacgagaccgcaatgtccgataagagaacgaattcagcctgcacgagagcgtgccattcaatcgatggcccaaaaatggaataagtttactttgtgaccatcaaaagtgatcgaaatctaattcgtgtccctaaaccacaaaaccggatatctcgacttctgaactcttaaaaccggtgcaatttggcgcctacgtggtagtattgaccgggtctcctttatacgtggcgtttaggtggcatttaaataaaaaaatatatgtgggacccatttgtcatccacacataaaagaaattgtggggccgacatacatgtggagcccacaatcatcctctccccttcttcctcctccctctctctccattctctcgccgcggtcgggttcatccggggncgncggcggcggcgagaagggcgttggaatcacctcctgctcgtggttcttcgcaaacgcctccgggtcggcgcagagctcggcggtatctcagccgtagtagccggggaactcaccggagagcgggcggaggtagatgacgcggtcggggccgtaccacgggttgccggggaactccatgacggcatcgactccaaccgcgtaagggttgcccttgagaccggcggtcgcatcagtgccgtgacgatgaccgtgagcaggagggtgaggcggagatgtggtccttactgctcgcttctcgacatgggtcctccctgtcatccattttttttcgtggtggtgccggcggtggagttgtggtgcttcttgatatgtgcatatgcacgtatgcacgccaatttgtttgcttgttgttgaattgaacagcttgagattgtgatggctctattcgacagggatgcaaagtgacgagtagatattgcgtgtgccgaagatgggtgtgcgcagcgggttggcattgtccgggacacgaggctataccgcccacctccgccgccgctcccgtagacgccgctaccgcttgagctacgcggattcaaccggtgtggcgacgaggtgcagctgcgtgccctgagtacgattccggcgaccgtcgagggagatggggttgtcctgtcgcgtgggggcgctgctagatgccccggccaatggtggtgtgtggctttctgtcgtggcccagcttccttgctgctgtcgcctgttgtcgcccgccgccgtcgccgctccagtgcctgccgacgtcactcccacgtttncgtcgctcgcaggccgncgcgccacacccgcgccttagccgctcgcagcgcgtgggtcgccatcggcgaggaggccgtggagctcagcccgagcgccgccgccgtcgtcgctccagtgcctgccgtcaccactcccgcgtctccaccgttcgatcgccggcactccggccctcgccacccgtcgcgggagagagagagagggagtggcgaggagggagaagaaactggagggagggaagagagagaagggacacgtgggtcccacattttcttttatgtgtcaatgacaaatgggtaccacacatattttttagttctaaatgccacctaaacgccacatgtaaaggagaccaggtcaatagcgccacgtcagtaaaaccgccctccaaaaccgtctagggagtcaaattgtaccggttttaagagtttgggggtcaagatatccagttttatggtctagggtcacggattagatttcggaacttattcccccaaaaatcgatcggcagtgctgtcgacctgagtccatggccgaagggccggataccgtggttcacttcatgttaacccagtagtagtttcatcttttagcgaagttattataaacgcaactttattccatcactctgtttaattccaaaacatcaatttgcttctactacagtgacgcctgaagacacaatcacacaagaaaacagcactatccttgtcgctgcatcttgtattctgacaggcacttgagaaaatctcgcacatatcgatcgttcacctcatcatccccaaacaccttggcgagctccttcaccttaaccccgaactcgtcgccttcctctcccaccatgactctcctcagcgcgtccacgatgtcgttggccgcgaacgagccgtcgtcctcgtcgcgagccacctcgacggcaaccttcttctcggcgagctgcctggcgttgaggccctgctcgaacatcagcggcagcagcaccagcctgacgccgttcgcgaggccctcggcgatggagttccagccggcgtgcgtcaggaacccgccgaccgatgcgtgagccaagaacttgacctgtggtacccagcctcggcagacgactccgcggccgttgacgcgctccttgaagcctcccggcaacccgtcgccgtcgccggcgtccggcggcgccctgaatgcccagatgaacggcagctcggatgcctcaagaccgagcgcgattctctgcagctgttcggctgtcagcttcacctcgctgccgaacgccgcgtagacgacggagtttggttcttgcctgtccagcccccgcaatgtctcctcgtggcc

SEQ ID NO: 5562 - DNA, 12360 bp, Oryza sativa
catcaacgtactcggggacggcggtgaggtgcgccggctccgtcttggcgtacgggccgcggccctggagcgtctccgcgggaccgaagaagcagagcgccgcggcgccgaacaggctgaggaacgcgcacggcacgccgtgcctcgaggcggcggccggcgcccagtacgcggcgtagtcggcgaggacccagtcgggcctcgacgggcccgtctcctgcagcagccgagacagctcgcgggagaaggcttcgtcgtaggcccggcggaggtagggccggaggtcgttggaggggaggtcgatggtcgcctcggcgtgctccggcaggtgctcgacgcgcggcagcgggatgtccacgacgcggatgcgccccgcgagcgacggcggcacgtcgatgaggcggcgggtgttcctcggcgtggagaagagcgtaacccggtggccctgccgagccacgcgcttggcgaactcggcgaaggggaggatgtggccgaaggccagccatggcagcatcaccacgtgcatgctgccgccgacgccgtcgccgtccatccgaagaccgtggcgattggccagcacacaatacggagtattttccaaccaatttggagggaggagaagaatgggtagctctaccgcattggcttgactatcgatggtcaaatagggcggcaacgggcgtatacaaattgggaaggagcaaagcaaacaatttgtgtggctgcgtcaaggatgatgatatgtcatcacgcttggattggatgtaatgcagtatcactatcatgggtgaaattcagatggcgatatgcagcctgtcgctaataaattataaatatttctcctgcagcatcacgttgatggatactccatctgtgtcatggatgggaaggagtactccatctgcatggatgaactataaaaaaaagcgtatattagggtaggaccaatttcaaataattaaaaaaggtgaggcttcgaatctaatttgtgtaacccaccaccttatagagctagccggaagaccccatagacatttctactgtggacctactcaaaatttgaagccgtggggccataagcataaagtcccactacacatgaatgattatagaattgctaattctagaaattataaagggtaccccttataatttcgtttaatccctcccacaagcataaaggccttagttcgtttaaaccctaagagatgagaaatggaggggattgaggaggaataattccataccacaataggtgtggaataatcccctccaaatccccctcaatctacttgtgggagggattaaacgaccaaggcctaatattcactttccatcaattgatgaatttgaattatcccatcttatagcttgtgggtatagtttgtgaaaatatgagaaggacaaaacgaaatgatctaatagtatattttagtatatttcatgtcagtgtatgctgaatttgattatgtatggactttataataattggttgtagctcgttgagcaaatgccggaatattattccattatcaaaaaggacattttatacataatcaactaattatgttataaacttgaaattttttacttctgtttttatctcttataatattcgttgcaatgccttttagctagtactccatccgttctaaaatattacaacttttagcatttagattgtcttaaaatataacagcttctccaccaacatttccttctcaatcaatcacgacccatcaccattcaatttccccaccttctccacttctcaaccaattacaatctttcaccattttatttttcctacttttctaataatcgtgtccaactctaatactccttatatcctgggacaaatctctactattataaaaattgaagatgtttttgccggtacttttggtacggcatccgtgcttgattcggtttttgagttcaatctcttttggaaatacagatccgtgtttgagtcggtttttaattttgttcatttttagaaatatagaatgagtcatataagagatatctttaaaaaacttgcatgctaacttgagacgatcggacccctaattgtggctcatgattttgtaaaaagaatatccaagcgaattcccaaagtgaatttcacctaagctaaaccgtacaacaataataaaattaaaatagccttcacccgttgcaacgcacgggcatttttctagtatggtactacataaaagaaactatagtgatggtggtgggtccaccacagatgacagattagataatcagagcatgtagatcggtcgaacgttcggaccttgaaaaacccccaaaatacgtttcaaatttaaggttgaaaatccaatttttgactgataagtatagacatgggcgaaaagatgaggccgtaagtacatatactaggcgaggccggtggggggggttggatatggatatgacacaagttatatctagcctagtccaaatcgataatatgatgggctttatttaggaataagttcaccagacgttcctcagctatacgtcgagtctgttaaaggtctcctgaccacaataccagaaatgtgtaccctaaactatgtaaaaccatccaaaacaagatcccaaggcagtataggtacccggttttgctaacgtggcatcctaatcagcaaaaataaaaaaatgtggaacccacatgtaagtgagaaggaaaaatgtagggcccacatgccagcatcatcttcttcctttctcttttcttctcttctcttttgacgccgacaacagatggggagaggtggccgccgacgactccgcgccactcggcctcgttgacggtgacgacgaccaaccggcgcgctgctcggcctcttgctccgaacaacccaacccacaacccagcaatggatgagagggagatggccgcgaggagagcgccaagcctagctcgtcgtggcgtgggtggcgtgtggtgttgcgggcgatggggttcgaggacgacgactacgtagatgatgcggtcggtgaagttgtgaacaatggcgatggactcgcgcgccgccgctcggacccaggttgagcgccttcttcaccctcgagaacccagggatggcgtacgagaaccgccccgtgaacgtgtcggcgaacctaccgctggtggtggagccatcgttgacctccgcgcgagcgttgttgtcatcgccgtctccacgccctcaggaccaacggcaactgaggggataggcaccgccgacgcccccgccctcgggagcagcggaggcggaggcggagacgaaggcggcggccggcgggtgagagcggcgactgcctctttccccctcactcatcggctcatttgccccctcttcggccgtcctcctctctcccccctctggccggcctcatcttccccctccccgaccggcaccagctgccgccgccgccgcctctcacccctttgctaccgacgggtgaagaagagaagggaagctaaaaaaaaagagaggaaaagatggaggagaaaaaaagagagatgttgactaggatgtgggccccacatactttttttaaattttttttgctgactaggatgccacgtcagtgaaattgggcatctatactacattggaccttttgtggacggttttacgtagtttagggatacacatttttagtattgtggttaggggaccttaaacagactcgcgtacaatgagggacgttaggtgaacttattccttatacatatgacgtattgggccctagtccaacgtaacgaaatggatagggtctatcttgacttggaccaggcctacaacacaagtccatgtccttcgatgactgcggaaaatttatttgggccattaggaaatcaggattaggctcagagagaaagacaatagaattaggagtagattaactcaggcacatggctcgtcccaaggagacattgattgtaatagaagttccaattatcctgtcacgtcagtaaactactcaaacttctaacatcctagtccaaacaatcagccgtgctcatctgcagtaatccaagccagacattgatccatacccctatgccactgcctaagtcgaccagaccatcggtaacagcgagcccggagttgattaaggcgcaaacagccgagttcgcagttgagattagcatcagcagcgagttaaaaaggactacggtactgcaccctcctcaaaagagacggaggctaccgccaaatagaattgttagctgcaacacctaatctgcagcctagcgtaattaattaaataagctaatccacagatcttaacaccccaacattccctggcacgcagcgcacggtcagcagcagatggctggtaggaaatggcccatcttgtagccactaaacccaaaagaatatgcccgagataatacaatcaagtgctaaaagccacctttcaggagcctcaatggcatactagctgcgtggatacgtgtgaaaccagagtgtcatctgttcccatatctttccaacttgttggaaataataattcattagagcaaatcttttactataatagctaattcatataatagttacctataaatatatactaccacacataattaatatctggtctcacctctcatacacacatgtatattggagcccgtgttatagctggctataaatttgtagtccgctgctcttatttcttctttcttatcttcttaaaatatgtttatagctggtttacagtacatgctctaataacggcattctgatatttgatagtgacattaatcaatctttactccatagtgctggagtaccaaagttgtttgagatgatatttcgaagcacttcggtttggtgccaaacttttgatatttgaagtattaattttcaataccgcaggtaaaacatttcaatattctaccaattcttttgtagtgctaaaatctccctaggcttttgattatttactggtgtataaatttgttttaagaatattcagaactaacgagcagtagataattttttaataccgagagtgccccaggtggagagaatgatggcggtgggccgtcatctcctaggaagcagtgccaaacccttccttcctcctctcgtcccacctcctcgtcttgctccacagtacactcgcacacccaccacacgccgtctctctcaaaacaaaatagaagcccaatacagccagtacaccaatccccccactcccggtcccctcggattccgcccatgccgccttcccgccgagagccctagccaagcccgctcgctgcttgctaacccccctccgcgcgcgctcacccgagtcctagggttccagcgagcggcgaggaggtagctcgttcgcgcgcgcgtcaaatcccatggcgggcgccgccccgctgcgcgactccctccgccgcctttgcaccgacgtcggctggtcctacgccgtcttctggagggccacccgcgccgccgactcccagcggttgtgagcgctctcactctgatccccttcccctccctgaattttctcccacacacctcagttcaactcgacttgctagttgctaccaccagtactggtagtgtactccgtagttgctgccgccgtggtggaattggctgcagaagaactgcgcccctttttttttttgcttcctaggactgcaataaatgccattgattgccacctttgccgcaaacaactggacaattggtccttccgatggcgggttcattgattttggctggagctgagttcgaattgcactttcgtttttggcttttgtgtggcaggaaattggtgtggggggatgggcactatgagcgggcggccggagcgccgtcgatctccggcttcgaggccatggacctgctgctcaaggagaaggccgcggcgttgcggagcggcaccgggcgcggtggtggcggcggcgaggggcacgcggctgatggcgccgcgggacacagccatgacagggtggacgcgctcgtgcacaaggccatggcgcaacaggtccacgtcgtgggagaagggtaatttggttttcgttactagtagtgttttgttttggatttgtgctctggttctatgggggtagtggtgtgatttggttctgctattgctgttgctggccagggtgattggtcaggctgcactgacagggttgcatcggtggatcgttcacgatattgttgatgagtgtgaggaagaagatgaggtaattgccttcgatattgccctagttggtggtgtagctcaaatttaaaatatacatgccttaagtacatttaggactaggagttacaatgtggattgattcataaattagttgctctgaacatatgatgtactgttcatcataccattccaaattagagctgctgtttcagaggacaaatcccctttaatttgttttctaggtcactctgcttgctttgctaactctatttgttgtatattttttttgtttttctgtagcgaatgagcttgaatttcgttgttacaactctttagttccatcttgatgcaggtattgctagagatgaagggccagttttgtgcaggaatacaggtctttatgctatttctttcatgttccattaccatcagcttccccatccctcgtgttcatctaaagatgcttgcttcttaacagacaattgcagtgatacctgtccttccacgaggcgttattcagcttggctccacaaaaatggtaagttacttactcattatggcctcgtgaaggtgctgagattacctactccctccgtcccaaaaaaactcaacttctacagtttgaattttgtcccataaaaaaccactttctaccatcctacctaccctcagcacgtaaaacgagaaattttattccttcaatactctttacctacctatcactcttactattttttcaatgattaaaggtatttttgtcattctccatctccactaatttcacctcgggatgctaggaatgtattttttgtgggacggagggagtatatcctagtcctttgcagaacagtaaccctttatttctgctttgctcacactttcctgtactaatgaaaagaaaaaactttactctatcacgaggttcaaaatatatggttttctttatatatatttgtctgcccccaacccccccttttttttcatttccacttctgtttcctacttgtagtgaacttgaaccgttctgctgacaattttgaacagtgtgcctccacaaattttgaaataaagattaggttaggggtcttattctatatcctatataatccgtcctggatcctgatgagctagcagaaacaacaaaaaatgttccttctgttttttgttttatttgttcaattcaaaattcagtggtttctattttgtttcaaaggttatggaggaagcagcatttatagatcatgtcagatctttgtttcagcagctgggtagttcaactgcagttgttccgtgtggttcctttgtacaagattcgattatgagaactccatttcacaaatcacttggtgtgcctacctcttcgcactcggaagaccttgctggtggtggaaatacttataatgatgacatgattaaccaccagttcaggcatcagaagtcaccagcctcgacaattcagtcatttaaccctgtacaacagttctatgctgggcctactttctgtcgtccagtaactattgcatcacgttgtgatctcttccaacctgaccatggatcaacctttactttgaacagtcagtcagaggacaatagatcgacagctttactcaaaaatagtgtttcacattctaaaacatcaaatgatgccttttcacacgcttttaaccccctcaatgaacccaacgtctccatttcaggcagaagagagtgtgtaagcatagaacaacatggttcttgccgtaatggagaaatggaaataacaataggccgcactgcttcttcaagttgtacaggcaaaacaaatattatcaataaagtggatgatttgctgagtcaggattgtttggtaggttgtcaggcaagcaatgccacatctgtgaacagaaagtttcagacaatgtccattgttgataatacaaagcttcaagatggttcttatgcaattccacatgctgcacttgttgactctacccaatattcagactgctttcaatcgcttcttggcacaatccaaggtagttcttccagcaattcaaatgcaattcatgtggatacttctcataatgctgtccatggaaagagtaacttttgccctttaggagataggaatgctgctaattcaagtgacttggctgaacttctggcatcgccaataccattagagttgactgggggaaacgatttgtttgatgtactgcaacttcagcagaagccaaatggttcaaataatagtgaagtaaacaatcgtcaatcaatgccttatggttcagagcaagctgttaagtctctgattggatgtgtggatgatgatttcactggattgatcacagaagctgatccagaccagctcctggatgcaatagtttcaaagataatcacagggcacaagcagaacgtggataccagtgcttcttgtagtactacagtggcaggctttgacagaccacttcattctgattgccacctatataccacaggaccatcatcagggccaatattttgtaattttgccagtgttgctcctgtagcaattaaaactgaagggcctgctgcaggttccaggcaatcatcttctagtatagataaatctgcaggatgctctcagacacaggaaagttacaaatcacagataaggctttgggttgagaataaccatagtgtaggatcagatagtctttcaactggacaagcatctgacagtctttcaactggacagtgtaaaaggagtgatgaaataggtaaatcaaaccgaaagagatctagaccaggggagagtgcaagaccgaggcctaaagatcggcaaatgattcaagaccgtataaaggagcttcgtgaaatagtacctaacagtgcaaaggtaacagcaccaacacatagatacccctatattgacctttaaaataaaacacattatttatcatatttttggtacttagatttctgtttgattaaacagtgtagcattgatacattactggagaagaccattaagcatatgcttttcttgcaaaatgttgcaaagcatgctgataagttgaagggatctggggagccaaaggtatgttgcatgatagtacttatttttagttatgtatcagtatcttgtatgaacaaggaacagccattaatgagagtgaacatctagcacaacagataatgtggtacttttccttgttatttagtactccatccatttcttattataagttgttttgacttttttctagtcaaacttttataagcttgatcaaatttatagaaaaatataataatatttccaatataaaataaacatactatcaaaatatttacaatgttatatttaatgaaactacttagatatgataagtgttgctaaatttttctataaacttggttaaacctaaagaagtttgactagaaaaaaaaagtcaaaacgacttataatatgaaacggagggagtagtgaattagctgagcccaaaacagacaatctctacattcttgatattcttcgtcgttccattttcgtcattagcttgctgctactgataattgatacaggtaaatgacaggcattacatgatcaacattcaaatttcctatggtccttttggagatctcctggagttaagagtttcagaaatcagcattgtcttgtttcagcaagtctttttggaacctgctgttcataatgaaatgtgattgaagttgttttaaagccaaagttgtcaataaatgactaatttatctgccaatagcccaataggtcaaaattttcgaaattgactgttttgtatttttcgatggtgacagacctttactatcataaatttgtgaagaatgctattaacataattttctttcttcaatgggtacttttcaagtaatcccattagatttctaacttgattagccccgatagatagaaaagaaaggtagatttcattgctatatttcattttgtcagagtgttttttatgaatacattagtaatctaactattaatttactcaagctaccctaatccgtgtgagattttcttgtttcatggaagcagattgttagtcatgaagaaggtttgctcttgaaagataactttgaaggtggtgcaacctgggcctttgaagttggtacgcgatctatgacatgtccaatcatagtagaggatctcaatccaccccgtcaaatgcttgtggaggtatttgctacttctctgttttcttagttcttgtaaatgctactgcacggtaattctgagtgatgattcgaacatgttgtaattgttcagatgctttgtaaagagagaggaatcttcttggaaatagctgatcaaattagaggtttagggttgactatcttgaaaggtgtgatggaagttcgtaaagataagatttgggctcgctttgctgttgaggtattaaatctttcctcgtctctcttcaacttagtaccagttcttatgactatcaatttttctgccaaaacaccaagcaaaatcacattctagcgtgatttgattatgaagctacaagtggtgtggactgagtagtatatcaaagtttaattaaaatattgaaatttctgcaggcaaacaaggatgtaactcggatggaaatatttctttctcttgtccatcttctggaacctagcactgggagctctattttgtcagcaggtgttgagaacactagcctgccgcgcgatagtttctttccatcgtctattccagcctctggtttctccaactgcttgtgacacgatgtaccatacctcagcaagtggagcgctgtgagtgggtaaagtttcacctgccgtgaccttttctccctgccttgttctagctgccacagatagttacgctgactccagtatcttgttgcctgtctccacggctgacgttgtggcaaattactgttcagtaagggagagatgtgtgttttgtcctaaccttaaactacatcgcagccagcctttgtgagggaagaagctttagcgtaggaaattgttgttttaggcaggctccacaagtgtaagaaatgcagtacataaatgattagagatttagagttaggatagcatcaggtttttctgctatgtaatatctgcattcatgtgcccatttggctctctggatctgctaacctggttgtgtatttgcagttcggtctttttcctctgttcagcaagtaccacttgaatgagtgcctcaccattttttactgaatactgaggtgtgtaatttggaaccgcagattaacagaatacacagattgtgattactctaagtagtacgagtaccaaggagtagataatggacttgcctaatacgtatccgtatctcattacactcattacgcatatccacaatatttcaggttaggatcccattaaggcaaagttcctccatggaggttactattgtctttgttgtattcctcgtttttttttctagccctgggatgtagctagagtgattctaatcccaaattgaatacgtgtagcatgcaagatcgaggaaaacacagcaaaatagtctcttgaaccaaagaaatgggattatcctcaaaagaataaatgagcaacctaaaaacagctcagttgagatacacatatcttttctctaggcacaatcatgttctctcctcttgatccaagtaaatttggaaaaagaaaaaaatggcagcaaaaagaaagaaaggagaaaaaaaaagaagaagaatgaacaatggagtggtggtcgtcatgatgggtaaagcgccaagaagctgggagacaagcatggcgaggccctccagaccctggagtgcagcttgagcacctcgtgcgccttctccttggtcttcaccccgcactgctccgaccgcagcgccaggcacagcttccccaccacgccgcactgcgccatctcctgcagcaccgccggcgtcgccgcgtgccgcgccaccgaccgcagcacgcgcaccgcccgctcgctcgccgcctccgacacccgcagcaccttcttccccaccacggccacgcccgccgcgtgcgccaccagctccgcgcgcccctccgcgcacgtgcacagccggtccagcacggccagcgccagctcgcacacgcgccgctcgggctcgtccagcagcagctccaccagcgccgccaccgcgccggcgcccacgatcttcacgcggtgccggccgtacgggcagagcgcggcgagcgcgt

SEQ ID NO: 5563 - DNA, 7702 bp, Oryza sativa
cccgcgccgtcgagcaggcgctgccgctggtcacgacgcgagatagcacgtcgaacaccccgccctgggactccagcattgccctgctatcctcgcactccgccgccagctcccgcagcctcctgagcgcgcccacctgcgccgcggcggcgtcggacaggagcgacgcaacctcgtcgctcgaaaccggtcgtagcgcggccacctcctcgtccacggccgacccgggggagacggaggccgcccacgactggatcaggcggcgcagggtgtggttgggcgtgagctccagcccgtgctcgagcggctgccgcgtgacgggacacgtccggcgggcccccggcgcggcgagccaccgcgcgatcgcggcgcggtcgtacgagatccccgtagggagcgtgacggggtcgcgcatgagctgcagcgagatcgggcagacgaagtaggacggcacctcggccgccgcgctcgccatcgctgccatatccgtcaccagtagtaggagtgcaccagccgatcgccacgccacgcacttgttcaccggaatgcgcgcgagggccaagaatatataccgcgagatggcggtggcgcgcggtggtgcgcgttcgcgagtcgtagctgttcttgcggctgcgggtagggagaagaagaggaggaagaagaggaagacgcgcgcgtcgcggaggttgcgcggctgtgcgttggtttggtcgcggttttaatttaaggcgcgggggattcgtctagtggcgttcacatgcgtcgcgtcgcaccacatcacatgctacgccgcgctttgtttactcgtcgctcgcggttggggtcagagggtgctgtatttgcgttttagtcccttgggtttctttaatttggggggactagctccctttcctccttcacaaggagaggcttttgagtttcggtttgactttaatttggtgaggtcatgagcgttccgtggctaaggtttcctctgacttttgatggtttggaaaaagtataaagatgacactgggaaattgggagctcaatgtgaacgtcttgtgcataaaatcaaaggttagtctgtagtaagatcaaaggttattattttgtatgattatattcgaaagaaaactgtacaatgcttaagtttcttttgtggcgttgattattcgggacacgtttatcttaaaattctactccaaattttgaagatttagtacaactattctaacttcatggcaccgcaaataagaggtttaagattgaagaattttgatccacatgacgagttgccatgctatgatagaaggcaataaggtatcaattaattgtaaattattgccagataagtaagaatgatgtgacactaacttactttgatcacccaggtaatggattgcccattttgcatataagtgataaatggacttctttatttgaaaatgacgcgcgtcgactatagaaactcatcaccgtcccttcagttacaaaatgctccttttcctcatataagacgaatagtccttgctttgaaacagtatcagtacacacacaattgctatcaatcctcaatcagtaactactaaccaatattatttctcattttgacctttgctccagtttcctcggagaacaccaggaggagtcttcccataattcactcaatcccaggtctccttttgcaaaagtaacctattccagtcagttgatggattggaacagtgggaaaaggctccactggttgacctggaaaatttccgagattaattaacaaaaccgagccggtcagaagcctagcgattagcgctggctctgcactgttaacacttttgtttattcagatctctgaccttgccggtgccctgcatgttccgtttctcttgagatgtgcgcgcccctgttcgtattaggtgccctaattgagggcttgagtgcttgaccaactaattcctcaattcttttttagtgctcacctgatctaaacagatgatcagctcttatctgtcattttgagtttttttttctaatatgatcagctcttatctgtcatcttgagggtttttttttaatcattgatcttcagaatctttctctggattcatctttcaggtgatgtacatgatctttcttgttgatgtgacaccaaagattttctgaggggaaaagtgatcttttctgtattaacagatccgtgattcagtgaattggttgctctctaccagttgtatccttgtagcaactagagagaaaatgagaaagcgatgtccactaggttaatttgtaggccaacttatggaatcacagtactccaagtcaccaaagctaccaaattagcgttcgaaaacggctacatatatagtagtgattgattagtaactcttagctccaattggaacttgagaactggacccaattacctaattggaccactagctagggttattttctgtttccaatggagtaattagtgagtgaaggagtaacaaaattgccaactaacctaattgttaggttcaaccaggagtttggtccaccgttttgccaaatctaggggtagatatattattttggatttttcagaaaagaaaagcctcgtctgatgtatatctgtcacttgcaattaattaaggctattgtcagaacacatgagagaccatttcctcctaaccttgcatgttgttctccatcatggcatcatgtcactggtacgtttacgttggattctagatccatctggtacatttacacaatgtcaacgataacattattcagaggaattgatcatccacatcgatcgataaaagaagtgtttgacttttgctaaccaagattctaattccatcaattttctactgctaattaactggagtaagcttttgtacatgtgtggctgatactgttataatcgatgaggcaccaccggtagtgtgtacaagatcagaattcggcgctacctttgttctgcctaacccagcggtaaaaagttaaaaaaccgaactgacctgctataactgaacattgattcggttcggtaatggttggctaattcaggttgattcaagtgcttggcacgagtttttgtctgaaatagcaaatggctccatgcggtggatggtgcaaatgtgtttttgtctgacgccgacgtcgtttactttttgccatttccactttcttaactaattacctttcattaattcaggatgtatgtatgcatgcttagcagtaatctgactggtactactaccagtctatcgattagcttagcagctagctaggtggtgagatcaacgctcgcggcattgacctttcaccatcaatggcgtcacaccgtttgtttcattgtttgagcatgtgaaaaactcagtactcgtgttggttttcagctaattagctagcctggaaaagagctgaccggtctccttgctctctttaaagtgcgtcgctgtcgcaatggatggcccaaggctggtacacgtcggtgcctcctcgacgcgccgccgctgaaccagccgtgtactttttggtgcatcatctgtgctgtttttggttttctcacgattgattcgcaatcttagatagaagtagcacactgcaaattgcagtacggctctacgtacggggccactccatcaaatgatgtactactcccttgcaaatgtcaaacatacagttaatgatttctctagctgtttttgaaatactagacgtcttcacaaccactctcttgaaaaatacgcctgacgaataggattttttttctactactataaaaacacatcgtcgttctcctctgcaccccttcccatcttgtgcagcgcacattccagaaaaaaatgctagagaaaaacaaaaggaaatgtgcttattgcgcgctccataacaaaaaagataaaaaatagcaaaagaaaacaggggaaagaagagaggaaatgtggttggataaaaagaaatttccactttatgctagatccacatcttaggccctagcccatttttagtggtatggcccattgcaatacatggttatattaccagtttaatagaaaagcaaccatttgttcatctgttttgtagcagtaaatcataatctcaaaaatctcgaactagctatatatttttttcaataatcagatgtaaatatagtagtcatagtataattatattgtaatttgcatttagctgcagtacaatttgtatgcaacttaaaaaaattccacgctaacacactattttcgtgaagcggaggtcgcgagactgaatctcctcgtccgcacgtgcactatgattttttttctttccaacttaaacaaatcttggagtaataaacctaatggtttaaaattaagtgaaagctacatacatgttacgttgtgattacatgcaaatgacgcaagttacaatacaattgcaccataactattatgtacttacatttgataaatcgtgagaatgctgatgacaaaagcccaaaaaactttacgtaaatggcggcctgaatcgtagtgagccttaatggaccagctttaccacagggacaacgtgttaaccagcccaattacaaatatggttcagtttaaatttggcccatctgtagatgaggccgcaaattgggcctccagaaagtgagtaggactggcaatcaaccttttctagtcaaagacacccttgaaagctactccacgcaagcatccatagcaaggaaacgcttttcatggacagaatcgcgcagcgtaaacacaattcccagcaattctgtcaagtgtgtccggccagtggccaacgggatagttcttcgtcttcacgttgtacctagcctccatgccactgtccctgaaggcctgaacaatttgatgagtgtaatcatgacactgtccactgtacgtatttacattccagaagtgaaattaaacaaaaggattatcccagtaatacttcagttgcaactgcaaagacctgaagattaaaggaaggtgaaagaaactgtgtcttgattttgatctggagcatgcgtgaatgtgcgtagtcaactcttcaagtaagagtagttttctatcatggttattttttttggaagatttactaatgcaaatgatgctgcttagatggcgtcattagctaggctgctgcaaggataaggcaccgtatacgtgtggaaaagccagcaaaatgcatggatcgatggcatcggaaagaatgcatcaatcccgtagttactgttgccgaggtatattagcatactatattcagtctaagagttgaaatcaaccgagttgactgcaacatatataccaattctactgcctagtgctgatcagtgatcacctcctctcttcatcttctcttacaatttaattgctccaattgtaaatactgaacacacaaaaattaaatattagaaccataattagatagaaagatcataataattaattctgcacaattctgctacctggaatgtcaactcatattggctggttaattactcacatgcatatatatacatgcgattttgtgaatgtgaaattgtaaatgtgatctagtcccatgtgttctatcccattatcatcgcgaaaccacaagccctgcacgcactgacggaggatatggccatttgtttacgtcgttcgagtacaatttgatactacaggtaagctagggctaggaggggagatcgatcggttgggagctccctccttggatcatgggccagcttcttcttcttctcctctctctcggatccagacccggccatgtgcatccggccctaggcaccctgaattctgtagagaggggagctcccaaggttgatcattactgctgctgatgcacaagtcagacgagcagtggattccaagcatgaggctgcgactgcgagaggttaactgagggcggccatgcatgtagtcgagctctctcccctacgcaatccatccatggcgccgagccgatgcatccatccgtcgtgcgtgtgaggcgttgaccctgtaaaatattgcgcgcacgggtagcgcagtgagcagtatccggtacttctgcattccatgcaccctcgaatcctcgattttgccttggtcaatgcaattctggtacagtatacctgtactttttatacatctagtagtagtgttgttgataactgcatgtacttgcatgcatgcatttcattgctacttttgacagttgaaactaaccacatttggatcatgcaagtgcatatattttgttaagtttaaccacttgtgtcagggacccaaggacgtacagttcattctgaagatcaccacacaactcactttacagcaacagttcaatggtacagcagtgatgcactatgcatccatatgaattaatcacagggattactttttttttatcattttgcagaattggccttaatcacgtactgaatgtgcagctggatggtctttataggacataagaattggcagcttgatttagctagtcttttattaatttaacccagctcattagccttttagtttaattgaacaccgtgatgatgcagataacattctactggctgtaaaatctagaaagatactgagtgactacaagtggatccagacgagcaatctctatctttcaacaagatatatgagcagtcatgccgagaccaatgaggcaatggcagctactactctcctgtgagtttaattgggctgcttttgtttgactaacaatctcgaccgagcacaagggagacaagggacacatgcactgtggaatgcttgccatgcaaggtattagttgcttcccttgttaagccacatacaaaagaactgtacatgcaaactattcattcacagtgaagatgccgccaaaataagctactagatctatagaatttggattttttttttcatcgatcgatagccatttcttctactgactattgcgctgttaaattgtcatatcaagctagtctcgtaatttcaaatagttcttgctatctttcttctacttttcatgttctgctagctagatcattgagaacacatatgcatatatcgaaatacatgcataagcaacttcagctacagtaaaacggggggaaaaaaaaaggacttctgccgcaatgctagcttcagcagaagattttctgaagttgaacctgcacataaaacttgtgattataacatcactactccatataatcaaatatttttcaaactttattgtattggctctatctcacaagtataccaattacccttaattactcccttcacatgagtgatctagcacctagctcaccctctccctcttcaaaacaagcatagctctatatgtagttcttccaaacagaaacaaaagaaaaaagttacaaaccaatcgcaagaatagcatgagatcgattagctagaagaaaaaattttaatcgtatatatatttatggcatgtaaagagcctccaatccttggcaatccacgctccaatcatgatcaggagcgccgatcatgcactcatggaggctcatggcgtcgtcgggaaacgaatccaacgagtcgtacttgggctcctcccatgtcgacaagctcggcacgatcgagcaccacgacgacaggctgccggcgccggcgacgtccgtgggcaaacctagcgagtcgaagcagctctgatccatggcgaagttgagctcgccgagcgcggcttgcacgctcgcgtccgtgcacagcatggaagtggtggcggtggt

SEQ ID NO: 5564 - DNA, 12047 bp, Oryza sativa
  unsure (1)..(12047): unsure at all n locations
cggggacgttgcggagcgagccgcccttggtccagtaccggcggcatcccttgcagaagtagcgcggctggctgaggctgtagttgttgtagtagcagaacttggtgttgggcgagtcgcagcgcgggcagttgggcgccgcctcggcgccctgcttgtaccggcgatccaccagcagcgacggcggccgcggcgcgtacggcagcatcgcctcgtggtgcgacgacgacaacatcgatctctcggctcgatcgcgatcagcagcctccaagctagagatagctagctcgcttgcggccaagaatatatatggtgatgtgagatgttagctcagctcgatcgatcggtggcgcgagaggaattgattgatggaggtggcaagagagggggagagggagagggaggtggtggggtttttatatggatcacagggtgagctactagtagcacagggtgggagttttttccggttactggcgcatgtgcatgtgagtttgcatgcagacttgcagagcatagatcgatttggggcgagctgtagtgagactatttgtaggatttaatttggggttaaagaaatgaggttaggcaggagtagctcctaattaatcacccccaacaaactgtgcttgtgcagtccctccttagtggctacagtagtcttattatcgcataatgacgcaacaaccactgtgctagtgatcaaaggacattggtacaaggcaaattttcgcgtcgatctggaaaataatggagcttcaaccctgtgcatcttgtctcagtctacagttttatactggcacacaggactgatactcctatatctcaattgctctcgtgcaaaatttcgaaataactaccctctataaaagctgctacggtgttgattgtggattaaggccctgttcggctgcattagccgagccaagaatcaactggcagctggccgctggctgcaaggcagcagctgtaaaaaggcagcccaacaagccttaacccaaaaaacagatcaagtaacaaaagaaatttaaaagaatactactactacctttatttcttaaatatcattgttttttaaatatgtgatgtagttattttttaaaaaactttgactgacaatatttatataattagttagttaattaggaaaaaaataaaagaatacagctaaatctatcatcaaaattatctttaaaaagatctccctccatcccaaattgattattttatatgtttattcaccaaaactaaggataatttaaatcgcatcaattaagacatcatgcacaccattttcctacaatgcatgcattgattaaaacaccacgccaattacaccattgtcatgcacacattctcccttgctacattaattatattcgatggaattcgtgtccatgggatttatatgatgatcaatttgagaaattttggatttcattatatgatgatcaatttggtaaagagggagtatcatcaaaagcactttaagcatgtctaatatatttgtctatttgcacaaatatctattgataaaaaataagtagtcaaacacattaaaaaaaattcaacctttatgatatgtctactagtgtaaaagtggaattgttctcgtcctcctttcaccccatccctcactgtgcgaaacacacatctgctctgcgtaattgtcagatccaatgttcttcagtcgctctcctagcctatcccatacgttagaacccatgaacatgttactagtactcccttcgtcccactcactacggcgctcacatattttaatatttaactttttaaatatttgaccaataaataattattataaattcaaatttatttgatgaaaataacaatattggattgttatttatgtttactttcattataatatataattttattgctataaacattataatatgtgagaaaatttaaaaccaaatattagttttgaagactgtgtcaagtttgactgcggcttagtgagtgggatggttgaagtgttttaaagaaattgagagattcacgacgtcacgataagtatctcaggtacttatagggatagggtgtatgtgtgtgcgtttataggggtgagtgtaagcgtatgagcgtaaatatttgtactttgctttagaaaaaagtacttagctagtagtaattcagtccacaattccagttgatagaataataagaatataaggtgcatgactatactgcgagccaattattagcgtggtcggtgcaacacggagccgttgcgcccaagtgatcgatggcacgggctggcggcacgccccttgcggtgggcgcgcgcgcacggccggctgctcggctgctcctagcgccgtacatagccgggaagagaggccgtgtgccgtgacgcgcgcgagctcgcggtagcggggggagagccccactggccagccacgtgcaaaccccaggcccccccgcggtgccgggggtggggtgcgagggacgcaaatccctcgggatcgttcacgcccattttgttatacactcccctctcgatcgatgcgtcgcgtgcggcgtaccgtcgttcgacgggtacgctgtgggaaccgcgatttcctcacacgcggttaggctctcgcgacgcaaccgcgcatcacggccaccggaccacgacgcgcgcgcgcgcgcacccgctcgatcgcaagttaatttttgcaaccagatccagctgcatagcgggttggcgcgctttgggacttgggatacgcgcgcccgggttacttgcacatgtgcatgcgagtttgcgacgcatagaatcgggccgacctgtatgcagtgtgaatatgtaatttagtttggggtttaagaaagagattagggagctcccaactgattacgtacccctaacaagccgagattgtgtgcagtatagtctctcttaagttgctacagtagtcgtgtcatgtcatcgcataatgatgccacaaccaatgtgctcctgatcgaaggacgttgcttccaccgtttcgggcccctttgaatcacaggaatgaaaaaacagaggaatagaaaaaacgtaggatttttgtaggaatggaaccgtaaaaacagaggattgcaaaacataggaaagttatgttactagccctttgaatgggtataggaatttcacaggaaagagagtgtcaggaatttcacaggaaagagagtgtcaggaatttcacaggaaagagagtgtcaggaagtgtattaatacatgtcactttggccttatccacaatatcgcaatatatattttcttctaaaagaacaacaatgatgcatatgtctgtcatttacctcgatcctacgcacacatgatggaaaaaagaggttagggtggatgttttctttcctatgttttccatgtgaaatgagttccaaaggaaaatttcctctaactttcctatgccctaatcctatgaatcaaaggctgctacagtgcctaatcctaaatcctatatttttcctatgaaattcctattaatcaaaggaggcattcacgtctaaattaaatgacagttctactgagaaatgacagtagtaaaaataaataaaaaaatctacgtccagcttacagtacgagaactgataggtgcaagcagacaacccaatggttcccgcattttatcgctccatgcacgtcgaaagaatttcgatgattctttccacggttagttggtgcatagtgatgcgtggcatggcggtgcccagcctgctacaacagggcctcatagctagccgaattattgttcttttttaccctgagggaaagctggctagccgaattggttcgataaagtgtctcgatacattttgaaaaacatacaaattttatattttagaataaataaagcatcagatcaatttgaatctctccataattacaatattgtttatgatactcatatggatatgtgtctttagtcgaatcatgagaaagtgttttcatcctctaagctgatatctccttgttttttatgtcatcaaaatagtgataacaaattgaaaaatgtttggtagatcaatatataaaatataacactccacaaacatacaaatttaaattcaacatactccctccattccataatataaggcacaaccacttttttagagattctataatatataaggtatgcatgtaggcatgcatgtaagcatgcaattaaccatgacatcttctccattaaattattattttttaaaatcatccactctcatgttacataatcctattggatgcatgcattatatttattaggatgatccaaactacaagacgataataattatttattggtatttgggttaaggtgattgtgccttatattttagaacggagggagtatacaaatagaaacacaattttatattgtataagttatttttgaacttacatatttgtaaagtgatatatctcatattgatctaccttaccatttttcaactttttaaataaattatgagtggcatgcacaaaacgggaggatattccctcaaggatggtatccacattcgaatcttgtgatacgactgcttaagttgtacttcctgtgttctacaatatagcaatatggtataggatgagaagtgtgctcgcgaaaaaaagtataggatgagaagtatccttagtataaatttattgtattagggtgtgtctaatcctatagtagattgttatatttgaaaagaaaacacttagtaggcatatctattcaaggaatggtttattaattgggtatcttcttttctttgatgatgacgattgttttgtgctcggggactccacagcaaaaccgggtcctatttatgtttgtttcccctgatccatcgaactaacaacggcgcccatgcatgcaaggtggtccaaagtacgtatagacaacagtacagtacagggctactgcaggctacacagacaacagcgagatgatgacagattgacgttttgacaggtcggtggccggtccctcgcccaatcatacctcgccaagacacacggccggacaagcgcgcactggtgtgcctggtggtgtgtactctgccgccctccatccgcccccctccccccgccacccgcacggcgcctctgcgacgtacggcacggcgcacgctcgaccgagtcttgcacggtgacatgcctgccatgccatcgccgcctactactactggtactgcctcgtaccatccgatgtctctctgcgtggcccagcctctctcgatcgcgatctgtcgtgtagggcagctagctggtcggagtggtttttgatggcgacagtgagtacattccgactccggccggacgtgtacaacgtttatttgatgnacgtacgtaccggtcgacttgcgcggtgctgatcacccatgtggctcgttgaggtacgtcgtacgggcccggtggcatgcatgagcgttccttggccctaatcatacgcaattaagggggaacacggaccatcaaccacaaatttgacttgcttgcgcgagaaagcgatccagctgatgagatagctgcaacaagatgagctcgctctgacaaaagtaatgaggagctctaattttatatgttgaatttgaatttatgtgtttatggaacaacatatctcatattgatctgtcattcgattttaaaaatttgttaataactactactatttgactgtcatacaaaaataagggatatcccattaaggaataaaaagagtttctcaggtaaacgtaacaatgcatctagattaatctattaaatggaaaacaaataagattaaagttacatattttttaagagaatttattccataccactaagtttactctaattcaacgatttgtcatatactttacctccatttataatacaccattgactttgtcaaaaaaattacaatgtatcattgagtagatacttttaaggaaatgactaaaatacccttcaagtcatataagggttgacacttgattgacccactagtagttatttttttaaaaaaaaataaaattttgtgtgtgtatattttaagatatagaagtgtgtgtgtatattttaagattttctttcttgtttttttaaattattatgtagcatatatatgaaagaggtaaccccataaaaaagaattataaagcatatggatgatgatttatgtgaaaggacattaacacaagagtattctattagtacataaattataaattatatttccaaaaataataatacacgcgaaataaaaatcttgaaatatacacacttctatattatgtaaggaggctacataaaaaaatttcatgttttttggaaacttctactatatcaattaattgttatgcctttgtcggtgatatgggcccgggggtatcaggtttagagggaggaggctgccccccgatgccacgtagccctcctccgaggggagtcaggcccgaggtggggtggcggccactccttccctcaaagactagtcggaggaggctgccccccgatgccacgtggccctcccccgaggggagtcaggcccgaggtaagacggcggccactccttcccagagactggatggagcaggctgccctccaatgccacgtggccctcccccgaggggggtcgggcccgaggtagggcagcggccactccctggccgagactagagggagaaggccgccccaggcgccacgtggctccccccccgaggggggatcgggcccgaggtcgggcggcgaccgcccccctcccgtgactaggggtcgggctccccgaccccctctctaggtcaccacgtacggtgggttaggtgtccgcctccaggtacccacctacccgcatttatggcgtcccgagcagtcgcgccacgcagtgcactcagccggtctgtgaccggtcgaatgaccgatgggactggctagtgcgcctgtgcgctgctcgtgtgtcagcggcgtgcaacctgacatgtcccatcaaatagtgatggtgagaggttctcatcctcttatcccagccggagtcggtcctcctgctctggtcaaagcaaggctcccgtttcccggtgtaataggagcccagaagtcttcacccattaaatggtgactaataggggcaccccccgtgttaggcggtaagatttgacaggccccatcatcaagacgacgtgtgcttggcttcccaagtcaagagacaagacatgcatttaatgcaaagattataatacttctccaccagagctaggttaggttgttgggcccatgtggtaaccccttgaggtataaaaggaggtccaggcctagtgatggaggggggacttccgagcgaactggcgcttgggtctcgcaaccccaagcacttgtgttctacattcaatcaatcatgcacaagagtagggtaatgcacttctcagtggcccgaacctgtataaacctcttttgtctcatcgtcttggaggggcctaaccccctcaagatcacacagctccgctcaccaagccctcgaatatcacccgttgcccccggccgaactcacaaagggggcctcacggttccctggtggaggagttcattctttgacatctggcgcgccaggtagggggcgcgttcgtgatttttgaggttctttcgagcgccggcgtggtgagtgtcgcgccgccgctacgggggaaggtgcagcatcctcaggagtgtcgcgccaccctaggcagggggcaaggccctccacatccccaccaggtaagcttggctactaggtctttgtggcgagtcttcggaatgtccaagggccccccaaagctccagccctgcctcaccgagaagtacgacgatggcgccgacccctccaagtccctctagttctgcacagcgatcatagaggcggcgggggatggcgaccgggtcatggcgaacgtcttctcatggccctcaagggccaagcgcggggttggcccatgagcctgggaggactcttgcagttttgagctccgggtgccgtcgaagcccgggaccccctgtgatggcttttctgtagcggctggctttggtcccaccagctgactacggtgcccggcccggctcaactgatcgtccttttaagcttcaagtattttcaatttttcaattcattagcttgaaatcttatatttatttccccccattctattctcatggccctgcgacacccgcgtgttgcgcatttgtttgctccctcggtggtaagagcccaacctctctcccatctacatgaacgattatttgctaagtgtgggggctaagttttctagccttatcctagccttaagttgagccccgggtgccgtcgacgcccgggaccccctgtgctggctcttccgtagcggctggctttggtcccgccggctggctacggtacccggcctggctcaactgtagacggggattgctggctctagagttttcggctctcacagtcatgcgaaagtaatcgtccatgtagaaggaaaagagattggaaggaggccaccgaaaggaaagagcaaacagaatgtgtagcgtggggacacgggctcgtgggaacctgacctcgtttgctaagtggtcacaggcttcccatgatggttcggaacccatggtgggggggcctcttcgagctaaaggtttgtgtttgcttcattcatacaagcaattctttactataagtgtgagggctacgattcctagctctatcctagccctgcgtcgagctctgggtaccgtcgacgcccgggaccccctgtgctagctcttccgtagcggctggctttggccctgtcggctggttacgacgctcagcttcgcttgatcgcaggcgaagattgctggctatagaaagttcagtcctcacactcgcgcgaagataatcatttgcataaaattattgttgcttatatttatctctcatccatctcttcctcgcggtcccacggtacctatgtgtcacgcgccggcttgcctcccttggtacaaaaagtttgtattcgcttcatccattcaaatgattctttacttaaagtgcgggggctatgattcctagctctatcctaaccctgcgtcgagctctgggtaccgtcgacgcccggggccccctgtgctagcccttccgtagcggctggctttggccccgccggctggctatggcgcccaacttaatttaatcgcgggtgaagattgctggctatggaaagttcagccctcacactcgtgaaaataatcgtttgaatagatgaagtagaacatgaatagaggttaacaaatggcaggggcaagcgaggtacacggcgtaaggtcacgggcccgagagaatctaacaacgtttgctgaatatatacagaaaataagttcacagcctaaggtatgggctagcgagtcgccctcaggctggggcgaaaaaggcgcatgggtcctagtgccagcaaagaaagaataagagatcgggccacacatatcatcagactaggaaagtggcgtcaaccctgaccacctggggaaggttttggtcagggctaacgccgggggctactgtcggtgatatgggcccgggggtatcaggtttagagggaggaggctgccccccgatgccacgtggccctccctcgaggggagtcaggcctgaggtggggtggcggctactcttccccaaagactagtcggaggaggctgccccccgatgccacgtggccctcccccgaggggagttaggcccgaggtaggacggcggccagtccttcccagagactagatggagcaggctgccctccaatgccacgtggccctcccccgaggggggtcgggcccgaggtagggcggcggccactccctggccgagactagagggagaaggccgccccaggcgccacgtggctccccccccccccgaggggggatcgggcccgaggtcgggcggcgaccgcccccctcccgtgactaagggtcgggctcccccgaccccctctctaggtcaccacgtacggtgggttaggtgtccgcctccaggtgcccacctacccgcatttatggcgtcccgagcggtcgcgccacgcagtgcactcaaccggtctgtgaccggtcgaatgaccgatgggactggctagtgcgcctgtgcgctgctcgtgtgtcaggcggcgtgcaacctgacatgtcccatcaaatagtgatggtgagaggttctcatcctcttatcccagccggagtcggtcctcccgctctggtcaaagcaaggctcccgtttcccgatgtaataggagcccagaagtcttcacccattaaatggtgactaacaggggcaccccccgtgttaggcggtaagatttgacaggccccatcatcaagatgacatgtgcttggctttccaagtcaagagacaagacatgcatttaatgcaaagattataatacttctccaccagagctaggttaggttgttgggcccatgtggtaaccccttgaggtataaaaggaggtccaggcctagtgatggaggggggacttccgagcgaactggcgcttgggtctcacaaccccaaacacttgtgttctacattcaatcaatcatacacaggagtagggtattacgcttctcagtggcccgaacctgtataaatctcttttgtctcatcatcttggaggggcctaaccccctcaagatcacacagctccgctcaccaagccctcgaatctcacccactgcccccggccgaactcacaaaggggggcttcacggttccctggtggaggagttcattctccgacagccttaaaggcaattttggtatttttttaaaaaaaatattcaccccaacagcatactattgacgtaaaaagacaaagtcaatgacatatttaaaaaaaaagagacaaagtcgatggcaaatcgttgaacaagagtaaactttcctccaaaaattatattggaggtgtagttattcgtgagtttaggctaatcattgtgctaaagtggattgagaacttaaaataaaatcatgcgaatgacaaatagccaaaaacaataaaaggaaagcgttagtgtcctgattggtccgcgcgaaattatcggctttgtttgtgtcaaagaaaaagatgaggaatcgcaaattcgcaatccaaacaaacgtgcaaggccaaacggcaagtcttgtgagtggcagatcgccagatacatgcactccactcatgcaggtgccaagtcctgagtcctgacagcattctaagttcacggcctgataacacgatatatacccttctgtaataaagtgaaaacattttgaatttgtcgctagatcacaactcgtagatgctgtaactgtgaggtaattaagcactgataacaagtcaaccatggatcagcagatcaaacaggaagtgcttgtacagagcaggaaaaaaaaagagtaactatagaatgttctgttccggggagaatccacaaaggacgagatactgcagtatatactgaactgaatgcttgcagcgtgcccccacactgtaaaagttagagcaatgtatcacgttacttcattaatcggccaaagagtacacatggaactgacgctgttcgtcaccggctgaattgtctttttgatatgcatacacattgggtcaggtactcaggtggtttgtactttcagacgatctcatattcagcgatcgttgatgtctagctacttctattcatgtaacgttaatgctgtacatatacagttttacatgagctaacatgcatgttcttgtctgaaagtaacttatatagtactagtaaaacataaaagtttaacagccgtcttcatttcattgccgcataaataacattttgtctgcgaagtattcctccgtttcacaatataaatcattctagcatttcattaacatcaataggaatgtgggatatactagaataacttacattgtgaaacggagggagtactatgtttcttaggcagcaacagttcagatacctattagattaggctttggggattattgatccactgcattctctctttttcttcccctgttttatgtgattttctgaagatgctttcaca

SEQ ID NO: 5565 - DNA, 4052 bp, Oryza sativa
agaattaagcgtttgtacgtactgggaacagtaggcatggaggatgagctgcatgcacgcaggtacaggtgcagtgcatgagaaagcaaccgttagccttgtgatggaacgacaaagtgggatatggaggatggacgaatattacgtgcaattccgacaaaccagttctatccaatgcatcatatataggctcttctcagttattttattatttattgccaaaaaaaaactaaggttagtgatggcagaattaggaatgaaccatgcttgtgtccaaactccaaagtcgcctcagaaatagtcacggaaaataacaaaacactaccatgtttcctcaaccgtgtattcaatatatctggctgggagcagaggacttgctggatggtaccaagacaccgtgatcaatataatagtatatgctctgcatatgtatgtacttattaccaaaaatttatcacaatttgaaaggcgtaatatattgagcctggagcactgaagtatactttgatccctgttcaatatcctacgccgacagttacactttcgatctgaataatggacttaccagctggtacagatcgattaatgaacgtgcttacccgtacgtgtttggaccagttagtactcattactacgtacttataaatctaccggactaccgcgacaacagccagcaagcttatataggcaatggctgatcaatcaagggtgagagatctatgcagtgtccaaagcctaggcatgacaaagtaagtaacaaaccatgcacatcccctcttcggaaaagttgagaggtgtaaacttgtgataggtagtacgtacaacgtacgaacgtactccatctcggtgcaaactgtacatggtttaccaggccggccggccggccggcccggggaccatgcgatgcatgatgccagcatgcagctgatgtgcacctcacctcataatcccttccttgaaacccaatcaacagagacaatacgcgagcacgacagggctctcgctcagctagcgcaagggcgcgcggcgcgttgacaaaacccctcatgcaccgcgagtcgatcgagaccgagacgcccgcgcgccccggccggccgcgaaccagcgatcgacgactgagccccgcgcgtacggcgcccgcgggggccgcgcggcagggtggggggttgccggcgggttggtgtggccggctggccgcatgggaggagcgcgtgggacgtgccgtaccgtgggtgttctgccgggtggtgaggccgcgggcgcgcgactggcgcgagtcccctatgatgcctgggcctgtggaccacgcggcggagagactcgatcgcggcaactgccgcgcccgtcgcccgatatggtgtacgcgcggggggggtcacatgggttttggatccgtgcgcctgcctccttcaatgcgcgacggcgacgtcggcacgaaccggaactggagggaagtggggcgcggtcttgttggaaatgtcaaccgcagaattgtcgtaaacgacggcggttgatccagattccgtcgagcgactagcgtgcaggcgtgaatctgcgccatatgatcgatcgagcgcccaagttaacaagcctggcagtcgtgtccgatgcaacaatctagctaggcccagacgccgagtgttatactggtgacggattcgtgaacaaggcgaggtcaggtgagaaaatgacaggtgtgtgttttggcaaagggagtgtacgtgttcgggcctagcccaatcattcatcctgattcctgaatgaaaaaggccgaaaggagctttttatagtgcgggcctgctcagatctcgtgataaaggcccagttacgacaattcgatcacaccccagaaaacaaccaattaacgaatttggttgtatatttgtcgacaaattttcctccaaaaatttatcaaatgtaattacagtttaatcgtagtgtaattatgtaactttcaaaaatctctcggtaacatgttatttcagtaaaatagaggtcgtgggaacaaatcctttcacatatgtgtgtgctgtgattatttttcttcctcactagaacaaatcttgtaaatagatctaacgatcaaaattacgtgaaacttacatacaagttacactgtagttacatgcaagttacagtgtaattacatacaagttatagtgtaattatactacgattatactataattacatctgtcaaatttttagtagaaaatttatcgacaaatatataggtggtcccaccaattaatgttctttcttcatcagaaaatgtcatctggaatgcaaacgaaggaaaaaaaaaaaagcaacgccagttcaacaacaatcttgatacattcttccataaagaaccaacaaattcgttgtgttcgctccgggatattgataacttaataactttaggcgtgcgctttttgttcttgtcaatctcatcctcttctctttttctgttgggaagaaacctctccttgctcctgcgttacaagttggacagggacccatcaagctaatgagcgatccgacacgtacatacaggacagtggattctgatcatcaagatatgtgtgctagactgctagtgtagtgcagtggagcctttcgctgtgcgtttttgcacacgtcgagtacgtgtgccttcgcccttcgccgatcgttacgcgacagccgatcgatcacgcgtccaaagcccgtcaatcgagtgggcatgcatgcatgcgctccatctggaaagttaatttaagctatttctgagagtgagatctcatcagatcagatatatactccgtactacattcgtgctagtctcctaatctagaagattagtagctacagggtactatatatctggctcatttttcctgttctagcttgtaacaaaaaattcactgctatgatctgaaacgttgtactccatcaaagtatcaaacgaatccacttggaaatttcggaccgaccggttttagattcccgccaactgagcctgtgaaaatagtaaccgataaaaacgaaataaaaatggtaaaagatatagaaacataaacatatttctcttataccgactgttttcgtattttaccatattccacttggaaatttcggaccgaccggttttagattcctgccaactgagcctgtgaaaatagtaaccgataaaaacgaaatgaaaatggtaaaagatatagaaacataaacatatttctcttataccgactgttttcgtattttaccatattcctattgaaattacctttttataatattgataattaccatatttttaaataccctaatatgtgtggtttgatacatagtttagaggctcgttaattcctcaatcaaatcctaagttgagtgcatggcataagaagggagaaagtttataatttaagctagtgtaagcttgaatttgttttcgcatattatattatatagttatattaagttaaatatattatttttacagcttaatatttccagaatttatatcggtttccgggcgataactctgtttttcctccgtatagtgacatttctgatttcctgatattttttacaccgctttcattttcgatttgaccctttttatcctattttctagaataatatggttaaaaaatgactgagctgtttttcgaccattttcttccctatgagtgaccatgtgtgtagaagatttatccattttctttttattttttgcgtacttttcctgtggctcatgcagaactgaagggctggaagcctggaacatgcatatacagtactctgttgtaaattttacagacgtccattaattattagggtaatttggaaccatgccattataattttgtaaagtttaaaatatatcatcggtatctcaatgacatgcaggacccatatgagtcaatgacatgtaggtcaggatggcatatgtcggtgacatgggatcaggagtatcatgactagaggtttgaggcagacacaatcgcacacgtggcctggtacccccgagggacgtcgggcccgagggtgatgcgttcgccctcctcttagtccccccgaggggg

SEQ ID NO: 5566 - DNA, 5468 bp, Oryza sativa
ccgtgtcttgtgtgtttcctgtctcgcgagccttccacatacagagagcttagaatctctccctgagtccccggccgaaccggcaaaggggggcctgcgcggtctcccggggaggagccccacgctccgtcatctggcgcgccaggtaggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactcctccgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacctgcgtctgtccactcttgggaggatttgtgccaacagttcaccatgaacttccaaggaacatatccgcgcctaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccaaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgtggtggtcggaggttgccctcaccttcgaccagaccgaccacccaccgtgcattgcccggggagggtagattgcgatggttgtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacatggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccggtccccggtggccccatctctgtccatggcgacctcaaagtcgcgctcacttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgaacaccgtctcgccgtgcggccgggcgcaaggccggtccggcagaaagtgcggcggcaggccccagaacgtcaagccttcatccgcgaggaggtggcgcgacttctggaagccggattcatccgtgaggtcatccatccggagtggctggcgaacccggtggtcgttcccaaggcgaacggcaagcttcggatgttcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacaggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagaagggaggagaggctcccgagccgaatggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccaagccgaacggaggcctaaggcccctgacgaccgaagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctctgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccacagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtacagcgtgtcaattccacgccaag

SEQ ID NO: 5567 - DNA, 11547 bp, Oryza sativa
tccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacgtcgattcatggatcgaggagttgccagcggtgctctgggcaaaccgaactacaccaagccgagcaaccggggaaacgcctttcttcttgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgttccccggccgggctccatatggctggccacgggcgacggcactgagctgcctaacccgtggaacatcgaacaccttcgtcgcttctacccctgaggggagggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggggaatcggcaaaaacctacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgtcggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcagtcctcggtcccaggagggaactcatccaacgccatccatggagagaaattggggtccctggcctggtaactcgccaggacgagctccaccgctccttgggcgaggtccctcgaggatgacttaattgtcttctcgagctcctcggggagccgttggagggccccgaccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcgaaggcggaacgtgaactcttcttcggcgcaggcagcctcgtgcgccgccagcgttgcttcccggatggcgacggcggcctcgcggtccgccagatccctctccacgacgcaggcgcgctcttccagcgccatggcgcacgcctcgagggcctcttcgcgccgccgggacgccgcttcggtctccgccgcccgctgttctcgggcagcggcagcgtcaagcaccccctgggcggcgtcgagcttcttccctagctccgcctcccagctcccgtattaaaggcggagggtgtcctgcgcctcgttcatcacggtggtggcaatgagggcagccccccgctcctcctctatttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctacctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccgacctcctcccgagcggcttccccggcctggcgggcccgggcggcctcctcccgagcggcttccccggcctggcgggcccgggcggcctcctctcgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagattgaatacagccacgacgggtgagagacgaacctgcgagggggtcggttaaacgaccactttggaggggaaataaggtttccccgagatggttctgtctcccccatcttacggggccgcttcttcttgcgctccccctcgggctgcgatgttggcgcggccccctccgggcgcctgttactggcacgcgccgccccgccccctcggggaggagatgggggaagtgttcctccctgcttcctcttcccccgggcgttggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcactggagcggcgcaatccgacgacggaggtagtcgccgtacaccatggcccctgtgagcccctgggatcgcaggcccgccaggcggtcgaggacggcgtcatagccatcccccagatctaccggcgcccgccagctggagacctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacgaaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgctaacgctgtgcccggctcctcgcttctcgcgcccactatttcgccccctcgtttctcgcgccctcgcttccactaatcccattcgcccgcttgcggcgcatgaggtgggtatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgcccgtttcccttaaagaaggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccatcggccccgagggctgaggcgccccgacccctcgtgggtttttgctccgcgtgtatgggttaggtgagcacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttttgtgaagaagggcgagcatgtagattgctaagctgacacgtggtggacaagaatgaccgacgtgactggtctgataccagtcatgtcgttagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagcatatctcaaattttgtaaaattataatggtatgattccaatttttccttattattatagccacttgcagtaatgcttggattatattgctcgttgtgaactcagtggatgggatcaaatgacagggctgctggtcaccccccgaatgcatctggcattggatgttggtgttggtcatgcatacaagacgacatcaactattgtgcgtggctgatctgtttggataacctagcttaacagcaagtagcaactgccataaaacagtatataagctcaagttgccttctcacacatactcttacagtctccttaggtcgaaatctgaaggaattcaagcaaacaactatacgaaaattaaacatagttaactataattaagctgtgctgcttgcctgccactagtctgcagatctcttatataactatatatacttcgcaattcccttttctcgctttttcttattttaaacaggctttagtacttcaattcctttccattttgaaaaaacaagtacataaaagcgtaggcatggcaagatagaacacacaacacgacgaggagtgtatgaacatgtatgcttgattgattgatcagcttaaattgctttaattttgtgtcctgaatatgttttttttagaactgtcctgaatatgtagaacttcggtgcgtcccaagctgtgccgcaacgataaggccgacacggccgatgaggcacgtccggggatgcattattgtctggacaacatcaggcgcttgctaattgatcattgacggcttcttgattagaaatcactcgctataaatgttggagtacttgacatacacctctttgataagatgccttgaaaatacatatttcaaattaattcgagaattattcttacatatttcaaattacttcgagaattattcttctatatgctataaaaaccttaaaatatgaaattattactttgtgtataatctagcaccgaaggatcttgaaatattccataaagaatcttaaaatacgttttccttagacggtagtatgatgggccgatataagcacgtttttttagcagtccggcccagaaagcccaggcaaacaaaagaaaacgtacgcgcgccaaaacgaaaccaggatccgacaggaagttgacacgtcggacgccaccctgtcctacgtggccggaacggaccacccgcgtattgacaagtcaccgccgcggtggcgccacgggagccacgtgtcacgcgcccatgagccgaccggtcgcgctcaactagtggaggctccggcatgcaggattatgattgccatttgtttaatccagtctctaatgatggatggttagtgcggtttggcgtccgttgcatttgcgggtttcagcgagctagacgccctagaccctctccggctcgtagaaaactcggtttaaacacgcaactccgtgggctcgtttcgagtttgtattttgtctttgtgtgcttttagctcggtgcatggaagttgcaagcatcttaaagtggaaagttttgtgcttgccggaaatcaaatgctcagttgttcttttcactactgttatatcaatcgtgcagggactctcgagaaaacatccttttattatttacatgctatcgaaatagttataaaaaaattaactaaatagattaatatgtggtaaaacactccacaaacatataagttaaaattcaatttctttaagttgtaaaaaaattaaattataactatttaacgtatattcatagtttttttcgtttcttgtacaggttaaatttgatcttgcatatttgtagactgatttatcacatattaatctatcctattactattttaaaatttgttcataactatttagatgatacacaaataataataatgttcgagagtttagaataatttcctcaatcgtactgcactactgatacatatacgtcctgcctctcaaaaccatggaagatgccgctgtattgtgtgttctttttgcttaattaaacttactctttctgaaacataattttaaggactaccggaaagataaggaggtcgcatagtgctaaagctcgtaggttcaaatcttcaccccctccttaattcaaacatataacctccgttctaaattaaatcaatctagaatagaataagacattacctaattcaacgaatttggtaaacaaactcttatttaaatttgtttatgtaatatcatattttattttagattgatttattttggtacacaaggagtaggtgatttctaccaatttttttttagagaatatggggaattggaagtctgaaactgaactacgtactgaagcacttccgtgtaattctgcatctggtcaaaaagcctgtctgtcctgtgtgtctcctctgaattttgccggtaatccggctcccttacgtacaataggtagtgtggtgcatcttatctccacgactcccctccattactcgcacatgcctctgaattgatcgacaagtccacagggtaagtacttctgttaaagtctttcttttttttcccccgcggtgcccactaagcaaagaacaaaaatcacacagactgaaatgacggcgacccgaaatatctttactattaaaattccactgcgcactgtcaccttcctatataaacggccaccctcgccgtgcgacgagagaactcttctcccacgagaccaacgttttctactgtgcacgtgcgtacgttggtttcctcttggagttttacacgaaggaattgaagtgagctaccaagacatggacgtcgaacagctgcagcagcatgccaggaggcttctgtcgaacggcagggtggtgtcggcggcggcggccgccggcgcgtcgcctggtccggctgggcgcgtgttggaaggcggcgcggcggcggcggcgcgtcgtccggcaccgttcagctcgctggacgcgacggtgatcacggtcctgtccctcctcctctgcgtgctcgtcgtcgggctcgtgctccacgcgatcgcccggtgcgcgttccgcgtcacgcggcgcatgtgctacggccaggagccgcccggggatcacggcgacgaggcggcggcggagcgatgcgcccgggtagccaggaagaagccgggacgcgccatcgcggagaagatcccggcgatcgtctgcccggccggcgggctcgatcggctcgccggctgcggctcgacggagtgcgccatctgcctctccgaggtcgcgcaaggtcaccgcgttcgcgtgctgccgcgctgcggccacggctttcacgcgcggtgcattgaccgatggctcgccgcgaggcagacctgcccgacgtgcaggcgggagccgtttgcggcggccgcggccgtgcagctgcaggtttaccctgacgccgccggcggccagcacgagacgccttagcaccaacgtgactcaactgtacagtaggctatcacagtagttgggaacacagtgaacatttttttgcttttcttttgtcatccgagatactgtggtcattatctctgttttttttttcttttctgttatgttcatgtcgaagtgacccggttccgatgaaatgaaggtgaaaaccacccgagtaaattttactgaaaactgcaaaaatatgtaccatcaggttgtgatttggttcaggcttgtaaacccatttgcaaatattgcacggagagtgccaacttttgaatcgtctgaattgtttcagacacgatgggagctgcatctggagtgttttttttctactttcgagaggtataatactctactaaaatattatatatacaatagaactgaacaaaaactcaactcaggagtataatatacatactctctctagtcaaatttattttatgttgagtttagttctcccaacgtcaaatatttttactagatcaagtatctcttaatatattctaaatacaaaacaaaaaaaaatccatgaaattgacgatatattgtgtgatctgttccacaatgaaatgggcaacaggcccattgagtaaattcggcccacggacgtactccaggagtgccagcctgctacaacactagtctgacgttgtgactctacattgtactgtacatacgagtattggtatagtagtagcagaattagaaaaagaggaatcggcctacggtgtatctcgtactataaaagatggatgtttgtgttgtggatttgtggtggcgtgtatctccctcgtagtctgaaaaagttaactaagaacgcatatttgctaaccacgggtaattccagattcccttgctactggttaagaatcgttttgacttgtacggggttgctgaattttctttgccgatgagttatagatgatgacggccgactgatgaattggtgacttcctgaagttcaaagcaggtacgctgaataatgcgatgcttatcgctgtttctgaagacatcattttcccctctgtctcactgcaaagtgaatcacaataccatgtgccatattcgattgtttgctgcaaaatgaaccttccggggaggaaatctagtcaatttatgaatagtttagcgcaataattagctgaaatggggaggcatgaagcacgctttttgactgcaagtcggttacatcttcattccgtcttccccccggccgtccagagtgggagctgcagctaccactgccacaaacctttccgcctcactgaattattggctcacgtaatgggttctcctgaggccttccactactggaagctgcaaagcactgtactatagctagcgtgtgcctcgttaattatacttttctgttgccaataatgcagccactattgcccagaacaactgacactaatacgcgggcaaagtgatcaactgagccgtagtattcgcgtatcaacttatcatatcccccagtgctgaaagcaccaacaggatatcaacatatgctgttcttccggcatcataggatggaactgcgtcaactttctgaaagagggtaatacagtatgaattattgctgctttgcgtggctggaaaagtcaattattgggggagagttcggttctctgccggctgcttgctcgaccgaatgatgcattctgctgtagctagtgatagtgctacgcattagtgttttgtacggtcttaatcaattgtggtctgtagaatttgatggagcaagctcttcgtgtgcatccttggtccaatcttgtgcttgatatgtccgagtcacaacgcatgaaa

SEQ ID NO: 5568 - DNA, 3366 bp, Oryza sativa
tttattcgtgtggccctggtgtaaatcggtttagctcagatcgcacctcggtagaaaagtgaacccgttaatggtacgacaattggcgagttttctccccttaactttgtcttttattttgcttttctttcatttttctctctttactactgtaggcagaagccagaaaagctaaagagacgaatttcctctcttctttttttgaaggaactgaacacggtgacgccacaggagcaagtaagcaagagtatttactcccagaagcccaatccattgatcttcgtgagactttcaggagaatccaagcccaaataggtctcaggcgaacggcgaccagcccaacaggcctataattggcatccaaactaagcccaaatagacaaaagcgcggcagctggacaccttgctattcatcctggactttcgcaacgggaaactcatgggccctcaaggtgattggcagcgcaggccgccttcgccgtgctagcaggattttttttattagtttaaatttttatttacaaaaaaaaattattcaaacttatattctatccgtcctataaaaaacgaatctagtaccgcatgtgatatattctagtatgatgaatctggatagatatatgtctagattcgtagtactaagatgtgttacatccggtattagtttggttttttatgaaacggatggagtatgtatttagtagtgcatctctaccctctcttaaacggtttttatgacataacacacgactgtggatgcaagttagcagccacgcggagggaggtcaaccattttacaggcagccctcttccgctctcctaaaggactacaaatggttgctcgtaaaatcttcgtgcggccattaacatacaccaacggatatgtcacatatgccacgtcataaaaaaaatcatcttggaggaaaatagggttgtagatttataaagagtaaatttaacaaaattaaaggtaagttgatcaaattacagtaaaactacatatttaagataatataccacaaaactatatatttaacattaaatttttcccaaaactagatattcaaggtggagtgccgtaaaactatagatatagaaaaatgttatcacaaaattacgggtgtttacaactcaaacatagaaggatttaaaacctaaattttgtaattttgtaattttgtgattttttacgatacttggtcataaacctaaaattatgcaataaacttaggctgcgttcaggataaggggttgggaacccgaagcacgcattattgcataattaattaagtattaacttttttttaaataaaggattaatatgattttttaaaactacctttttatagaattttttctgcaaaaacctcacggtttagtaatttgaaaaacgtgcaggcggaaaacgagagatatgagttggaaaaaattagaggaataacacaacattagtgtcaaatatatagttataaatatgtagttttgctataatttagttataaagcatatgcagttttgtaaaatttaatcatttataaagctttgaaaaaatatttttgtttaacattttattaataactaaaattaaaaatattctgcaagcaaccggatcgctgtcagcctatcaccgcctcaccggcgaaggctgacggggtcacgggagtaggttgcgcggtcggcttccaccgcacgccagcacgccccgtccaaaccagccggtggcccaccggccattaagaaaccgactccgacgtggccgttccggtttcggcaccgaaagtccgtccgtttccgttgccaacttgccaatacccaccgacccggcacgccagtccaggtcaggtcagacaccttcggcttggctggctcagtggttcgcccaggtcgcctgcctcgtgctctgccgtgccgtgacggtgccatgtcacgttcaaacggcgaggcaaaggggaggagggtagctgagcacacacgcggtccgtgcttctgcaggcgaaggtgacgccgcagaagactagtccaacggggcggcttccacgcataaaacggctccccttgctgcgctttccgtttcggctctcccatttgtctcgcgctcgctgtctcgcgtcagcggcggagctctctagaaggagcagaggagtcccccccaagcgatcgattcgatcccctccgccgccgatcgcctcgccgaagtctccgaggtgtaagcccgttcgatctctccctctccctctccatccttgtttcgatctgatccgtggaatcgcttcgctggatcgccggtagagcttcccgtgctttgttgtccgggtgatttttccggggaatttcgcgctgttttcgtggactgtttgtgttgacctcggcgtttggacgcttgcggttgatagctgtatcctctcatgactagcaagggaattcatggcgtttgtgtactgtatgttgtatagtctgatccttggtcgggttgtatgctgcagttgcagacagcagagcagttccaatatcacttctggagatgatctcaaactgcataatacctattctaatactttctatttcctttctaacaatccgctgcgcagctagttgtatgttacttcagtcgatacttgcatcatgcatccagaattccagacaaatagttgtatgttacttcatgttgtgttttttcctttgttaacatgaaacctctgatgtgtcacatcgtgattgtgtttacctttattgcgtagttttttttaaaagatccatactgccttactgaaatcaaagcgaactcaaatgaaaattctttcttattttgcatgatcatacattcagtcccaggtgccacttctaatggttagtcccatgttgtgttttttcctatacctgatcagttccctaatgatatgatctgtattttattggttgttcgttggcatgttgtaaatgtttagtgattgctacttcattttttttatcatgcactttatttgggcccaggagtaagctcggtggcacttaagcaaaacagtgcttaagttaatatgcacaataattgatttttgaatgcattctgaatactgatatttgttgcagaaacacttgagggatggctgaagaggatatccagcctattgtctgtgacaatggcactggaatggtcaaggttagttaattttcctgccacgctgtaaaactgttagttcgcacaattgggatgttcagattctcttttgcctgctaatacatttgtagcacccaacgaattgatcatttcttcatgtggaataggccggttttgctggtgatgatgcacccagggctgtctttcctagcattgtaggcaggccacgccacactggtgtcatggttggt

SEQ ID NO: 5569 - DNA, 941 bp, Oryza sativa
catttgatttgaacatacttatctaaaaaaaattgattttaatatccaatgagtagtcgaactgcgctaactagtttataaatgcaggtattgtacttgactctggtgatggtgtaagtcacactgttccaatatacgaaggatttacactcccgcatgctattcttcgactcgatcttgctgggcgtgaccttaccgacaaccttatgaagattctcacagagaggggttactccttcaccacaactgctgagcgggaaattgtcagagacataaaggagaagctcgcctatgttgctcttgattatgaacaggagcttgatactgccaggagtagctcctctattgagaagagctatgagctgcctgacggccaggtcatcaccatcggagcagaaaggttcaggtgcccggaggtgctcttccagccatcttttattggtatggaagctcctggcatccatgaagccacatacaactccatcatgaagtgcgatgttgatattagaaaggatttgtacggtaatgtggtccttagtgggggatctacaatgttccctggtattggtgatcgtatgagcaaggaaataactgcacttgcccctggcagtatgaagatcaaggtagttgcaccgccagagaggaaatacagtgtctggattggtggttccatcctggcttctctcagtacctttcagcaggtatccattgtctcaatgcatatacttttgtttcatctgcttaacgagattaccaaactatgtgtcttaatgcatttttagtacattgtctgcaagacactgcatccttgcaaacatttaacaaactttttggtgttgctttctttgacatgctccttgggccatgtgctgtcgactctgtcaaagggtggagatgtacttgatctttccattatcttaaaacacaaaggccaagacagg

SEQ ID NO: 5570 - DNA, 691 bp, Oryza sativa
ggtcaaactatgctatgattggcccatatgacgcagatggtaaccgtattacgtacccttttcttgggggactaaactacaactctactacccctgttaaatttacaaaactagcaaaaccacttaaagtcggggatacacaggtttttggagaagaagttagtctatggaacggacaggtaccgaaagactaccaacgtagtattatcatgcggggttataaaaactcgttcggctatacttatccccatggaacctataatcagcttatgcagatgaggacatatgatattggtgcaaatgacaccacaacttacaagattacgttaaacaagccatgggcagttgccaacccaaataattcaaatgggaatttcccactagggcatacacttaacccaacttatgacgggtccacatatttgtatttgaatggtcacgtaaatataccagtacctactacgtacaccaagaacagccatttggattagtggctcttttgagtttgctaatacaacgattatcccagtagaaacaaggttttattcaacttggattcttggtgaaacgggagacaacaaggtggaaaaatctcggctactggtttacgtctacggaactatacagatacggtttaaaactaaacgaaggacctttgagaaaacacaagaaaactgttgacaaagctcaa

SEQ ID NO: 5571 - DNA, 8344 bp, Oryza sativa
ggctcgctgttagtcgtcgaagtcggcgccgggcttgccgctgccgcccacttcccagtgccgctaaccgttgcaaccaccgtcaaagctgttgctgccgaggggctgagggcaatttaatctttttgaaatttctctctcctcttttgcccggaaataatagaatatcgtctcgggtgtcctatagaaaattacatgaattttgtagtgtccatcagtggcgatgcaattttatgattcttctagccaattacataaattttgggtgtcctgtagcaaattttgccgctataaaaatactccatataaattttttgataagtaagaacaaactttttatatcatatctaaaaataaaaatactccatataaattttttgataagtaagaacaaataaatttctacactccaacttatatatttcatcatactaaaaagcataatggattttttatagcactttaatttaatgctaaactagcggtcaactaacgaaaaccatatggaatagatctaaactaaaattcaaaagtatataagcaaatgagcaaaacttaggagtatagaagggattggataaaaatttaggaatatataagaaattttctcaaaatcagtcgtgcaaatcgatcgatcgagagtgaaataaaaaatcatggatacccacggttatctttatatttgctgcagaaaccttgggatataaaactagctagtttttgctagatccgtagatgctgccagaggaatataattgcacatgccacgctagtgttaggtactaataaattggttatacaaggttaaatattctggtgtagtgttatgcattcttagtttagaaagaaaaaacttggaagtgcttgtgtgtccaatccttacatatttgaacattttctgtccacagggcataactgtagaaattcctaaaacttcaaattggactgctcagaaaccttacttggaaaataaccccaagatgtcaagcagtgttattcgacaatgttcattgctgcttttaattactttgttggttatatgttttgaagggaatgatatatatggcgattagttatgtcatggaaaattactggaacatcgaaaagggtaaaaatacgacgcaggcagggactatttataagttggaccccccatcaccccatggcatatcattactaggaacagcattatcacaagcggccgaaaagggtcttcacaggcggggcggcagtccgcctgtaagccaacgactgtgaagatcaccgatcttcgcaggcggggtggccgtccgccagcaaagataattttcgcaggcggacgttggctagtccggtccgcctgcgaaaataggaatcggccacctgaaaaaaaaaacttccgcctgcgaagataggtagaaaatattgaaatttaataataatttgcccgtaaattacttttaaattatttaatataaattcttgcaggtagattattatgtacatatattagaagattatcaagcatttggtaatgataaatgtacatatattacatatctcaaaagtgttgccaaaatatatatattacaatatttttttacattgtcactttaaatacgccatgtagttaatacattatggcatagcactgttccactcccgaagatccttgaattcgtcacttgtggctagggcaccctctgggtcgaagaaatctcctttcacatgacagcactcatggttgatgaagtggcacagatcacgctggacatttttgatgcctgtatcatcaaaacttgttcgatattctaatcttggcaactgcatgcattgaagataaacaatatattagtatcataaatatgtgaagctgtctagcacatagtatagagacttatatcctctgcgttagtcctgtacctcccattaactctaaggaattcgcaagcgtaatacccgcaaaggatcgttccttgcggttgcttgtgatacttcaggacatatcataaaaaaatagttaaaatttgcaattagtgaaacaattggtatacattaagtgagtggagtattaccggccaataggtacgtactagcagcttctcccttgttcgggtctgttctccacccatgaacttgtagtactggtacactctgtatggatgtcgtaccgtttcacattaaggaggatatttatttaaaatacattcatataaaaatgtaagagtcataatcacctactactgtaagattgttagaaattctttgtatgactggtgtttgtaatcgagagggtccaagactaacacagctccgtctttagggtggatgagtaaacagatataatgatcgctacatattaacaacatcatagttagttagtaccagctaaaataagacatatgtgtagaagataaatgtatcggacttaattaaaattataagcggccatgacgactctcttattttgaaagtgcaagaaggctcgtccaatgtactacgcgacagtaatcaatttctccttgtgcaagcccttcttgtattcagctatctattttggattcttgcccttcagttggtcagacctggtgctagcctcacggtatgttgtgtttggtagatccgagttggatccaagaagccgataggttcttttttcttcttagcatccatgtattgcatcctacagaagaagtttgttagtaacaatcacatggatttgtattgtacatatttttcatataattaattaaaaatcatactcacatgcaccaaacaccgaagtagttgacatccatcttatcccgacgatatatggcatggagatctgagaaatctagccatacgtaaccttcttcgccgaaacaatctgtcggtgatcgagctgttatattgcccaagcctttcttgctggcctccatgtagaaggtatgtaaccttttcatctcccatggtccttcgttcagtgcccattccggcaagagtgctttcccatgttcgtacttttccgggcaatcatcggttgcgaagtatgttggcccggctagttcagcagccttctaggggtcatcatttctgagcttggcacgttccttaccccttctgaagacggttaccatgaacttctccttgttctcatctttgacttggagtcgtggctcctaagcactctaggcacctcagaactggtagtggccttctcagggaccgtggtctcttgcacctcagggtctttcgcaggagaagggttttcaaatatttctagctttgtaccgtcccattccaatcctggtacttcttctatttctgacccaactgatgccacaaattgcacctctggttctgccactgtaatctccataggcacattcggcactggaatctccatggctaccgccggtactgcaatctccggtggcacttgcagcactggattttccttttgcatcttgggttcctccgccttatcagtcaccttcctcttaggaggtctcggaggttttcccaaccccggttttggcaccacaggtttttgcgtggcgtcggtgcccaatccaaaggatatgtcattcttgtgccagagaattacaaggtcgaccgcatccccaagtacggatacaccatctgcagtcgagaagtcaatgtcgtaggactcaaacccttcgtggaccacttgcggctgcaccttggcatacgcatcgggtatgaattcttcattgtatgttctcccagggatagcaatggctatagcggcctcaagagttttcccggagtgtccaatgggaacgtgcaatctacagggtgtattctccatgaggtcatcgaaggggtaatctggctcatgttctttggtttcggggtgaggcaaaatcatgtgcttgacgcagaaatccatcatttgcctttcaaactccgcagccccttcgtctctaagtttatccttgtacgcttcacgcttcttgtgggggtcatgtttgaaccctttcttccaactcatcttgctcgacacacctcgaacccttcccccatgctcaggagtacccagcaccgtacttagcacatctttctccctcttaggcttgaaaagtcctttcttctctgaactggataaattctctattttatcggcaacgctctgcagtttcggatcttcaaacgatacttttccttcatccgtgatcttcagagttctagctcttacccagtccttgatctttgtgtccattcctccattagtaccggttgccccttcttcctcatttcctcctcctcttttgtccactgctccacctttggtgcgtattccgcggagcctaagcgatgaggaaatttgttcttcttggccaactctgcatacttttggctcctttgaatttcttccggggagttcttcaacgtcagaaagtcatcccactgattcggggttatgttggcatacgtccaaaacggtgtgcatcccgtcttcacaaatttcttgcttaaggtggttttccaaccacgccaagacttggccattgtttgcagtgcacagttccacactgctatctctgatccatctaggaactggaaaattttcttcaactctttccataggacttccttatccccattcgatacatgatcccagtccttgaccgtgatggggatcttttcccttactattatgccacactgtgaactgaattttgcacgtgcagtgttaggggcgagcagctctccttctggcgaaacatgggtaacaacatggaacccttcatcctttctattcatgcttctttcgcccttccttttcttcgcctttgctgaccgttcgcttttctttgagccggttgtgttagctggtacctcgtcgtctttcgacataacttttttcttcggctaccgttttgatcgccgtggcgccgtttcctacgagaaggtatacatgaaagtttcgaattagctcgggctaatagttatcacgatgaacagtttacatattaagtttacttaccccttctttagggggaatgtagtctttgtcgtcttcttcatcgtcgacctttttccttctcttcgggctcgggcttgggcttggacaaggatcgcttggcaacgagtactcatcgtcttcgtcagctatgtcgttatcggaactatcttccggtgggaccgttggtaccggagcaaccacaacagtaagggactgctcttgctcacctaaacccttctcttcagtccctttagtactatcggccatcgtttcaaacctctaacataaaaaaaagagttatcctccatattttaaaatactcaaattagtataaacaactttgtacaaaaataaattgtatattaacaatatgtcgtatgaacaaatttaaattgtctgagattaccatatattaacacgtagggaaaatagatatgttattaattagtacttactattatgctaaattaattagtacaaacaaatttaaattgcgaaattaattactacttacaattatgctagaatagatatgttattaattagtacttatgctattaattagtacttactattatgctaaattaattagtacaaacaaaattaaattgcgaaatgttattaattatacttactattatgctaaattaattagtacaaacaaatttaaattgcgaaatgttattaattagtacttactattatgctaaattaattagtacaaacaaatttaaattgtgaaattaattactacttactattatgcaaaattaattagtacaaacaaagttgtacaaaatttgatatgttattatcatgtagtgcactaattcacaattacatttcctcgacatgttaacatatcctccacatatcctccacattcttttaaaaaaaaatgttaacataccctcccacatgttatttaacaaatatgacaaattcacatatactgcaaatttgaacataccctcccaatttcattcacatatcacccacattcccaaattcacattcacaatcaacatataacccctcattcacatatcacccacccctcattcccattcacacccacatgcacacacatatataccccctcacacccaaatgcacacacatataaaaagaaacacccacatgcacatacgtccgtggacgacgaacggccgacgacgagcttcggtcgtggacgacgaaggaagggccgacgacgaggttcaaccgtggacggcgaaccggccgatgaagccgttcggccgacgacgtcttcgctcgtggatgacgaaaggccgatgaagccgctcgtggacgactgcgagagagagagagagatggcggcggcggctgtggagcggccggcgacggtggagaggtcggcggcgcggtggaggggccgggggggaagcagccggcggcggtggacggtgccggcggtggagcgctagcccgcgagcttgcgcgcggtggacggcggtggatcgatcgtcgacggcgcaagctcgaaggcccgtggcgcgtagaggacgacggtcggcggtggcggaggacgacggtcggagggtgaaggtcgtaggcgggcggcggcggaggacggcggaggcatgcgggggcgaaaaaatttggcagcctgacggggccaaaatttatagggttcccgccgagacttagaaattttggcaccgcgggcttgcccttatatagggaaatgatctcagtccgcctgcgaagatgtaaaccctactcggcataataattttacaggaattattacaagaatgaccctatctatttcagaattattttaaaatcatttttgtgatttgaaaatgtctacagtagtcgtaataaaaatggtaattgtacatacaaatagataaaccttagtattactacttttcaaatgtaaatattacttaaatgtttcaaacattaatattactactttaaaaaatcatatagtagcaattttatatgtgcacttaccattgttctaaaactttttaaaatataaaaaactgtaaatgttaccctacaaatggtaattgcacataaaaattagtacaaactaatatgcaaaatgttgagtgcaattgttcgtcaatttgcgatatgatcacacatcaccttacataccaccattacataactactaacttattagatgcttacatgcgactcaacaatcattaccctttaacattttttcccacaccgtccgtgcgcatgtaaggcttcacggtcttccgagtagatgtctcgacattcttaatcttctgtacaaactgactataaagtggcatactatcgtattgactgtaatcttcgacatcttcaaccccagacttcgtttgagggtaatctttaattccacaaaagatttttgggtttttggtcttccctaccattcacccctcctctggtaggtttgtttggtcttgtgcgatcccctccacacatttgaatttgacaatgaattcatatgtcatcgtgttatcgttccatgttggagtgaattttctttagtgcacaccctgtacatgatattctttggattgctaatactcttctttctggatcagcatctgtaggcagtactacgtgccacgatacttatatgttggagtattttgcaatcaacaattaatattatttcattttttgcattcctgtccaaactttcatgtatagttcctactacacttctaaggtaccaaattctgaaataaagctcattgtacttttatgatatgttcactgatcaaaactactattgcaagtctgatatgttcaactgtacttctgatgtaccaacacattagctttgtttattgattgaaatttatttttgttctattagtaccgctgtccaagtgtgcagatcaattcgtaatcgatcagcaggcctgggtgttgcttcaaggtataagtggacttgattgaaccatatctatttgtttgatccttatttgcatataaacagttgataggtactccctactatggtatgttgcggggtatattttaattaatttccttttgagatttattattttataagatggggattgttcaactgcaactgatttcgtagtctattgttcagacatttcatttaagcccatccatatagtttgtgaaatataacagttgggccattaagagtgtgtaaagaactcgctgagtcattctatcaaatgtagagcaagatcgatgacatgcgctcccagtattacctgacatactattatctggcttctttggtaaattcatctgaatcacatactagaatgttaaaacgacactgtatatagtgcatcattgtttgaatgagttatcatcaaaagcatcatgctgctagttataatcaatgtagaaaggcctgaatttatt

SEQ ID NO: 5572 - DNA, 15621 bp, Oryza sativa
aattttctttctattgcgcattttagccatacttctattgtattttagtatgtggattgggatgggtggttttagtctttaatatgcgcctttagtttgaacccaggcttggagaaatcctggttccgccactcatataagcaaatgtatatattgtgtgacacaaatttttttcagtttgaaacttattttactcaacctccatcctctctctctctctctctctctctctcacaagagaattgtcatcaaatgtattgattcttatgcatgctatctgaaaattaatgttatgttctcaggttctgaccattaaccagtggtacacattctcatgttttggaaagagcacacaaataaactacaatctcattgcacacaacacagtgtcctttattggttgtctccagttgcgtttacttggttcctagatctgccattcttttcttgcatccacaaccatggaaaattttcgtatactggatttgcaacctacctgctttatgctatatatagttaaattgtatatggcttgattaatttacgatattttaagtggctgagaattgggtgaatttcttctatattgtaagcaccttgtggtctagggtctcttatatatagtactactgatgcagaggcttccctgtgcattcaacgagttcaatgctcgcagatatatcttctggttgtgattgctgtctttatgcatctctattgttccttggccattgaaatgattttcgatacataggcatcatataatcatttgagtatactgttggagtaattagtaaagttggagctgaatttacatcagatgcatctgtactaagcaccaatgttcttgattttattttatgacttgtaattgcctacttttttgtgacctggagctcaaattagaaaatgatgttaggaaagcttgtgattcctttcggcccaatctgtagttatttcttttctgttaattctgaaaagttgaaaattgtttttcatattctaacaaaaaaatatgcatacatctatgattgctaagcacataatgccatgcatacttccatatgatatgctttagatggtagaaaaagttattgacttaactaaaaattgattctgaattttttttctttatattcctatgatatgctgacaatagctaatcttgactcatttgggcccttcatcctcttctcctccatcgtcatcaacagagctagacaattcaagtcagtttttttcacaaatttctttggctatatggattatatacaacctatgtgaacttattttgatgttagtagcatacacatttctatcaactgattcttctgataaatggaaatcaaaccgacagaaacaaattactaacttcttctgataaatggaaatcaaaccgacataaacaaattactaacttgaaaggattatctttagaaaaccttggaggaaaatgtactgtggtagagaaacatgacctaacctccattgcaaacgtcaatgctaggtagaaattgttgacggtcgttatagaccaatttcgaccgtcaatataactaaaataacggagaactagctatgcttacaatgcatatttgttttagaataatctattttcacttgtacttggattctatttgcttgtagagattgatacataatacgaaggagaatcgacaacaaaacaatcgaacaatcaatcagccactgttgggaactcagaaatgacatgatcaaataagcccaaaattcactgttctagattaaggagcaaacgaggagtcatcctgccaaaaatgggccaggttggcccagcccatggttcggccgaacccactgcagcgccatttgatccagggttttgattggatggctcagatggacttctaatgacggttggagggtgttaccgacctttccaaccgtcataaccgtcattaatcagctataaaaggagctccccttgttaattctcccacacactcaagcaagctcaacatttctctctatactttagtttagtattctagtgctaagtggagtacaatagcatagctctcggagtcctcggagtcttcgggggaattcgagtatggctctagtagtttttctttattctttcgtaagagtttcagaattaatgaaatattattctttatatactctccgtactttagtttatctgagtatcagctttactttatatttgtattggtatagttgtgtagttagcctaccagagaggtgcaatggtgtgggtttagtctccgattactcggctgctctatgtcatctcggaggatatagagtagtatttaataatgtagatgtggtgtttagattattaagtatcattatctgggcatatatgctacgggtcagtcgaggtgggccgctaatggtgacagctcggtatgggtattcctcgacgctagtatgtgtttctaagaaactttcctgggaaggatactcctccgtatttggccccggttagaggccatgacacgttgtcgtaagaaactcggcaacccggggtggtctctcgaaacaccaggagggcacttttaggggctattggctactgttggcggctgttaaatgctgattctgtaccgccaacatctgcataaagttcagataataaaacatttaacatagcgataggtgcttaatctcacatattccacagggttggtgtatatttatatgcagataataaaccatgatgttgggaggaaatatagactaaagtgaggataaatatgtatccatacaaggatgggttgtgaacttcatagaaacactagagaatcagcccataacaccgaagaatggatagaggaggaccataagaggagccaggccaaaggccaggccagggggggccaacccaggttcgtggttcggccgaaccctggtgagcgccgttggatctaggtttttggcatggacgctccatatttctccctgatggcggttgcgggacagttcgaacatttctccttcgccaaccgtcatacctacctctacataaagacttcacttcactcacttcaacacacacttccaagtttgagctgaattataagaggctctattgtaatatattgtatactagaaaggaagagagtaaagtagaagaagtcggaagaattccagagttgttggtaatcttctcctatttcttttattctgtttattactctgaattcaatataatattcttcctgaataatttagatttatcctgtgagaattatttcttggttagttcgtaagttgcatacgggattattgttcactataatcaactaaaatatagtgatcgctttggtgagttataaacactaaagtagatattaattgcttagacgtggtgttttggtaattattatccagtaattgctgcgtatcccacagtatgtttgaggtaggtgtagaggtggtgacagccttcgagatcacttaagtcctgcctgtctgggtacgtagtagagcgacatctagaaacagcgggttgctagtgcctgaagtattgaattaggattaaagttaagctttccctgacactgtttctcactagaaaatcctctctatcctggcctatcatttgcttggtgtccttaaataaaccggaggaagatctgaccacacacgttcccttgaattcgatacccttgtaatactctgtaggggaagtgctacagcggtatatccgtgcgcttgcgaattttatctgtaatcgtaagaagtaccaacagctacatagttgtatactagcagatgtaaactaaaattgactttatactagaagtataggaattgattgcttttctatttcttcttccacatagtgtaggattgattaatgagagatatgagttctttgcttcgtgtcactctactcttataaatatattaacccctacttagaccctaatcatataagtggtgtgcatacattattagcatagttctctcttacagtcttcccctgggattaaataaatacgataacttggaatactcccaggtgaaatgctacaatggtatatccgtgcgcttgcggattcttgtaaccatatatataccaggaccatttctagtgccattgttgggatgcatgcctggtatgatatgatttggtaagattgtgatatcgtaatcctgcacacgcatgagatcaatgcattgactctgcaccctaaacactgaccagtttaaaaatccattctatccaattaagcatttatggtaaaaatagaatggatgcgaaaattataactagccaatataggatcggttcaatatatatatttggagaaaagtaaagcattacattatctagtaattaacaggaacccaaaatagtagaccaattattttctacttaattggatgagtttacctatcatagatgaactcaaatgatggggattcaatggaataataaatcacaattaattcatagatgaaatgcttgctatctgttgcctgtagcctccgtgtatatattggcttagcctagatgaaatgcttgctatcttatatgaattgataaacaggatcaatggaagagaagagcattcggaacattgttccaatacagtccatgaacacgacaagtgaagcgccggctattttcccttatccgttacaagagagtgtgattcatgcacttgctgcaagggaagcaactgctttgcatcgtcatgctgctacgagtcaatatgtaaccagatgcaaccaccaaaccattgcataaatcggcggatctcgtattgcggttgtggttctagtagtatctaatcatcttatttctgcaataataaatggatggctgtcgaggagtaatcctctctagcgggagaacgtgagacccccctttgtgagttcggccaggggataaggtgcgatgatcaagagcctatctccgccggggatctagctaacgaggtggttcgcaagcgagtaagagacaagggattatacaggttcgggccgctaggaagcgtaacaccctactcctatgtgtggaattaagcttgtgctgttacaagggaaatccaaccctagactcaagcttctcaagtgttgtcccttttctcggtgggtaaggtcctccttttatagttcaaggggataccacatgcaccgtctgtatatatttcatcattggagggggggggggcacacaacctggctcaagccaccgtccatgccttcaaccggaagcaaggcggtcgttcgcccccaggtgggtcccagcggggacatccctgtcattccctcttaatttcatggagacttttgtggattcatctcttaatttcatggagacttttgtggattcatgcacagggggcacgcttggctgcatgccgatgggacggggcatacctgcccccactccgcctaacacagggcgggacgtgggtgcgctgccacctgtcccatccgcctgcgactggtcataggccggtcaaggccgattgatgcacgtcaatcgggcggcgccacacgcctacccacgccgcataaaacgcggcgagggacggttggggcgccgctcattaaagcgcttggcagcaccccttcctccgcctactcggccgccatgtggcagccgagtgagggcctcggggcggcgcactccaagggcccgaggggtgcgacggggcaccccgaggccccttggccacttgacgactgcccgacctcccccgagggggagggaagcaggctgcgcgaccacgtggccagatgaaaggattctttccctctattgtgcgtacccccgagcccatatcaccgatagtagcccccggcactacgtctgaccgtgacccctccagggctgtgtggttcgatgcctcataacttctgtcttgtgatggtgggtcccgtgaggagttcaaatagccgtcatcggtatacttagttcaagcgcccaccatgatgatgactcgactgctaataactgcgccacgcatgggggcgcgtagggcgggaagaccggggggtctgccaggtcgtgcctagaataattatctgccgtcgcgttgactacctgactatcaggtgtgcgaggaaacgagactatcggtgggcccgcccagccacaaccgtaatcatagcgcgccccgcgtcgattatgccgctgacaggcgcattaaacgcggggtgtggatttagtggggcgagtgggatgagcgggcgcgaaaaatgaggaggcagctgtggttatgggaaacgaggaggcgggcgctagcgaggcgagaataaaaatgaaggaaggaagagagctcgtatccttcctttcgccattatcactctcgcacacacgctcctctgcccccagcgttccacccttgaccaccgcgcttcactcgcccaacttctcgctcatcctcgccgattgccatggcccaagacaccggcaacgccgttctcctggcttcgcgcatcacggcgcagaaacatttgaacctcatccgcaggttcatgccgaagggcgccgtcgtgagggtgggggagtcatggcgctagactcggaagcccggacaccccgtgaccgccattctcttctttttccttgctttcttttttgtgcttttgtaatggacgcggttgactgcaggctttcgtgccgcccctgttggatgtacataagtcttcctcttcgcatttccgcactctttttatccgtgaatgcctgcgacaagggaggatagggaaaaacgcgcagtcaatttccttgcgggtgaatcgctgttttcgttccttcgctcccccccctcgggctcgttcggatatgggaagagggttcgcgcttaacccccggcaccaaagtggcgaggggcagagccgtcaccttgggagaaccgctcagtggggctggccagaccggagctaggtgaccgggggtcggggatgaccgtgtgtaggtccgtccgagcccccagggttcaccgcagttcggggcgcggcccacgtccgggcttccctttggcacttttcaggttgcccgacaccacctaggggccacggtaaggacgaaccacccctaagccggaacgagacttgaggaagggaacgaaaaagtacacaacaactttgattaaacaaaaggatttcttgctggggagaaatggtaagatacaaatattgacaaaggcagcccccggccaagcccgcatggcccgaggggcgtgcggggttggcctgataccaaaaacggaaaaacaatcaacatcacgggtagaagcggcgaaggtgctcgatgttccaagggttaagcagctctgtgccgtcttccgtggccaatcgaaccaagcccggccggtggacaccgatcactttgtacggtcgttcccacattggtgaaagcttgctcaatcctaagcgcgactggacgcggcgtaggatgaggtcatgggacctatagtgaccgggcccggacgtggcgctgatgatagcgccataggctctgttggtagcgcgccgcccgaacggccgcacgccttcttcgctcttcgaaatagtcgaggtcattgcggcagagctcgtcctggtccgcctcattgtacagcgcaacgcgaggcgagcccagggagagctctgacggtaggaccgcctcggtgccgtataccatgaagaaaggggtttctccagttgcacagctcggggtcgtccgattggcccacagcaccgtgtgcagttcccctacctggcgcgctagctgtcgaggagtaatcctctctagcgggagggcgtgagaccccccctttgtgagttcggccgtaggataaggtgcgatgatcaagagcgtatctccaccggggatctagctaacgaggtgagcgtatctcactagtggagataggcacatctatgacaatctacttttgtcacggaagacgcgcaaatcgtcataaagtaacttctatgacgaatttatgacgaaatgggattcgtcatagaagtcgcgtcacatatgtttttctatgactaaacagtagatttcgtcatagaaatgcttatatccatgacgaaggtgctcgtcatagaactgctttccagctggctaggacagacgtcgtccatgccacgtggctatcacacgtggagtccatgttggctgtgatgtggcggatgacgtgtacgccacgctggatcatcatctcccgtacgctagagccaagtggcagtcgtatttaacgccacgtgttggcatttggtatgtccacgtggtggtgcaagctgatgccacgtggtcgaacgtggtggcgccacgtggcagccatattaatgccacgtgttggcatttcttatgtccacgtggtggagcgcgctgatgccacgtggccaaaggtggagacaccacgtggcagtcatatttaacgccacattgccgaaggtggaggcaccacgtgctctcattttgaagcgccacgtgtacatatctgatttgtgacacacgtctttacctgatgttgccacgtgttgatttgtttggatgacacgttagcacagtagggatgacggcccgctcattttttttttcttagcccagcccatttggccacatacttcacatattgttgtggcccatcccactatgagatctaggaaatttttagcattcacccatttcaagcaacaattaatcagaacttcgcagcacataagaaaataggcccaacatcaagattgatcacatggacaaacaatcagaacttcacagcacattacaaataggcccaacatcaacatatatcacatataccaacttcacatagcaccatattacaaaaaagttcacagaacctagcacacatatgttcacattaagtccacaaaagtttgccataggatgacattaagtccaccatagcaccaaacatcatttcacataatcaagtccaccacatgacaataagttcacagaaccatcaaacaactaatataagtagatggagttcatcacagtgcagaagatcataaaggagactaggacagatttaagttaccctgggaaaggctcaagatacatcgaaggagcaaattgttctcttcctgctgctgcttgaactctgccaactccttttgagtctttgccagtgcttcatttgcaagatttgcttgttcttttagtgcgacaacttctgcatggagaatggctgaactttgcttttcagctgcaagttcttcctgaagtgctgcttctgtcggtgtcactgatttcttggagctcatctgcagaccagcatttttcaaaaacgtggtattggagttgtcccgagagagaaccttggacacaacttctgcactagttcttggtgtctcaccatcaggtacaggttcttccataatagctttcatacttgactgcagcaatgattgaacattagctatgaaattagatacatgaaaaactggcagctgcataacacattcaaaatactggcagctgcacaacacattcaaaaagtcactgaaaactgatggaaagctaccaggaagcacaaactagaggtaaggaaacttgtatagaatgcaaatttaaccaaatttgttttccataagccaaaacagaaacaaattatatgagtaagccaagcattcccatatttagaaatattgcattgccctcttaactgtgaaagagaccagaaacattttgagctctaactatggtagaatgtaattattttctatctagcctctagcaacaatgcaggccaaatgtttcttgacagaatctaggatactgttttagcatatatcagaaggctgactttagactatatttgattagctttcatggcagcttttgattgatggaacaccctggtagctataaaagaacaaggttttcccctcaactactttcataaaatttggagggggtgcaatgttacttagcgttggttattttctattcctcctatgatgcctaaatattttccctagaaaccactaatgtttagaaagaaaatactagtgtggagtacataatccctcataattaagtttacttttccaagttacaatgaaataagttttgaagtagtaaaggctgaaatatattcagtcttatgttcatatgattcaaaacctcaatacatgcaaacaccactacagcagcttaggtaaaaatgagttttcatgaatcacaccctcaaacccgggatattgataaaaatacaaactgcaaccaggatcaattgatgaaaaaatgtttatgtagcttatttggcattttaacccaatctcaacttatgttgtatatggtaagttgtctagcgacaagtttccagcagctacaaatttagtttggtatgtattctaacattgttagagtctataaattccattaagtctgtaatgatcttagctgcaaatatctctgcacactaaggacagaaattatcctatggatgtaaatataaaatgagctgaattaataatatgttggcataggtaacaaggaattgagttcaatgttgtaagaatatattgagtgacttacaattgcatctttggcagcatcacttagacctttttccctactggtatggcagtcctcaaaggcatccacagcatcaagctctacaaccttgttattctccttctatttcagtacagaaaatgcagatcaattattttatatatctattacattagataagtggttcttaactacaattaatgctaaaagataatgggaacttacgtaagcgtgcaagtgtgcagcatagctgcgagatcccgtagcctgatggaacctaacattaagccggttttgcttgttctgttcagagatttgctacaaaagatgtatgtgttagacatagtcgcaggtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgcaatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtactgcttccaatgagggaagacaggaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaataataaatttctcttcgttgaactaacttgccttcaacatcagaattggtttgctgtgcaggttgctcttcatggttggcatcatgtccatatgaccagtccatcaccgggctcgggggcctgttcacatcattatcttgaagcaaatgtccactgcccacatcttcatcaccattgttttctgtttctggaggcagttcttcatggccattacctttaccttgttctgctatgagttgccttttcgctgaccttgttgagactccaggaggcatttcggttggagcacccgccctcactctctttgatatccttactcctggtggcatcttgagggtaggtttcttcttcgtcgcacacttctttcgtctagtttgtcgagggtactacaataataaacacaaaagttgtaagcatgtgaataaattggcaacaatcattaaaaaaataatcaaatgctgcacaaattaaatgcggaaaaattattgcagatatcctagccccccccccacagccaagatagaagaagcacctcaatcattatggggacgggctgctccgcttctaaatatgaatcatcatcacactgaaccccttgttcatcatcttcagggagaaactctgatgtgtcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccgcgttctttcatattcgttttgtgcaggttcttacatgaatacacatattttaatggtcagaatactagatggcattttgatggcatttcctaagcatataagcattttcagaaacagaaacaataaagtatctaggcatttgggatgaaaaaaaaagagaccatgctcatcaacattggggatttaatgatcaatggtgaaaaacaactttacttcaatatctagtaaaaacaacagggtgattcacttttccattttaaaagacaattttgatgagaactctggaaacacttttacagtgaacaacattggtcatataaatgatatagccattatatcattctctttcacctaataaactgtatctatttatacgacctcaatcggattgcacacagaaaattcttaatagaagttggacggcaaatcaatccacatgatgtataacatctaatagcttgagacagtacacataaacatctgagcttgagacgacaagataattttgcgtacctcgtgctactggacgtcgacgtcttcccatcggctaggtacggcgacggtgcagggaccttgtcgatggggtacccggctccggtgcggcagtaggcgtcgacggtgttgtgggagatggcttcggtgcggcagtagtcgtcgacggggtaccggctccgatgcagcggaagtcgtcgacggcgtagtgggggaaggatctggtgcagcggtcgtcgtcgacggggttgcagcggaaggcgtcgttgcggcggctgtcgacgacgaggaagtaggggacggatctggtgcagcggtcgtcgttgatcggtttgcacgggaaggctccggcgcagcggtcgtcgttgatggggttgcagggtaaggctccggtgcggcggtagtcggcggcggctctggtagagcggcgccccgatggtgtggcggctggatttggggattagggtttggtgggtgagaggctttgtaaatatatagtggttgcacaaatgcccctgggtgttgttttgctcttcgttagatggaggataaaagtgacatttcccattctgatttgggcaaatgggcggcaatggaatcttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccattagcaaatgtttactgcagcaccacatagtcaaatcatggcgcaattaggctcaaaatattggtctcacaatttacacgcaaactgtgtaattggttattttgtctacatttagcactcaatgcatgtatgtaaacattcgatgtgacatttttggaaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggcgtctttttttaattaattggcacctatgacaaattaaaggtgttggtttttttttaaaaaaaaagaaaaccaacacctatagtattggtgtcagctcttctatgtcgcgttttccatctactccctatccacgtcgcgaaatttgccgacgctttccctttcccgtgcgtgggagccgccgccgctgcactcgatggatatgatcagtgatagggaagggtgctactaaccgggactcgtctctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccagtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcagtgtttgtaggaaaaatgttggaccggccggttttaatagaatggaccgggtggtttggaccgacttacccctcattcttatcggtagaactgacatataacgagggtacaatcgtaaatcaacacacatataacaacggattcagatccaaaccaaaccaaatcgtaacaaaaaaaaaagagcttcctcctccatggcggtgagaattagcaggaagcgcaggagcccgccgacgcgtgggctggggacctccacgacggcgtgctggagcgcgtcctggcacgcctcccgccggacacattcttccgcctccacgccatctgctgccgatggagcgcggccgccgcgtcaccacacctgcggccgcatcccgtctccgactccgaccgcatcgccacagtagtagctggtccaggtgccgcatctccaaggccgatgctcccagcgctgctggtgaagaggacctggtgctggccatgatcgagtagcaagcttctggtgcttatgctgcttgcttcctggatgtgggcgacaacagtagcttgagaagaaatgatacttctttgtacagcttggtgaattcagattgagatcgtgaatgtgaataaacttatggctgattattgtgttattttgaaaatgtgatgtcgcgtcccaaaatgactctaaaatacatcctcgaaattatgcctagaataattaaaatccttttgaaagcctcccacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaaatcctaaaaagtcttttccccc

SEQ ID NO: 5573 - DNA, 20983 bp, Oryza sativa
cctcgccggcgcatcaatggcggccggatcttccgctcccgttcccccctcatcggccgccctctctcactcccaaccctatataaacactccccgtgcctccctccaccgtttccgccactcgccgctctctctctccgccggaatcgagctcgcgccgtcgctctctctctccgccgtcaccgccgagctccagtccgccgccgtcgtcgccccggaccttctcccgcttcggcgccgcctcctttggtttcgccgcaaccttgccgacctcgtccacccctccgtttcgcccgccgaccgccggaacgccgccgtccccgtctacccgagccgcgccgccgccttcctccgctccggtcgccgttcccgtcgtcgccgtcgacccggggtgagctgtggaccgccgattcgtttcccccttccctcccctctctcgggcgccgctccgccgcgccggtggtcgccggcggcgaccatcggggcgcgggtgcgccgcctcccgtcggctgtgccggcgtggccgccttcgggcgcgccccgcggctgccatgtggggcccggccgtcagccgcccgcgccctcgggtgcggctgacgcgtgggacccacggcgccggccggtgtgagccgggtgcacccggtccaccgtggaccgtgaggctgccgcgtgggccctactcccgtggacccggtccgcgcgcccctcccctcggctgacgcaataaatccaaattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcatgtagacgctgcagcttcggaagatctgctcttcgtggaggttgaactcggaatatgttcacatcatctttgaacatattgaatcccggtttataaaattatgttgatttaaattattgcattatcgctttatttaaattcccgcgttatcactgttttatttagccatgcctatttacctttgttatgaccttattattgttattgttattatttccttgttcaccctagattaaacaaaaccccaactagtggacactctactcatggtacctctagtatgatgttaggtagatgcttcgctatttaattaggtaacattaggcggttttacaactctagactttgggatattcatatcacctggacactttggaattgttggagtattgtggaattggattcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctccagggcaaatgaaggctacacgagctgcggcccggtagtcgagatgtcgtggcacagggccggtgtcctgctgctaggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttgtacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggatggcttgggacgagctgggacccagggtcgggttgccggttcggtctgaatcatcgtaggccttgggttaaggcagattcgtgtgggttcacggccttgataaataatattgcatagttctagaatcgtgtttacaaaatagctttgagcaactaagcatctttaaatgctgtttactgcaaccctaaccctttatattataactcccttgtactcccttgcatttattatgcacttgtgggtgtgtcttgttgagtacggtggttgtactcagtcttgctcaattttttcccaacccagaagaggagcccctagatgatgaaggctttggtgtctagctcgtgcctgccgtcaagcgcctgtggtcgtcgccctagtcttccgttgtttctcgtttgtctttgtgtgtgctgggccttcgtcgcccatgtaataaattatctatttacgcttccgcttgttaaactctgaattgtatcaactcttggtgtaccttgcctcctgggacaaggaataatacacgcacgaaaggaacgcccgttgggttaattccggtcgtgacatgtgaagaccatatttgtgtcatttttttatgtcaattgaatatgacaattaagaaaaaagtgtaatgctttgaacagatgcttgaagtgtaagttgtgtttgtacagattgaaattggtttttgctgcttgaaatgtcatggtctgtacagttttagactgatatgcagtatgtcacttggaacaaatatatatgtacatcactttgcatactgtttcaccaggaaacttactggattacccaaaaaacagaagtaaaatattttctcttctcctgaaatttttgacccaactgcttcacatattgttaggaatatgagttagcaccatgaacctgggaaagaaatcaaataaatgcaaatcattgctggtaacaactctgttcttaaaattgctagctcagaatctcgatgtgtttcagatatacaatggcaaatgagttcacagaataaatcagttgtgacatctcagttacataacacaaaataaatgagtttatagctcatcccaattacatatgacatatcagatagatgacacaactcaagatataatttaatcatcatcggtgtcttccggcatgtcatcttcagcgttcccattgccaatgtcactacagtactgcaatattgtgtcatcttcatctgcatcatccctactgtcttcagtcaagttagcttggttgttaaggtcttctaaattagcttcaataatagtaacttctccatcttcctgcaaatggtctagatcctcatcagcattccttcatgcacttcatgttctgtatcagaacaattatcatcttggtgtacatcaaaaatgtggtcatctttttcagacacattatacatgttcctatgttcgaatttctgcacaattcgccattcgttgcccaaagaggtgtcctgcaagtaaaatatcttcttcgattgagttgctaaaatgaaagggtcatccttgtaccaaaatgattggatgttgatggatttgaaatgcccgtcatccctaactcctcttgtcttgccaacttgattgaaccaatcacaacggaaaagaaccaccgatcgatagatatctagatcagagttatactgcaactcaagaatctccctaaggacaccataaaattcaatgttatccccttcatgtgtaccatcaaccattacaccactattctgcgtttggaggtatttctcacggtcaacagtgctatacctgactccgttgacaatgcaagatgcacaactctttactcggagatcaggaccacatgacaatgcaaatagtgcttcactgaccacccctggattttctttcctcagcttcctgatctgatatatatatatatatatatatatatatatatatatatatatatatatatatatataaaaatacacatgttattcccaatttgaaatttcatcaccaaaaaatgatatttttgtaagtgtgtgtcacttacatgagtcttaaaccacctagcaaatcctttttcaagtcttctgtcaacatcatgtgcatcttctttctccaactcttctctatgcatgctgtagcatattatgactcaacaattaggaaaatattatatttaatacaatacatgtgaaataaacctacataaatggtgcttactccaaatatggttgaacctcctcacagttatttagcacataccaaactagcttatccatgatttcatcctccatgtactgtatcctagtggatcctatgagtttaacatcatgcataaaaacagagctgttaccatccaatggcccatccccatgacgggcgtcccgattaaatctagtgtcaacatcctccatgtaccttgaacaaaatgtcaaggtgtcacttgctacataggcctcagcaattgatccttcaggcctagccctgttccgcatggaattcttaaaggtgccaagtcatctttctattgggtacatccatccatattgtacaggacctctaagtagtgcctcatcaggtagatgtacggccaagtgcaccatcacgtcaaagaaggctagaggaaaaattttctcaagtttgcataggatcagcgggatgtcttttttcagtcgtttgaggacatctatccttagatttctactacacaattccctgaagaagttaccaagctctgcaattgcttcgtatatatccttgtccacaaatcctcttatgccggcaggtataattctttggagaaggacatggcagtcatgagttttgagcccctgcaccttggaaccatctgaacttatgcatcttgctaggttggctgcatatccatgtggatacttgacacctttgaggaagttacaaaactcaattctttgttccttcttcaagacatagcgagcttgtgggatgcgaactgagttgccatcctgctgtaagtgcaagttatgtcttatgttcatatcatgcaaatctatcctcgaattgactgtgtcctttgtcttgccctcgattttgagcaatgtgcccaaaatgttgtcacatatgtttttctcaatgtgcatcacatcaagattttgtggcagcaacaaatctttccaatatgggagcttgcacagacttactttgcggctataaattagtggcccttcatcctctccacgttttcttttcttacttgtatcatgcttacccggtctaacatctttcaccttctctaactgctcgaggacctcatctgtgctgaattttcctggctcaacctggttttcatggtgtccatcaaaagcatggcttcttcgccaagcgtgtgtccttggaaggaaacaacggtggccaaagtagcctatcttatttcttagtgctcgtgacaacgaatttttgtcacaatgaatgcatgcataataaccttttgtagttcgccctgacaaggtgcttagagctggataatcatgtatgcaccatagcatggcggcacgaagattgaactttctagcactgaatgcatcataagtactaacacctatccataattcaagcaattcttctatcagaggctccaagaataaatcaaaatcctttcctggagatgttggacctgggatcagtaatgacataatgcagttcgatggatcgacagattcccatggtggtagattcaaaggcataacaagggcaggccacatgctatacgaattgctcaccttgccaaatggattgaatccatctgtagctatggcaagcctcatattccttgcatcttctgcgaaagttcgatactttctgtcgaagtccttccaagcctccccatctgctgcatggctcatttcattatccactggcttccgcttgattttgtgccactgtgtgtcttcagctgttcgttttgatgcaaatatcctctttaaccttgggataagtggaaaatgcctcaaaactttgcgaggaaccttcctgtcgccaaccccatcttcccatctggattcaccacatattgggcatagatccatattggcatattccttccgaaatagcacacaattattcttgcacacatggatcgacacatatccaaggcccaattcacgaagatatttctttgcctcatcataagattttggtaattgacattgagggaatgccgaggacaacaacttcaataattcagtgaaagctgtattgctgattcgataatatgacttgatatggagcagcctcacaagaaaggaaaatcttgaatggttagatcctgggcaaagtacctgcttcgcatcttcaagaattctagcaaaccttggtggctgtccatcttcccctgccgcagtgtatagttcacctattaactctggaactccattgtcatcctcgggttcatacccgcccacatctgtcccttcattatggttagtttcatgtacctgttccaaatattcgacatcttctgtatcaactaattctccatgataaatccaccgggtgtatgttgatgacatcccaaaaatatgtatatggtcatgcatttcttgctgaggcagtgaagtgtggttaagacacctacagcatgggcatggtatgtcaacgtgttcatcaaatctttgtccaacaaattccatgaactgtttcactccctccatgtatgcaggtgtgaattgtctcccatgtatccaagttatgtccatctgctttggcatgttaaaaaaagcaattaggcaaacaaagctaatccattttttaggacagaatattttctaaaacattagatggaacagctggttgctacatgacttaaaccatgttgatttgttcataatactctgacttgtttctctgttcatacaacacaaagcataatctttcatagctgaacttgcatttcatacttagagtaatgtacttatggaaaatcataccttatatctactgaacggcgttggtgatgggctgtgcgcgctgacgataggattgagagaggaggtgctaggataagacggtgggcgaggagcagccgatccgtctcagtcgtcgaggatcccccgcgccgactgggatccctccgcagccccaccgaccaagatcacttcaccgcgccgccacccaccacgatgctccacatcacgatgccggccagcctgtggagccgcccttccctgcaccggtgggataagaaacctcctcctctgcaccgtcccggtggctaggatccgcccccactgagctccgcctgcgccgccgccaccctccctccctggctgtgaccaaaccctgcgccaccgcccccctccctccctgaccaaaccactaggtcgcccgcataaagcattcaatcattcttgtgttcgagaattgaaaggaaaactaaaagtaaaacatcatcagcatgaaagctccttgcagcgtagtggttaagctagaattatggttagtcacaagtcgtgggttcgacccccaagtgctgcagcattttttttagaaaaaagagttcacatgggctgcacagattcacacatgggctgcacaaattcacggactgcacaaatttgggctgcgaaaaaaaagttcacatgggctgcacagattgacacatgggctgcacaaattcacgtggactgcacaaagcatctgctggcccgaaaacgcacctgtgctgcatatacaatgtggggtccaataacaatctggattgccacgtatacaatgtggggtccaatgacaacctagatagccacatatgcaaggtgggaccaacagcagaatagagatttacttacaactgacgaaatatatttcagcatattgtattaataaaggagcgtcataagtgtgttacatgaatggtgcgcaccattttgtgacgaaattatctattgttttatgagaccattttaaatttcgtcatggagtttcgatgtctaccctccgccatgagtgatccatgacgaaacatgaaatttcgtcatagatatgctgtattcaatgacgaaattatacaacgtcatgagcaaaacgtcatagatggatgatttcctactagtgtctccgccggggatctagctaacgaggtggtttgcaagcgagtgagagacaagggattatataggttcgggccgccaggaagggtaacaccctactcctgtgtgtggaattaagcttgtgtgttacaagggagctccaaccctagactgaagcttctcaaatgtcgtcccttttctcggtgggcaaggtcctccttttatagttcaaggggataccacatgcaccgtctttacataattcatcattggagggggggcccacaaaacctgggtcaagccaccgtccatgccttcaaccagaagcaaggcagtcgttcaaccccctaatgggtcccagcgccgtcctccgcccatgggagacatccctgtcattccctcttaatttcatggagacttttgtggattcatatgcacagggggcacgcttggctccacgccgatgggacggggcatacctgcccccacttcgcttgacatagggcgggacgtgggtgcgctgccacccgtcccatccacctgtgaccggccataggccggtcaaggccgattgacacacgccaattggtcggcgccacatgcctgcccacgccgcattaaacgcggcgagggacggttggggcgccgctcattaaagcgcttggcagcgtcccatcctccgcccactcgaccgccacgtggcagccgagtgagggcctcggcgcggcgcgctccaagggcccgaggggtgcgacggggcaccccgaggccccttggccacttgatgactacccgacctcccccgaggggagggggaagcaggccgcacggccacgtggctagatgaaaggattctttccctctattgtgcgtacccccgtgcccaaatcaccgacaatggcaataaaggacgcgttgtaatattttcagcataaataattttctaaccaatgaatgataaataaaagtacaaatagattaaatatgtatgttgatcggctcgtaaaattgattattatgaaagtaggtaaactgtacataattgcatgtcagcacccggtgacatgaatttctgcatagctagggcatataatatgtcccatgatcagtgactagtacatgcatgcacaatattattatcacatccatacaacatacaggtcatacaaataggtaagtgattatcatgacatacatgatagttgggccaatcggtcaaataaaagagtataaatgcagcaaaaatagatgtaagatacataagttttttggtatgctcatctaccaaacaaaacaggcaaccgactaaagtcaccctagaaagaatcatccctgaaagctccaacattcactgcaaagtaaatgtcgctaggcacttcacctccagcgtccatgtctaaaaacaacaacaagatgaccaagagtgagagtgtgtggtcggggctccctatactgataccgaatgcacaccgatttattctgatcccttaattggttgcatgaaatatagctacattagcacttgatcgatctataggatgatgatgggagaacaatttgaactcggttagtagtatggccacaccatatctatctaatataacctatatctattcctacttaaaaaataccaatttttcccattgtcacaatcgtttttcgtccgctgttgtgtcactcttgtcaacgttgtgcgtcatccgcctccacatcttgcatactcagtttggtggcatccggtcacatttatgtgattgcctcttcaacgactctaacactagatcctacctcaaattagaatgtaatgccgttgggtcaatcacaaacgcatacacgcgatcacctgaaaagtcaataggaacaacttgctcgtattttttttcctgttccaacgcaagtgcattatttctagtacatctcaacttgctcatattttttttcctgttgcaacgcaagtgcattatttctagtacatctcaatttgttaaaaaaaaacttgatgttcgttttgtttatcatttgtctttttccctctttgttcttatcctttattacctctctatttttcatggaaaaaaagtgagatttttcttttccacgggctgaacggcgcacgacgctgttcccgtgtacaccatgtttagattacgattccaatccaattaatttgctaatggctctgataatactagggtgatggggaattggggatgaagaacatgtctcatgtgaaaaacgtaaaaaaaagcaagaacattgagggtcattaattattcgggtgattaacttgggtaattatccttcattcacgctgaggcttaagaacagcgccgcacttttcagttccaaaacgatagtggccactgagatacatatgtctatcaatgatcaccttggcttgcaccataaagtctatcattttaaatatatatattgtcattcaagcttatagttaagttttaacaacaataagacctacgtagtagaaacgcctataaatccaggaataagtacaaatctatcataggatttgcatgaataacacttggttagtcactcagtcgccaatcggattctctatgtgcagatctgttatccttgttatctgattgccacatgctgttaaaatatactagcactattatctctcaaagaacagatgctacattgactgtatttagcttattttggattctatgtactacttcagtgatatttagaagcaagaagtaaaacacttgtttctcctagctagaagaacatctttgatttaatctaaaacattagaatgatcttcattgagagaaaaaaatattgcaaaatgctagaaaatttattaataatgttccaagaaacatgtcattaggtttgacataattttctacataaacatggccagttgtaatcctttacccttatcattctatgaaacaacaaatgaatacattatttcccttgctccactgcctattggaaaatattccatttttgacaaagaagtatttgcatttgtacttatatttgtatttgtgtattgttattgtttctagtcatctgataaaacaagtcttatattgtatttgtatactaattttttatgactttggcaatgaatcctaacaaaggaataaaccatgtccgttctgtgcccccacatagttataagcatcatctttacatcctctagctatcttgaacagtaaaatattgaaataagatggaaatatttcctgataagacaaaatagtgaaattattatcacatgaaaactacatgtgacatgaagagggataaagacattatccaaattattattttaaatttacgtgacaaccgcttataccaatggcaactgcaatctatattcttagatttctgttgttggtaggatttgcctcatgattatctatagaattatggggtttgacttatgtagacaaaaactacatatcattatatcaaacaacatatacagaaaaatcatggaccttttattgaggacactaacactgaaattgtcagcaagtgacactttgtttgccaaggttatgaccaactcaaccaaggaccaggtgtatgcaattgggccgtgctttggcttcacaaatattagtatctgcatgaggtgtatcaccaaggcattgcgggaaatgtaacaagcacgtgcttaaaagatggatgctatgacattttacaacttatgtaacgttagaatttttggtgatcttaggttcaatattagacatgacacgactactatagatgtatatggtgacccttgttatgtcgatcataataggttgtttagtaggggttgacggttgttaagtacaaatttttactgtcaactactgcataaaagaaataaaatatattatcaaaacattattggatttcagggtgttcaagcacgaggatttcgtgctgcagcaacgtgctataaacaactattcggtgcggtcacacagcttgtacatacaattatattagtcgcatcatatcgtcggtgatgctgactgaactgatcatggttttgaccctaactactaccagtacgccagctgcaggtttgccgatggccatattgattttgtaatatataggtgtgacgtaaaaattaataagtttccgaacagttatgttgccaaatacgttgtcgaccatgctctgacatacaacagtgttgaactgcctccgtttaaaaaaaatagttttacactatttatgttcaacgcttgactattcgtcttatttaaaaaaaattatgattagtatttttactgttattagatgataaaacataaaaaatacttccttcgtcccaaaatatagggatttttggattttgacagtcttcaaaatagtactttgattaataatatttataaaagtaagatattttaaataaaaaagttagtaaatttagtaacaccaattttacattattgatcttaaatttaaatttagtaacaccaattttacattattgatcttttttattttttttctattaatagtcaatattaaaaatgtttgacctggcactattctaaaattgcttatattttgtgatggagggagtattttatgtgtgactatttttttttacttttttataaatttttcaaataaaatatatggtaaaacgttcgacatgaaaatgcacacctgcatttaaattgggtcggagggagtattcaatagcactgtcagacatgctagttggtgccctttcagtcaacctaacataattgaagtgtgaattggatagtaatcgtactatttatttgctggatttttcttttctatacctcgatgtggtacttgagtatagacttttaatgtttcatgaagtggtatatatatgctgctgaatgttgtcaaatttttcgataattttacataacagtttggatagtattttaaagctcaacatacatgtgagtatagtatttataagcactcataaaacctaaatacaagcatatcacatcaatctattaagcacaaaactcaacatgcaaacatatagtaattacatctataatttatttttttctaaaagtaaacatacacatgttaaattattattctcaaatcatttttataatattttaatccaaattattttatcatttctctattatgtggcatatatccgctggcaagcacggggagtactacgaatagtcgagttacagcattttatttcaactgttgtcgcgtcactgcacagccacatcatctttatttcaagaacgtcaataacagaattattacggcgctgacaaaggcacatgcatgcatacatgcatggcaccagctactagccatgttcaacgcgccggcgagttctccgctcctttgtgcaccgagtagccggcgtcgacgacgatgttgtgcccgttcacgtacctggcctcgtcggaggccaggtacaccgccgccctcgcgatatcctccggctcgagcaccttgacggcgtcgctggcgccctcctccaccatcctcctcagctccccgctcaggcccggggacaccacggcgaggcgcgggatctcgttcagcatcatcggcgtcctcgtcgcccccggcgagatggcgttcacccgcaggccgtggcgcgccagcggctccgccatggcgcgcaccacagcgatgacggtggccttggagacggagtacatggcgagcgccggcatggggacgacgcccgcgccgctcgccgtgcagatgacgcagccggtgcggcgaggcgccattacgcgcgcggcgtgcttgatggccgcgagcgccgggcgggcgttcaccgccatcacgcggtcgaagccggcgaggtcgacggacagcgcgtcgtcctgcggtatcctccccgggatgccggcgttgctgtggaacacgtcgaggcggccgtgcagcctcacggcgaggtccacggccgcggcgacctgcgcctcgtcggcgacgtcgcagcgcgtgtacgcggcgtccgggccgagctcggaggccaccgagcgggcgaggtcgtcctggatgtcggcgaggatgaccttggcgccattcttgatgaactccgctgccgtcgccttgccgatgccgctcgccgcgccggtgatgacagccaccttaccagccaacctgtgcatacatctcaatctcatcacgaaacaacgtacatatgattgaaacaggagatcatccaagaactaaaatggaaggcagatgaaattaacctctgtaaattggacaccgtggagaagcaacttagtgttaaatctgcacgggaagttgtttttgttccaataactctcttggtagtctctctgcaacacaaccggatcacaacaaaatctttccagtttcagctatagtgtgtataattcggctatattgtatacaatacctgagaagttgtgttactctgaacatcctgctggaaaaaaaaaataaatggctacaacgagatattgctacaacgagctagagctggtcgtcgttgttggctcaggtgtggtaacacaggcagtgggagcttccttaagaaggcaagcgcgcagccagaaaaaaaaattctcaaaataaaactggtccacaaaattatgaaaaactattctgttctatcaatatttgaggcaatcttcttgccttcctttcaaaaggagagagagaactttgaaaattcgatgaaagtacgatgcgaattgttctaaataaggtaaattattgtacgttctttaaattggcaacgtcacggcgatgaagtcaaagtaaacctttaatattctataccacaaagttgtacatcaaggttattatagccaacttgttattattgtttacttaagagagtatacgatgtgtacgtaccaacacacgccacgaagtaaacaataataacaataataacgaagttgtacatcaaggaattcacgaagtcacaagtgcatgcatcctctacacacgctggaaactgttaaaaaaatttgggattggcccataaaagcctggcccaaatatatttattgggccatcacagaactttctatatagtggattgcactatataaaaagagaaatgagctactcattgtacagttgattggaggattgaatagtaaagagagtctcaccccaaaatcttgtatacgtcatcagacacgaagctctaccggagaccaatgtaggagaaaggtaagaaactcgataatcctctttgcatcttgtagattgaattgcaaaaatgaattccttgcatcttcctcgttccgttttttgactcccaactaaaaccgccatcaccgacttggagtcgccggcatgtaaacgattggggttttctcggcatcctccatcgtggcagagacgaaactcaccaatgcaagcacggatcggagacacgccgccgcacggcatcgcaccaccggtcaccggccacgccaccgcacggcgtcgcgccgacggccacgccacggcatggcgtcgcaccgcgccgccggcaacactccgcacggtgccgccgcctgcagtcgcggccgtcgtgtgcactgctgtgagccgccgccggcagtgccctgcacggcaccaccgcccgccgccgtggcagccgcgtgcactgccgcaagtcgccgccgcgccgccatccccacacccagcaccgcgagtcacagccgggcgagccccgtacggcgccgttgcgagccaccgcacccccgccctgtgccgccgcgagctgaccaacggccgcgccccgcacagcgccgccgcccgattccgcgaccaccgcacagcgccgccgcgcaccgccacgcagcgatgtcattcgcaccccgcatggcgctgctgcgcgcgccaccacgcaccgccaccggacgcatcgacgcgcactgtcgccggccgcaccccgcatggcgccgccgcacgccgccgcgacagccgcgtgccaccgccgacagccacgcgaaatctccggagagaagaaaaagaaagaagaaataaggaaagagattagcgattttgcggaaagcctcctagattttctgaaaattagacgcatatctcccagcatggaacttttttgcgcataggaccctagaatttcggaaacgttcatttctaaccattccctgcatggaaaacttagaaataggcccttgaattttgcaaatgtcgcttatattccatatttaagcattttatgtcttataaaatttcaatttaaatttattaaggcattaattactgttaatgaatattttgaatattttgtttttagtatttatatgaatatatgcaacttttgcaccttttttctacgaatatttgtttgcatttctacaaagtatttatttattgaatattttgcacttcttattcgcattccctatgaatataaatattggaaaaatcatgaaatacttgcattcatatttgcaactatgtcactggcagtaacatatgaatattttgtcagttttgcaacagaatgtcagaatcacgaacaaggagttcgctgaactggcccagcatggccagagctacctgacctaggcatctgacgtccagatcgttcttggagccaagaagctctgccagaggatcgggatgggcaccccgcaggaacgtgcgcctacccctgatgagaacgattaggcgctgcacttcctgcgacaccacctctgtgccacgctcaagaatgagtatatgggattacggagcgcactcactctttggaccgcactcaagaagcggttcgagaagttgaagtacaccatcctaccccaagcaggactgggctcgccagaggttcacgaacttcaagagcgtctccgagtacagatccggtgccatctccgcgctgcaccggatctgtactaacctctccctctgcggcaaggttgtcacggattacggatacgacaacgctctccatcttccaccctagcgctgtgcagagtgctcgtaactacaggcaggcatcatacaaggagtatgacgagatgatcgacatcatgcagttgtctgagtcccatgacgaggttctccgcaagaattttgtctcccagccgcctggcatgagtgttggccttgatgtcaatgttatcagttataaggtctacaagcccgtccagaggaagaggggcaagcgtggtgggaagaaggcagtcgagaagtcagagagaaaagctccagctgcccagggagcacagggaggcaagggcaagaaggaagccaagccacccgcaatgacaagccgtatggccagcaggatcagacatgctacaagtgtggcatttggggccactagggccgtatttgcgaggagccccaacacgtcatcgacgcataccaggccagtaggaaggccaaggcgtccatagaagcacacatggttgaggctatcactgtggctactctctccatcaccactccacctgacgcccctacagttgcagcagacaaagcaaatgaagaggccgtcacacaggagcagagcttgatactctagctgattccatttgagtatttgatgctcctattttttttcgtgaactaagttgcattatgaacaattttgaataatggttttgtaagctctatgagaacataatatttatttcgtgatttgccttgcatggctagactttatttccaatattatgttgcattctgctatatgataaagttttacttattgccttgaagtagtgatattttactttattcacatagacaatatgcatagcctaaggtaaagaggaacattgtggaagaaaagcaccacaaagtgtaatcttgagagagatgagacaagttcagtttatgcaaagacgtgaactaccttcacaactacacgttatgattgtaaaagatattgtttttcccgtagataagctattacacctcaaatctcttgagaatggaaaactctcgcagaaaagttcccttgtaggaactagaagatgagagaagcatacacatcacctaagcatgcgagatcaatgtcctcactaagaaatgtaggctaaagtagactatttcatagtcagtttttcttagaatttagtatcttgcaaatgaacatagcacaaacaatgtcacatcatctgtcgtatcgcaatggtgagatatttgtcacgtgcactgcctgagcgcctcgcgccaggcttgtgccagacattggcgtgcatcatacaacattatactagtgccgcgcactaaatattgtacaatgcaccaactagcaaccccgctgtactgggggactgaacgaatcaagccgcgttagcacgcgccatgcaactcctaccatgcgccatagctgcacccgctgcataccctgtggtcactctggatacgcatgacatcgaacatcggatgcgtgccaaacgtcgatcaccacatgaattctagaacgaattcgcgcataccatgtgaattcgcatacatattttgccctttaatggatcgtctgatacatattgggcttacgaaaaagctgcaattgtgtctaattgatactacgctcttgccaaatcgatcctacaagatcacacatgttggcatcagcacattaagaaaagcactaagtaccggacgtccacaagaataagactaaaaaattgtccattgcaccactattgaaattcccgccacttgaatggactcttagctccaaaggcagcgaattatcaataaccggactattcgaaatgtgttgtcaacttaaaggaacactagtgttgactcaacacatgtgcataacccagaaccataagggctccctccaaaaaactgaaaatttttaacagaggtacgaacgtagcctaaattccttgacaataagaaggattatttccagtcatttagagggagagaaataacccttaaaatgataaatgtcaagaaaaatggtcaaggaaaggatggatgcacctttaatcaagcaccagcgaatgaaagtatgaaagcacacataagaattggataactgcctatcacttttgtgattcggagagcatgactaagttgcattatccaaatgtaatgcaccggaggagggtgaagtaccgaagaatgcaaaggtatacctcatcttgtctagaggcctcgagaaaaataatgggactagaactccggccccttaaatccctaaagtaaccagagacgtgtggtgaaaacgggacaaaaaggaactctcaaggtcatagtcactaaaagtaaccccagaatttgaggaggagccagttcagagctggcaaatggtatggaaccttagaacaggcataccacatcttcctatcaaggaagaaaaccagcagttggagtgcacaccaacgccggtaaaatgaaaggatcatgcccatgtcaaagaatagaagcataaattgcatatccccatatatccatggatactcgcataagtgtcacatacaaccaataggaattggtaatgagacctgctatgggcaatattctcttcgtacagcaaatcatttggagtcaacctggagttgaaaatcaactaaaatatcaacccgcaaagctgacctatagttgacaatgaatgtttaaagaaattttggattgggcactcgcatacaagcattaaaagtcccaaaccaagttgatgatccgaatatcatcgcataaagaaagaaagctcactctttccgaacgagtttgagataaaaaaaggtagaaacctatgttgcttaggcctgtaaacctacaacacatggtaaaaatacataggttccttggatatagttcaccatttctagcaagtaacatggttcgagctttgtccaaaccccaaaatcattatcaagaagataatcatatgtgcgtcgcaccagcactaatagactatatgaactctataagttatggaaaaatcatgcaagatttgaccattgaagcatcacttgaactatcttttgaaaagatatgagcaacgagttttgatggttcacacttaaaagagatgcaaaattcagggggagaattctgccagtctattaacaaaggcttgaactgaagaatcaagtacccaaaactgattaagaaaatcggtacaagaattttggtagattgtactccttttcccttcgataagttttcctgtagtttcttatcaaggtttttaatgagacaatctatgtgatatacatgcgtatgctatgtactctttatggagttttaacgaggcatggacatcacgcggtgagtgcctaagggggagtgttaagaaacttttgggcttggcccatgaaggcctgacccaaatacacttattgggcccatcaccgaacattccatatattggattgcactatataaagagaggagggggttactcattgtacggttgattggaggattgaatagtaaagagagtctcacccctaaactttgtgtctccactttctgtagaaattacgagaccctcttggactacttcatgtagcaggaagattgtgtaatagaaacatcggggcaggccatcaaacgccttcagctcatagcatgagaacacacatatcgatggaaaaaagcgcacatgcatgttataattgtgctcgcaagtacttaaaaaaattgaaagacattaattaacgttaaatcaaggatttaaactcagtgctccctttatttttttagttttaatagagatagttgttcgcaactttttgtgacaagtagacaagcacgatcgcaacacccaaacgccttcggtgattgtagagttgccaaccatcctaatccagcaaaagctagatcaagatgggttttgatagaacaaaccggctagtcaagccgatttagatagattgatggataactacccgtctcgtgggcaaaacggaaggtttcaggacaaacctacaaaagattttgcactctcgcagcaaaggtggacgatttacggtgcaaatcgacaaagatggacgaactaaactagggcgaattgaa

SEQ ID NO: 5574 - DNA, 32355 bp, Oryza sativa
aaaagcagttttgaaaaaaacgatttgattgattgattgttggatgttaccttgtttgaaccggccttgtcccttatataggggttggtcttgctatgtacaggccctcctccacgtccaacttagggtagaaaccatggaaacccgagcaaggaaacttgagacccaacaaaaacagactcgggctcggactctgccggtcagacgggccacacatcggcccccaaggaggaaaaccggcaggaattctatatttggcaattcttcctatttcaactctaggtgccaaatttgggtgtaaacacatgccccctgccttttttgtgaacatcgtgaatctaaaggcatagaacatgttgtcttagggtgataatctaattaccggccataggacttcctaagcatcttgccaaacactcgagaagtatttcccattgattgctctctgaaaatgctctccttgaagtgtctccaaaaaatacacatttcctcgaactatcccgcatactcgataaggaccttcccaactaggagaccacttaccgaactccttagatcgagaacccaaaggcaaaattgtcttccaaaccaagtctcccacttgaaacaactttgcttttacccttttgttgtacgccttagccaccctcttcttttctttttctatttcttccaaagccttcaaacgcttgtcgatgacgtcgtcaagattaactcccatcaaggtcttgtagtcttcaaccgacaaatcgccttgcttgatataccgaagagagccaagatttacctcaaccggcaaaatagcttcttgtccataaacaaacataaaaggagtgactttagtagcaccatgtttagatatcctatgtgcccataatgcctcagaaagcacctcatgccacttctttgggtgttcctcaatcttctttttgactaatttcaacaatgtcttattactcgactcggcttgtccattaattagcctgagcgtagtaaggagaagaactcaacaatttaataccataagattcggtaaaattcttcacttccttagacataaaagaagctccttgatccatagtcaatgtttgcggaataccgaatctatgaacaatatgcttcaaaataaaatcaattacatgtgtatgagtcatattcttgagcggcacagcttcggcccacttggtgaagtaatctgttgcaactagcacggaccgatgcccttttgatgacgaaggataaacttgaccaatgaaatacaaagcccaacctcggaacggccacgatttgatgatgggattcaacatggcggcggcgccaattgaacattgccgaaccgttgacaagcttcgcatcccctataatacttgaagcaatcatcaatcatcttcggccaatagaaccccgctctcctaagcaaccaattcatcttatgggccgattgatgagttccacaaattccctcatgaaattctcctgtagcaactttagattgatatcgtctaagcacttcaacaatacaccatctatattttggcgatatagctctccagcaagaaaattgcttgccgccgaatgttccgatcaaccttaaggataggatctttcaaatatccaatcaaaggaattatcaaaacttcttctatttcctgggtacaaacgtctgaatttacaattaattcggcctctaaatccatcaagatgtgccccccagcatcctgcccagagccggtcagaccgcacatgcaaggccgctcagaccgcataggcaggctggtcagaccggcggtactgagtcggtcagaccgcaagttgtcaccggtcagacagaccgcccctggtctgaaactttgccaatttcgtccaatgatttacaaccaagcaccggcttttccaatatcagaaacactcctttctttacattatagccagacgcttgttgagctagaccatttcctctaaaattctcacctctagcaatatgtctgatagcaaaatcatcaaaattggtaataatatccaagcattgatcaagatacctatttagtgacccatcaaagcacttgtaaactccggcaccttgttgcaccaccaattctgagtcacagtcacgctcggaatttctatccaaaattccaaacgcttacatgtgtgtaaaccctcgtccaggaatcagccgaggcacacaataacaaatcgataatagagtgcaattattactctaattaataagcgaatataaagtcattacagaggtagatagttactctcaaacaataaagttctaagcagcggaaaataagataaacggcgcaggcgactccattccacaagcagcttgaccaggactacacctaattctccacaccttcagcatcactgttgaactcctcctctgatgaatgattgcaaggtgagtatatgacatactcagcaagccacgcagcaaatatgcaagtgcaagggataacaaaggatggcataatatagtctcatttgcataaatggcatttaatgaatacttcagaatttaatcaaacagtaaagtatttaattaatcaatattaatccatcgcaatacaacatacccgttgcataggcccaaccatcctgaacaaccaatcccggctgcacagttctatctccaaacaaggaatataccattccaaaccaggagctaaacaagttattaccaattacagcatcatttattacggtgagatgtgtgaaactaatgacgaaagacattgttagacccgcccataactgctggcatgactattcgaatagttttactctggccagaggtgtaacactgtacccacaagacacaacctcaacatcatgtcaaccatgcgtcgcgatacttaacaagtacccaaaaagagattgtgacaataccctctgtataacacaattcaaagcagtgcaccgttcctggatcataatcacccccttaaaaataaggcatggactccccagcgacccccgtgggcttatctccgccacttcatagtctggcgctctacaatgaaccatactatacaaaaagtaaagccattgcccatgctggcttgtggttggcacagttaatgtttcacaaccgaaaatcgtgaaccggtccttaattgtcatgagcacgaccattaaaaccatgtgctcacaaaccaccattatcaattttagttgactaattaattaattaaccaatcacgatgaaccatcgtgagctatcattaagccatcattaaataatagtgaatcataaattatcccatgtatatgagctagtgtctctaagcatgtgtaacaccctgaaaattcgaccgacaaaatcaaaactctaaaaatacggattttcaaaaaactttttaaattaattgcatcatgccgatcttattcgtctattttatctggatttgatctcgaagattattaatcgtgagtaaagaatagttaattatgaataaatcgtaaaaacaaaattggtaaaatacatacaaattaaaataaatattaggtggggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgcaaaattaggaattgtggaatcaaatttatatggaaaatacactaaaatcgggttaattagaaaatggcactgttcattgcacctcaggtgttcaacgcggtcccctaacccagctcctcctctttcccctctctctgtcgccaccgtcaccgcgccgtcgccgtcgcgtcctgccccgcgccgcgcttgcatcccatcgccgcctcgcgccgcgcgccaccactgccgcgccgtcgccgtctccatcccgtcgccgcgtgcgcgttccatcgccgcctcgagccgtgccgctgccgctgccacgccgtgagcccgcgtcgcgccgcgccgtcccatcgttgcggtcacgccgtgccgccgtgtcgccgcccatcgcatcccgccccgagccgcgcgccatcgctgtcgccgttgccatcgacgtcccgtcgccgcgcgcgtcccatcgccactgccgcgccgcgcgccgtctcgtcgcctcgcgccgcgagcccgccgcctcgcgccccgtgccgcgctgctccccgggccccgtgccgccgttgctaccgcgccgcgccgcccgttccatcgcctcgccgcctgtcaccgtcgccatgcgccccgcgccgcgccgcgcgccgccgctgccgctcacccgtcgcgtcgcctcgctccgcgcgcccccacctcgcgccccgcgccgccgtcgcgtctcccctctcccctcttccccttatctctgcccctctcctatataaaccccactattcccactctttccctccatcctcacctcctctcctctacccactccaccacgccgccgcctccacgccgccgcgtcgtcgcatagagccgctgcgacgccgccacgacgccgccgcgccgcgccgcgccttggccgtgccgcgtttcccgccgccgtcgcagtcgccgtgcgccgccgccgtcgccgccaccgtgcgccgccgccattgccgttgccgccggtaagccgtgccaccgccgtctttttcctttcctcagccggtcgcggtaggcaggacgagagagaggaggagaaggagccgaaagagaatacaggaagagaagggaagaaagaaaggagccgggaggagagaagagaaggaaaaaaaggaaagaaaagagaggccggcagagaagagaaagagagggagagaaaaaggagagaaaaagaaagagagggagagaaaaaggggagaaaaagaaagagagggagagaaaagagagaaaaagaaaaaagaggagagaaaaagagggaaaatagaaaagaagaaaaggagaaaaaaagaagggaaattgggggagaaattaggaggaattatgtcacaccctgaaaatcataaatatataaattgttgtttaaatggaattttttttgaaataattttaaaagccttgaagagaagatctaattttaattaataaattccaatataaaatagggccagataaaattttattaaatactttgcttaattctataattcctagatttttctgggatttatttgagctaaggaagtatttttaataaatggaattgcatttaagaaataatttaaattgaaaaatgttttaaaaagtcttcttttggctttgggccgaaagtcggcccaaaacctctcttctctctctccacggcccagtccggcccagtccgccgccgcgcgcgcgcccttgctcgctgacaggtggggtccacctgtcaggttcgtcatccccgagccgccgtcgcctggccgaaaccctagcgcgccgccgccgccgttcccttccaaatccggccgttcctttccttctccggccgaatcaaaagaggggaaatgatctccgggatctcctctaccttttctccgttggaatcttcggctaaaacgttttggaagttcgtggaatcgagttcgattcggatcggcctctttccttcaagccacgaagtttccttctcgtcgccggccgccgtgggccttcgccgccgcctcctagcccatttaaaaggctccccggtgtctcctctactcgccgccaccctcgccttcgcctctcgtcgcccgtagagctctagcgccgtgtgccctaacgccgccgtcgccgccgtcgctccagccgtgcgccgccgccgttccagacgtcgccgtcactcgggaaggtcgtcgtcatggtcgccaagtcgtcgccgtcctcgtccgccgcttcgtcaccgtcggaaaccgccggagcatcgtcgccgtcgtcaagccgcagtccgccgccgttccttcgtcgtcgccgtcgccgtccgttggtcttccgccgctcccttggtcgccggtgagttcgccgtgccgtccgctacctgttggtgccctccgttcgtgccgtagtgccgccgtttgccggcgagcttgcgccgtccgagctgtcgagccgccgagccgccgccgccggtggtgacgtcatcgctgacgtcatcgtccccgtttcccgtgagccgccatggacccgatcgatctcggccgtccgttttggatcaagtcgatctcggccgtccgttcccgtgaatcgccgccgtgcgcccggtccaccgcgaaaccctagcccgctgacgcaataaatcccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccgaagagtccgttttcgccggagaagagtttgaagagttccaaggccagcaaggcaagtcacacagatcccaaacaaccctttgagcatgttgatcctatttaaagctattgtttttattcaaatattgcatttattttcgaatgtcattgggtggaattaacctattgtttgttatagcccttttgttcttgattactttattccttgataccttgggttattataatttgactagttgagctttgtttatattggttcaactagatgtattagatataattgcttagccctgcttagaaacattagcacactattgggataacttatgactcactattatttaaagatggcttaatgatagttcacgatggtcaatcgtgattggttaattaattaatgtgccaactaaaacctgataatggtgggttgtgagcacatggttttgagagtcgtgctcatgacaattaaggaccggttcacgagtttcggttgtgaaacattaaccgtgccaaccacaagccagcgtgggcaacggctttatcttttgtatagcatggttcattgcggggcaccagactgagaagtggcggagataagcccacgagggtcgctggggagtccatgccttgtttataagggggtgattaagatccaggaaaggtgcgctgtaatggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacttctcaccatagtaaatgatgctataattggtaataatttgattagctcctggtttggaatggtatattcctggtttggagatagaactgtgcagccggggcggttgttcagaatggttgggcctatacaacagggtacgttgtatagtgttggattaatattgtttaattattacttaacagttttattaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcttgtggagtggagccgtctgcaccgtttatcttattttccgctgcttagatctttattgattgagaggaactatctacctctgtaatgacattttattcgcttattaattagagtaataattgtactctattatcaatttgttattgtgtgcctcggctgattcctggacgagggctcacacacatgtaagcgttttgaattttggatagaaattccgggcgtgacaagttaggaaataaaatggtcagggttaatcatagattatttttggaaattcctcgagcgtaatagtatttcggtcgaaattccgagttaattataaaaatatgtttcttgaacagattagattaaaattggtagtaatttagatataattagtagctaaacaattagatgaattcttatagattattatagattatttttggtaatctctataagtcatcggttcacggtagaaattcggatttaattactaggaatcttagccgtgtatcatatttaatcgtttagtcatagactaaattaagttgtataatatttctaggatttcgttcgatatttagctcgtaatagaaatttctaacctattatatggatacaatgctcggggagagtaaattaaaaacttatgacaacgaaataattatacccgcaaaatagtttaaatcaaaattgggtttgccgtagttcgcagatagtaaagttaataaaaaggaatcgactttcgcattcgactttcatttggatttatttggatttttatttgaattctaaccgaattcaaatcaatttttgcacgtaactatagagcccgagggagttgcggatccaagcgaaggccaagacccgcaagactttgagcaaggcaagtcatcactattccttgaacatgttgatcctaattgcgaaattgttttgtttacaaacaaagttgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggtaattacctttgggaaggtaattgagatgcggcatgtggagacatgagcgccacattgccatgatgttgatgacatgatttgtgaaaggagaaataaaattaaacaattgttttcgactggggcggacggagaatttgggttgtatctggaaaaggctagtaccgtccccagtcaattaaggaccgagccatgaagttaagcatgaaacgacccccgtacaaccgtacttctcgaatgggtatagacctagcggattagatagccgagcggaggcagtatccctgcatagatggttcacccctgagtgaggcaggtgcgctacgatgggacagccgttgaggtagggccgagaagcgtgccctacatcggtgtcgccattggtaggactgccatgagtgtgtgagagagagaacttaacttgaaccataatttaatatgcgtgtgagacttctctttccccgggagcgccagaactcctctcactgctagaaacatggacgcctagagtgcatgaggatttaagttcatggagcgggtactggcaatgcgaggttatcgaaaagctttgccgtgacgcgtctcatgtgttgggacgaggctcatgtgttgggcagtcgcggagtgcgggtaaaatgtacatccactgtagtgtgagtaaaccaaatctattcgaacagccgtgctcgcggttattgagcaccgggacatgtattacacttggctagactctaaattctttaacttgtgtgggatgggatattacatgatgatttttatgctgatggagccacttcctgagaggcgggaatgtggatgtcctcagaaaaccataacgactcaatggcgggaagctatccttgggatcacaatggatggtggacagaaccgtcattgttaaatatgaacactggtaataaaacttgatcagtctatgctaggtcttaggcttgtgaaaataattacaaaacttgcttgcgcaaaagaaccatagccatcctttgaattcctctgtcatgtgcatcattgctgtggtggcttgctgagtacggttggtactcacccttgcaaatataaaattaatcagaagcgggagatgaagcctcggaggatccctatacctactaccaggagggagatgaagacgatggcactcagtaggtcttagtacggtcgttgcctgtggcaatggcatgccgctgcctgaattccgctgccttatctatttctgcttttggatgtattccggaccgctcggtccgatgatttaagactatgcctgcgggcttatgatgtaataattcgaattagacactcgtgtatgtgcacttggtattccagctatgaattcgtgcgtaccagatctgatccagggaaatggtactgtttacacgattgactcctgttataaaaacgggggtccacagcatggctaagcatcctaagcactttagctaaaaccatataatgttctagctaatccaattattaaccaagtgacaaagtataggtaagcaataacaaaggcaataggttccacccaatgacattcaaaaataaatgcaatagttgaatagaaacaatagctttaaacaggatcaacatgctcaaagggtcttttgggatctgtgtgacttgccttgctggccttggaactcttcaaagtcttctcctgcaaattcggactctccgggaatgtcggaatctaagcaaaaaagagcaaaatcaccaaaaaagcacataaacaatcatgaacagtacatgtggatatttttaacatgtagatctcaattttataaaaatttagagacttgaaccaactaaatctgagctaagatgacttagttatgaatttttaaagattaaaccggattaaatcatttatatagattttaattgaattatgacgcaataaagaattatttttgaaaaggaaaagatatttattgcatcagcggtcttgggtttacagtggaccgggtgcacggggatggtctacggaacgaacggccgtgatctaatcttatccaaaacaaacggccgagatcgaatcggtctaccgcgggtctacggctgacgcggtgctgacgttggcgatgacgtcatcaccggcggtggcttggcaactcacgctcgccggagaacgacggcgcggcgacgcaaacggagggcaccaacaggtagcgggcgacgcggcgaactcaccgagggcttagacgatggcgaacgacaacggacggcgacggcggtgaggttgaagctgcggcggcgttcgggtcaacgatgatggcggtgctccggcggtcttcggcggaaacagagggcgggacgaggacggcgacgacttggcgatcccgacggcggccttcccgaccgacgacgacgaccggagtggcggcggcgcacggctggactcccttcggcggcggcggagcacgggctctagtgcctagggcgctacgagcgacggcgagctaaagcgagggtggcggcggatagaggaggtcccgggagtccttatataggggctaggagcggtgacggaggcccacggcgaccggcgacggcgatggaaagtttagggttcgggaggaaaaacgaatccgaatcgagctcgaatcccacgatttccaaacgaaactagatgatgtttctataggagaaaagatagaggagatcaacgggatcatttcccctctaccaatttgatcggatcgggaacgacgcggccgaatttggaaggaggcggcggtggcttgcgtgcggcgggctagggtgcggctggcccgaggaggacgacgaccctgacaggtgggacccccacctgtcagggggagagagagagggagagcggcggctcggctcggcgggctaactacaccggggcgctagcaggccgaggagagagagaggggttttgggccgactttcggcccaaagccaaaagaggacttttaaaacctttttcattttaaattattcatgaaatgcaattccatttattaaaaatactttcttggctcaaataaatcctagaattatctaggaactatagaatcaaatgaagtatttaataaaattttatctggcccacttttatattggaatttattatttaataattagatcttttcttctagacttttaaaatcatttctaataattccaattaaacaacaatttatacatttgggatttttagggtgtgaaaaacctacccccttcaacataatctcgtcctcgagattcggaagagctggcgaaaagatgcggatgggctgactttaattcatcttcttgttcccaggtagcttcttcttccgagtgattactccattggaccttacagaaacggataactcagttcctggttcttctttcatctatctccaagatacggattagttgatcgcaccagctcgaccttctcctcctcgtgcgttcacctcgctgtactcccacgccgataagcaccgcaaactagcggcgcctctaccggtatccacacgtacagggacggaacgccacgcgcagatgtgctagcacccgcgcgcagctagggttttgcttggggagggatgtgacggctagggtttctcacgtgatgcaatgcctctgccggtcacacccctcacgaatataaaggattcatcactcgggcctccaaggtccgtaggactcctattcggatccctatccgaattaagctcattttggatctctatccaatccccttattccgacccattaagcatgcgaccctgtaggttcatatatactcggctgtaacccgaaaactccttttcggtccacgcatcaatagcggcccctagcagaatatattgacccaccgggcatacataaaaatcatattttctgaacctctagtgtatacttgtatgaacccctttgcatcacgattatcgattaagctcaaggctagatatgtgccatcctctaatagctcaatcattcactcgaatctgttgatggattatataacttgtgattgactcctcattcacctttggcatggccatgcacttccataatctacaacattgaggggcccagagatatctctccataggaggggcaaatcccatcttgattattcatatcccactacatgtttcatagcatacccgaaaactacttttataactacccaattatggagtagcgtttagcagtccctaagtaagctactacacatgttgagaaccatgataatctcaggtctaaggattcaacatcaacactcaatgagatcactgatgacacaatacatatggctcttgcagtgtctcatgttgggtctatccaacaacatattcaccaacatgtgtccacattattaatttggtatctttataccatgatccatgagacatgatcatcaattaatacatgtgctgatcatataaacacatttgttccacatatgatatttgatttgggatcctttagaaatagtaacaaacaacataaagagtctcatgaaagaatcacatattcattaaccaataaggagttatctatttcaaggaacaatgtcggataaatatgtaaacatagtatgtgatacaatcatctctatgattgcaactagggcatatcactaacagtctcccacttgcactagagtcaatcatgaatgtatcttacgcccattgccctagtgtgtgcctgatgcttaggttgagggagtggctttgtcaacggatctgcaacattgaaatccgtatgtattttgcatatcttcacaactcctcttcccactatctcgcgaatgaggtgataccgccataaaatgttggacttttgatgcgatctaggctccttggcttgcgcaatagcaccactattatcgcaataaaggtccatagggctagaagcactagtcatcacacctagttgaaaaacgaatttctttatccaaacagcctcctttgctgcttcagaagcggcaatgtattcggcttctgttatagaatcaaccactgtatcttgcttggaactcttccaactcacagcgcctccattcaggcagaacacaaatccagactgcgatctaaaatcatctttgtcggtttggaagcttgcgtcagtgtaaccttttacaacgagctcttcctgtcctccatagactaggaacatatccttagttcttctcaagtacttcaggatattctttacagctatccagtgactctcacctggatctgattggtatcggcttgttgcactaagtgcatatgaaacatctggatgtgtacatagcatagcatacataatggatccgattgccgaggcatatggaatcacactcatcttgtttcgctcatcagtcgtttgaggacactgattcttgccaagattaatgccatgtgacatcggtaagaaacctttcttagaatcttgcatattgaacctcttcaacaccttgtcaatatatgtactctggcttaatccaattagcctctttgatctatctctatagatccttatgcccagaatatatgctgcttcccctaagtccttcattgaaaaactatttttcaacgatgtcttaacggattcaagcataggaatatcattcccaatcaataatatgtcatctacatataggacaaggcttttcttcgtttttgacaaagcccacgccttgactacttcgtcaaaacgaatattccaactccgagatgcttgctttaacccataaatggatttttgcaatttgcatatctttttagctgattgtggatcaacaaatcccttgagttgtgtcatgtacacatcctcatcgatatttccattgacgaaagctgttttgacatccatttgccatatctcataatcgaaataggcagttatcgctaaaacaatctgaatagattttagcatggcgactagcgagaaagtttcatcataatcaacaccttgaatttgtctgaaacctttcgccaccaatcgtgccttgtagatgtgaacatttccatctacatctgtctttttcttaaagacccatttccactcaatggcttttacaccatcaggtggatcaaccaagttccaaacttgattgacatgcatggattctatttcggatttcatggctccaagtcccaccattgcttcctcataggtagttggttcatcgttttctaacaacaatatatcacgttgtcctgtagttaataacgcatacctcgcaggtgtacaccgtatcctttcggaccttcgtgaagctggtgcttccacaactggttcaacaacaacttgttcaacctgttgaacaacatcttgctcagcttgtggttgtgtggacgttgaagcgttttccagtgtttcctaaatttcttcaagtcgcaccatgctcccactattctttcttaaaataaactctttttccaagaaaacaccatgtcgggcgacaaacactttgccctcttcccgattataaaaataatatcctttcgtttccttaggataccccacaaagaagcatttatctgatttaggtgtgagtttgtccgattgcaaacgttttacatagacctcacagccccaaatctttaggaaagacaaactgggacgcttccctgtccatatctcatatggtgtcttattcactgattttgatggaaccttgtttagtgtgaacgcagctttctctagagcgtaagcccaaaagcttagcggcagatcagtttggctcatcattgatcgcactatgtctaacaatgtacgattcctccgttcagacaccccattccactgaggcgttcctggtggagtgagttgtggaacaattccacactcctttagatgattgccaaattcaaggctcaagtactctccaccacgatcagatcgtagatacttgattgtcttgcccaaatgattttgtactcagacttatgcttcattaagtagacataaccatatctactaaagtcatcggtaaaggtaataaagtacccaaaaccacctctggcagttgagctcattggtccacatacatcagtatgtactagtcccaatagttcacttgccctttcactttgacccgtgaaaggtgcctttgtcattttgtcaagtaaacaagattaacatgtctcaaatgattcaaaatcaaacgagtgtagaagtccatctctatgaagcttctccatgcgtttctcatttatatgacccaggcgacaatgccaaataaaagtgggattcaaatcattaggacgtcgccgttttgcattaatgttatagaccgaacatccatcaagattcacaatgtataagccattcatcatgggtgcatggaaatagaaaatgtcattataatagactgaacaaccattgtccacagatctaaaaccataaccctctgcttgcaaacaagaagcagagataacgttcttacacaaagctggaatgcaataacaattatttaactccaaaactaatcctgacggtaaagataatggcatagtgccgaccgcaacagcagcaactcttgctccattgcccacgcgaatatccacttcgcctcttgctaagctcctacttctttttagcccctgcaacgatttgcatatgtgagcaactgatccggtatcaaatacccaagaatcagtagaggaagtagcaagattaatttctataacattaatacctgaggtgaaactctttccatcctgctgcttctgcttgagctactctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgaccactcttcttgttgttgggcttgctcttatgcataaccatcacatggttggagtttttcttaatgctttccttcgcagtctttagcatcccatgcaattctgccaaggtcttattcaggttgttcatgttgaaattcattatgaacggctcaaagctgggagggagcgactggagaatcaaatcagtagccaactcttggctaaggggaaagccaagcttatccagactctcggtataaccaatcattttgatcatatgtgggctcactggattaccttctgcaagcctgcacgcaaacaaggacttttaggtattaaacctctcagctcttgcttggtcctcaaacatgttacatagtcccgtgattatcgtatgagcatccaatgcctcatattgcctttgaagctcaggggacatagtagcaagcatgagacagcttatatcaaagtattcattgcatcgcatttcatgctccctacgttgagcagcacgagcattgttgggcaagtcagctagaaaaggttgtgtaagcacaaactctttgtgctcttgcctgagaacaattctcaggttgcgataccaatccatgaagtttattccagtcaacttctctttctcaagaatagaccgcaagttaaaattggatggtgcaggagctgccatgatctacaatagaaatatatgtatgcaaagtcagcaccatgtttacatttaacctttcattaaacaatttaacaaaagatactcccactatgtattgtgaaacaaaattccctctagtaacatagtgagtcaagatcctcattttattagtgtctagtgagctttggcatcacagctatacaactatcaaaataggtaagcaacaccttactaatcacatcatatgtgactcttgtgttgttgggtgacatctccatgtccaacccaacctatgccccaaggtccaaaactgttttgataaccttgtcaagtaaactaataatctccgcatatagatgtccgacatctatcctattttatcatgataaaaagtgacactttgctatggcaaacccatcacttatgatcacaaccgtaataggtgcaattattggaagagcataaactacacttaatttttctgagggaatctatcctaccatgtcatatcaaatatacaaacaacaataaagtaagatagatataaaaaccccaagcgaaatctaaggggcaacgcacacggcggtcccacgggtttcagggcagcgccctgaaaaggtcacggggtacatagatctcatctacgattcgccatgtgaaaaccttaacagcgtaatcaaattatgccaaaaccgagtcaatctcactggctcgtttttctcattggcgtgcagttccagtggacatcggactatccgatgaacacaattgcactcggccttggtgagtactagacattccagtgaagtcaccaacacacataccgattgatcttatcaacccatgcggctaccagttcatctcatgttccgatcacctaagaacacatatacaacataatagatctcatctactacatccgcatatcaattatatgcaatgatctagatcataaactatacaaggcggctctgataccactgttgggatacgcgtaggctatgatagcatagatcaaaattttctatcgcgtaaaccaggaaccatgaagtgttagatcatagatcgttaccactcgacgtgctgcgcagcggaagaagacactgagaagttgaaggaactctcgcgaagtagcgcgcgtcgatgtagaggaagtagtcgatcgcaccggctcgaccttctcctcctcgtgcgttctcctcgccgtactcccacgccgatcagcaccgcaaaccagcggcgcctctaccggtatccacacatacagggacggaacgccacgcgcagatgtgctagcacccgcgcgtggctagggtttttctcggggagggaagtgatggctagggtttctcacgtgatgcaatgtatccgccggtcacacccctcacgaatatataggatccatcactcgggcctccaaggcccgtaggactcctattcggatccctatccgaattaagctcatattggatctctatccaatccccttattccggcccattaagcatgcgaccctgtaggttcatatatactcggctgtaacccgaaaactcctttttggtccacgcgtcaacagcagcccctagcataacgtattgacccaccgggcatacataaagatcatatcggctgaacctctagtgtatacttgtatgaacccctttgcctcacgattatcgattaagctcaaggccagatatgtgccatcctctaatagctcaatcattcactcgaacctgttgatggattatataacttgtgattgactcctcaatcacctttggcatggccatgcacttccataatcgacaacatcgaggggcccagagatatctctccataggaggggcaaatcccatattgattatttatattccactacatgtttcatagcatacctgaaaactacttttataactatctaattatggagtagcgtttagcagtccctaagtaagctactacacatgttgagaaccacgataatctcaggtctaaggattcaacaccaatactcaataagatcactgatgacacaacacatatggctcttgcagtgtctcatattgggtctatccaacaacatgtttaccaacatgtgtccacattattaatttggtatctttataccatgatccatgagacatgatcatcaattaatacatgtgctgatcatataaacatatttgttccacatatgatatttgatctgggatcctttagaaatagtaacaaacaacataaagagtctcgtgaaagaatcacatattcattaaccaataaggagttatctatttcaaggaacaatgtcggataaatatgtaaacatagtatgtgatacaattatctctatgattgcctctagggcatatcattaacagccaccgccagcttctcattccatgaagctagctagcagacaatggaagccactgggatgcagctgacgcactcatcttccttttctccccacctccgccgctcccggacttgcattagagcgtcgccgtgcatgtcgcctcgctttgacgccaacctcgccaaatctgccccgctgccgcggcatcgcttccttccatggcagcctcgatgagccatcgggctgtaatttgcggatgccgaggaacccatccgcccacccattttggcccacacgaagagctgctccaccattgctgtggggaggtccaccccgtcacatgcaggccatggcaactagccgacgcagagcgagagagcacaccagtggcaagcagttggtggtgaccatggcacgcggtggccgccagcgcacaggatgaggagatcgagcgtcgatgtcgacagcatggctagaccatgacatggtggctggcgcaaggttcttccgtcatcgaagctctacagtggcatcctagggaacccctgtttaaccttggcaatttatcgaatcctatttgaatgacggcatgttagcgaagctagtttttttttcaattacatagatgcaaatttttttgactatatgttcatcaagtaatgagaaaccataaaacactagtacagatcctcccatcaatgaaggcctctcacataactgggttttgtgttccgtcactccagatttgcccgagacatgcacctaaggagaaaatcgcaatcgggccgaaataaacaccgacgtagatcaactcgtacagatataattgagttgcatatatcaagtgcccatcaccgatgagactcatctgtgacgggcctacgtttaggcccgattgagattatctctacaatctttgtcgggcccaacacttaagcctgcaatggatgagtatcatcggtgacgggcgacaaacacatcccgattaacataaatttaaggcctatcaccaatgagcagttatcgatgacgggcttattggtatgcccgtttgagataactgaacgcccgtgaccgatgttctttcattggccgttactgatatctattgtacactacaaatactccaccccattgttctctgaagttatcccactgttcactattttggtgagaggttgaagggggtgaatttttgtgtatttttccaagaaaaacagaaaattcataaagtcagtgaagaatactaatcaattctcattaatttagtaatacttatcctataagatgtttctctaatattttttcatttttgcaatgatgaatcgaagttggatatatgggaagactgtgaaacgtcatagcaaggagtatagaaatgatgtattaaattttataaatgcagcggaggaggataagaaaagaagaaacaacgattacatgtgttgtccatgtgtggattgcaagaatgagaatatgtttgatagcagagtggacatacatggtcatatgatacaacgaggattcatggagggctacgcatgttgggtgaagcgtggagagcaagaagttacttctgcagatagaagtggtgcaaaaaatcaggaagaagaagatgagcatgatatgtttgtaccttctccattgggcagtgaaatggttgatgtggatcacgatctgctgcaggacatgttacgtgacgttgaggacccagcttacaacaagagagattctatgaagttcagaaggttggtcagtgactcggagacacctctatacgctggatgcagggcaaaacacaccaaattgtcagctaccttggacctaatgaagctgaaggcaagtagtggatggacagacaagagtttcacacaaattttgggaatattgaaggccatgcttcctgatgatatcctaaccaaccggacaaggaattgggcaagggcaagggtgaagaagaatagcgacggaacacttacgttcccaaatgccgaagatcaagcagtgtatcagaaaattgtaagttcaacacatcgcatatgttcaatttgtgtttgtgtctatcgtagtgtcgatttaacctggccttaattgtgcggcaagtcgaccttactgcctagagacagttctcgcaagaggtctcctcacaaagatgggatgatgacatcctcacggtagcgttgggaaacgaagaacaccgtggatggataagcggcattggctccgatattccatggaagcatgggtttccccaatacgcgtggcagtacaagaagaacaaactgacaaaggcggagaaagatgcacgcctcaaggaacaacttatggaggacatcagagctgagctaagctctgaattcgatgagaagttgtcacgggtggaggcacgcatcaggggtgagcaccagcaagggaacgtcgaccccgccgacgctcccagagtagaagtgagccccacggaaaggcgtagcagctgcgcatcaactgaagcggcggaagaacaaccaccagtccctaccgcagtggaccacacaatggtaaaaccaacaaataaagcatatgttgtcttagctcatcaatatgttatgacatattctaagaacatgtatgaatctatcacagggtcccatagagtgcaccctagtcgttagggtgacacaagcatttacacttcctaccgccaagggtcttgcgttcaagcctacaccgaaaacccgagttcatcgggcgtagttgatggccaggcatgctaaagtacaagtggacttagtcaagcccgaatgggtaggctccactctgatgcatccaccaaatgacgaggttttgaccctaggagttgcacatgggacctttatccaatggcccaagcataacattcagataaaatataagtcctaggccaacaccaagtactagacccactacaactcttatatctgcccctcctgccattgaagaaggagatgaagatctccaattgtaatatgatacagattttggggatgagggtttggaagtcgacagcatggcgtactttccccctcctgccaaaaagagcaagaaggcccaatcttctccaccacagcatgaaacaaaaaagaaagctgttgggagggggagaggaagaggaaaggtagaagcctcgcttctagttcccaataagccaaatcttggcaaggcaccatcagctcgtcccacggctccgaccgacttcacattaggcatgccactggttggagacgacatgttagcgaagatgggccctgcttgcaaggagttgcacgggtactacatggagatgtccaacacaaggaggaagcatagagagacctgcatgacgggccatcacgatagacagccattccttgggcctccaagctttattgctgttggtatttcttaatgtcacagataaaatccgcaagcgcacggaagataccgatgtagcacttcacctgggagtattccaaggtatagatttccacaggaacttgtgtgtcatctcttcactaggttcatccaaggacacaaagctaaggtaggctaagggtagagaggatttactagtgagagacagtgtctatagaaagctcagtttaatcctaacgcggtacttcgggcgctggccagtccgctgctcccagatatggctcttcaaagtacccagatagggatgactttagtgttttgagggctatcaccacctctacacctacctcaaacatactgtgggatatgaagcaaataccgaaaattaactacccagataccacgtctacgaagtttaataactactttaatgttagctaaacactaaagcaaccactatattttattggattatagtgatcagtgaccccataagttgattaggaactaaccaagaggtaactctcacagaataaatattaattactcccaatgatatttcgattaaagcagagtacttaacagagtgaaagaaataagaaaaggattaccgacaactccggaattcctccgacttcctctactctactctctccctaattctagtatataatatagtacaatagcgcctcttataatttagctcaagctttaagttgtgttgaaagtgaagtgaaaaactccttttatagggcaagtatgatgattataacgatgcaaaatgtcttaattgccccgcggttgacggtcgttatcgaccagtttcgaccatcaaaccatgtgaagaatggttgcacgttgttgcgagaaatcggtacaagtaagagaggacctcgagttaagtaccgtgaactacagggtttgaaatacagggttaaactctattgtttcctatgcaagagactataaaatgtaatcgcctagaaccaaaagagttggaatggaatgcatcaagaatactaagagtacggaaaagctgtttctggccctcctagaagatagtaccccatatgcatatggttttcttctagcatgactttctctttatggagacaactcttcccgttaagatataacagaaaaatagttttgttgctgctgacttgctaaagtatatacatagagttctctacattggtgtttaccctatcatgcaataggaaacggctggttaatttccattatttttcctaaataagaaaagatcatgccgctatttttttcattccaaggtgttttgagtatcgtaaatgggctatacatgttagactgttagcaaaaatgtactttgtttcaaattagtacttagaattgtaataggtgtatgatagacttagagtcatagtctactctaggttatcccttctttctataaagttaagacccaaagctaatatttagttaagccacgtcatcatttaattgtcagccgttggattacatctgagcggtcctcattgcgttttcgtagcacgtcctcggtcccttcgctcgccccccaccgcatcgccttccacaccggaccccacggctatttgcctccccccagcctcatcgcctattcgcctcctccctggccctggcaacaatgacgacggcggcgacggactctgtcgatgacgacagtgacagcggcggtcgcggacgagtgtggcgacaagggcagcagcggcggcggaggtcacggacgaggacgacggcgatcgagggcagcggcggacacggaagagggaggcagcagcatttgagggcggcagtggacgcggacgagggcagcagcgttggtcacggcgaacgagggctacagcgccggtcttaggcatatttggtactaatatgttctgtgatttatctgttttgcagctctgatgtgtagatgagtagcatatgactctccgtcgcaaatcgataatgcctattgcctgtgattctcccgcatgtctagccgaataattgcatccttcctcacaagcatggtgcagcgccaccaagtctctctctccaaatccaggaaactgcaaggcatcaactgtggcaattaaatcaattatcaattccatcagcacacttgagttttctcagaaatcgatttcttcaacctgcatccggttcctggccacagatgtcttctcacagtgtttgggtatgacttgaggactttatcttcatgtttcctttttctcatgtttttttcttctacttttatctaagcccctttcagcttattgcatcgaggtttggtattgcttgagctaaatcatatttatatgtgcagagcatccgcagatttggttcattggtttcgttcaagcttcactctttcattgtactgttaggtgatgtttgatgttctctttcatgctatatcttgcattcctactttcccgtggattttatagcacttacctctaaatttcgccttcaattttcagttttatttttttctcgaaaacactggagagctgcatttcatttcatttcagttttattttctgtgatgaggttttttttttctttaatgcaaaggtgatttatcaaactttcagaactgcaatatgctattctctgtttaattcttattatcggaatataccatattatgccagtgtcaatcatatcaagcacttttaatattatgccaggggcaatcatatcaagcacttttaatcaaagaacaaatgaacgcaattctcagcagcgtacagtaccaggtatattctgctattctataattgtatcccattaacctgcatttaattttttttctatcttgcaataacaatttgcatgggccttttactaaccatacaaaacacttctacattttgcaaatgaaatttcctatttcatcacacttctacattttgatggtgttttgcctattttcatcaagtagtgttattaccaccctacagggtgactttcctagatcatgtcatcaattatgatgtattctttagttgttgtttacccacaaacaagctctgatgcccaatattcagctacatgttcagctaatgagaatgtgtccaatcataggctaagtgacgtttcagtgttttaagataatttcacattcttatgttggacactcaattaattgtacatgtttttaatttcaggcttgaatatgatctgctaattacacaatatccattgcctccacggtttgaaactatctgctcacacttctatgaaccccgcaatgctcctttactaatcaagtaatcactccagttggtagctagattagggtttgtacgatacttaaaaggagttcagaagcagcacaccacttaaacaggtaaatatacagcagtttttttattagagattcattaattgttggaaattaagatgttcaggaaatcacacattcacacttgacaagttgatagctacttctagctatacaaatgcactatcgctgaattgagatctgctattttcaatgaagaactcccattattcgcaccagactacatgtatatatttgtacaacattcatattgcccttcttcagagttatttgcactgttcctaccctagttgattactttgttgtgtaatgcttgggcatttgtcagcacttaaaatatcatgatcacttcttacaaatcccgcagcaacgcgcggggtatcacctagtttgttaaatagagaagcacatataaccgtatggtaactatagcacatttttttaattagataatagattaaaaacccagtcactacatccaaaagctgtacacaaccaggtgactgtagcacatgcgagggatgattgggcggcagcctagtcggttgatggataccttgatgcgctgtaaccatgctatatcagggaggagcgttcataatcagaactttcagagatgtgggctatggctagactccatttctaaatattgtgcatccatatcgttattactttggatcttgtatggtgttgttccgcgcttgactacctatgttgatttcggtgcatgttttataacaatgcatttgcaacattatacccatatgaatattaatgagctatgttaggactattagaatacgcgtagactacgatagcataaatcaaaattttctaccacgtaaaccaggaaccgtgcaagtagtagatcatagatcgttaccacacgacgcgctgcgcagcgcaagaaagcgctaagaaggcgaaggaaccctcgcgatgtagcgcatcgatgtagaggaagtaattgatcgcaccggctcgaccttctcctcctcgtgcgttctcctcgccgtactcccacaccgatcagcaccgcaaggcaacgacgactctaccggtatctacacatacagggacagaacgccacgcgcagatgtgctagcactcgcacgcggctagggttttttgctcgggaaggagagtggcggctagggtttctcacgtgatgcaatgcctccaccggtcacatctctcacgaatatataggatccatctccaaggcccataggactcctattcggatccctacccgaattaagcacatattggatctccatccaatccccttatttcggcccattaagcgtgcgactctgtaggttcatgcacactcggctgtaacccgaaaactccttttcagtccacatgtcaacagtggcccctagcagaacgtattgactgaccgggcatacacaaagatcataacggttgaacctctagtgtatacttgtataaacccctttgcctcacgatatcgattaagctcaaggctacatatgtgacattctttaatagctcaatcattcactcaaacttgtgatagattacataacttgtgattgactcctcaaccacctttggcatggctatgcacttctataatctataacatcaaggggcccagagatatctctccataggaggggcaaatctcatcttgattattcatatcccactacatgttttatagcatactcgaaaactacttttataactacccaattacggagtagtgtttagcagtccctatataagttactacacatgttgggaaccatgataatcttaggtctaaggattcaacaccaacactaaatgaaatcactgatgacacaacacatatggctcttgcagtatctatctaacaacatgttccccaagatgtgtccatattattaatttagtatctctataccatgatccataagacatgatcatcaattaatacatgtgcttatcattaaaatatatttgttctacatattatatttgatcagggatcctttaaaaatagcaacatacaacgcaaagagtctcatgaaagaatcacatattcattaaccaataatgagttatctatttcaaacaacaatattagataaatatataaacatagtatataatacaaccgtctttatgatttcctttagggcatatcaccaacaaggacatgaagtaacaaatgagtagaattttgcctttgccaagaagatgtatgcacgtattcattataaaatttataatggcagatcttgtatgaacacggctagaaggctagaaattggaaactaattaaggttgaggtggaggattatgttacttccattaagcacaagcatattaattgttttgctactagtcagtaccacacatatggctagaagctttatctaacgcaattttttttgttaggacgtgtgaaatcatatgacaacacatgggaaacaaaatagaataaggccctgtttgattcagattaggattattataatttagattattaggaataaagtgaaacaaacagatagcctattatgatggattattataatctataagccagattactttaatctagtaatctactctaaatgttctttttttagtttattgggttgctaacagctaacaaacagcttataatccagagaaacaaacagcttatagcttattctatatatgttggcttattataattcagcttacagtaatctaactcaacaatctacgttacaataatattaagccgaaacaaacaggtcctaattcagtgtagagtcatttttgtacgtgcacgaaactgcttttccaaatcttgtttcatcttcaggtccatggatcgtcacaggttgtgcatgtatgaaatcaatactgtaacaatatcaccacaggagagtaatacctatgttttgcgcagaaatttcatcgttgaacagtggtttcatcctatttaactgagaattcactacatctattgtgtcacacatttggtctgcagtctgcacctagtacatttatatgaaatagtgggtcaccttctgcgatctgccaattgctccgagtcaagatcttgccaatatacattaagagcctattcgcttttgatgtcatttttaaccatattatttttggtaaagttgctaaaaaaatgtctacgtttagcttgttgccaaaattggtaaatacataagaaatcctaccaaaattttgatactattatcatcttaccaaaattttgttactgctaaaatttggtactccctccatcccataatataagagattttgagtttttgcttgcaatatttgaccattcgtcttattaaaaaaaatttaaaattattatttattttatttgtgacttgctttattatctacagtattttaagcataacttttcgttttttatatttgcaaaaaaaattgaataagacgagtggtcaaaaactcaaaatctcttatattgtgggacggagggagtaagatttattttagatataatctaaatatgccctaaaacagaaactataaattagagatcagtagaattgaaaacttcacatgatggaccagatgtttctggagtccatcaaagatctaccgacttcttcatcgtcggctagccagtgggcggactagtacatttcctgtgcatcgacaattaacgtctacctacttttggatcatagcgaaaaaagtcggatcggggattaaccttgtgcagggttagcgatctcgaaattatgttttttcgggggagggtagaactgaaatttctgaaacatcggaaaattgatggccgaatttattttaaaatataacgaatttaaataaacttttatcaaattcacaggaaattggaaaaagatgaaaattttggatgagatttttgcttgccggtggggaaatttctgaaatttcgaaccgaaatttcaatcactaacctagtgaggtcgtcggttcacggtccaccagttcaccagttagatgacataattattctttcactttaattaattttaacagtgcgaaatataatactttaccctttgatatctagtaaatttcacttgcacagctggttacgtggaaacgcgcggtacgcttaccgtatgtcatcatgccatgcacgaggtcatgggttcaactccccacttttgcaacatttcgctagagaaccatccggtttgatggttttccactggttcacatgcatgaacggaatttcctacaaaccgtactgcgccaggctttggttctagtttaactgtcggttcggtctggttttttctactatattagtttaaccgcgtgctcggtccgtttttttctactatattaggacagcagtagcttatatatcagccggcatactgtttgtgttgcaaaaggagacctcactgatctcctgggaaagacaaagaagtgatacacaatggctgacaatgtcgatgatgactctcaatgggtggaagtggtgatgatcaatagttatgccctatttatggggtacttgtccatggccatcagagggatgggcttcctggtggttttgtggactaccttcatcctcctcggtggcttcgtctccatgctcgagaaggacttctggagtctcaccgtcatcaccctcgcacaaacaactgggttagtgatctatatttaacttgctcctcaagcttcatttgctgcttattaattcgttgtctccttttttttttttgtttctggtaataaatttgagaaaggagaaaaggcttttggagcttggaacttcgaaaaaaagctccttgactcactcctccgcatcatttctgatgttcatgtagttttatccggaatatataagaatttgtgatgcaaaggaattacataggaattaacactagcagtcctatagaaacacgttgtcagtaattagaaagagcacaggttaattgcttgacgggagtcaataataaaatcagcgcgaaaatagtgctgattgaggaaaatgtacaccgttggcgaatggcgatagatgttttgctcctccttgtccagatagctgatcaatgatctgctccaataatttccatgatgacagcactgatgtcagagattccaggacagctgtgacgtcaaagagcgacagggagggacagaataataaagatgaagtaatgggcgtggttgactggctaaccacgactgtgtttaggtcacactgaagtttaaaagcttggttgaaattagtatgatgtgatagaaaagttgtgtgtgtataaaaggtttaatgtgatagaaagttggaagtttggaaaaaaactttagaactaaacagggcccaaaattctttgggatctattctttcttcctctcttctaaattttactctcatgtttttcatgcgcacgccttctaaattatgtgtttttacgcatatttttagaaaagttgctttaaaaattatattaatatattttcaaataaaatgtaggtaatacttaattaatcatcactactggatagctttactcccggttggtaaccccctatagtcctggttatgcaaccgggactacgaatccaggattaaagatgctcatctttagtcctgggtaaaataactagagtaaaaattcattttctagtcccggcactaaccaggactaaagatggagccaggccaggtccatttgctctctttttcctttttcattgtttttaacattaaatattgatttcactctgtcggtgacatggaaccgggagtatcatgactagaggcttgaggcagacacaatcgcccacgtagcctggcaccctcggggggcgtcgggcccgagggtgatgcgttcgccctcctcttagtccccccgagggggtcg

SEQ ID NO: 5575 - DNA, 7086 bp, Oryza sativa
acctaaccacatttattgcggtttggttgagcgtgtcacgccgcatgtaacgcagtgcagtgcactcgtttatccggtctgtgaccagtcacagaccggtcagatcgcgggttaggtggcgacaggcgatctgacacacgcctcgccccatcccgtcaggacgagggcttctaggcactcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgacgtgactggactaataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccacggagagacgagactggacttttccagattagaaacccagaacaagggagaggctggctgatactttgtagctccttcatacacagatgtcccaaaacacaggagtagggtattacgcttctcagcggcccgaacctgtatacatcgcccgtgtcttgcgtgtttcctgtctcgcgagccttccacatacagagagcttagaatctctccctgagtccccggccgaaccggcaaaggggggcctgcgcggtctcccggtgaggagccccacgctccgtcacactccatcctcgaatcatccctaaatcctgaaatcccaaatcctcaaatcgatcatctccaagtacatcctaagtcatcacagatcacagatcaaaaggatcatctccaaatcctcaaatcgatcatctccaaatacatcacaaattcctaaaaaaattacatcataagttctaaaaaattcatcataaatacatcacatattcacatcacacacaaataaaatacatcgcaggatcatgcaatgaatcacaaattctttaaaaaaaattgttgctgcagcctcccgcctcctctccggcagaggcgccggccggccgctaccgcctcccctcctcccgtccacgccggccattgccacctcccgcctcccctccgcactgccctccatgtcgtcacgcaggctgctgcccgtcgcccggacgaccggccctctaccgcgccctgcgccgcccggtcttcccgctccagcactccttctccagcgctcgttcctagccaataaggctcagctctcagcgaaggaaagagataaggaaaaaagaaatagagagaggagtttgtgtggacgggagaagaggataagtgctatggaggattatatactgcattttgatttttattcctggttagtaattggtgttactaaccgggactaaagatcccgatcgccctgacacggcttgacatggaatcaactgggactaaagatcacatagtcccattgtgcttttaaaccaagactaaaaatattctttagtcttggatttttaagcaatcgggactattgtggtttttggcaaccgaccaaggatggtttctccagtagtgcatgcgttaatccatcgctctgtttcgtgtgtcggggaggatgagttcccaacccctcctcctgaacagagatcactgaactacacacgacgttgaccttccatcttcacttgtcacatctacaaccctaatgtagtttaccgcttgcaacccaaaaatgttttcccgctgctctcgctgttgtcaagccttgcacagctcaaaacactggcaccatcacaaaagagcacattagtaccctcttatcagtgctggtttgacaaaacccgatactgatgatggttgatggttttgaaccccaaaaaataagttcttgctacatacatgcttcatctggcattgatgaggagacatcaccatggtcaccggcacacctcactttccctgtcccaacctttgcctctcaagtttatccaactgccaccttgtcttagcgcatctgtatcaccacaactctgtcactccttgctctagcaccatctacagtgacaccaaaggaagtatgcagcagaaaatgaacgtgaaccgattcctaggaaactgtgcgatgctggtactagtcccaggaagaacatgctagtacctgtggttaattgaggtacatcatataatataaatagttgatatcatataggaggtcacaccttcagaataacttcgaaaaagtaaacagtaagtagagaagtagcaacggaacttagtgtagctagaacccagttacaagcaactggttgggattagatatgaaacccaactcttcaacttcacttctttctagggagaggaaaaataaggttgagttcgtatgtactcagcaagtcatgaaaaatgtgagtatgcaagcttcgaaggagggctgggtttatttcataaatctttcttcaaaatacatttttttaaaacactaagcgtgggttgtttttataacatgactgtaaagaggctttcgcttcaaccctattcatgaattgatttgcaacaactaaagcagacgaagcaagttttagttgattgaaattactagtgaagtctattgctctgccatttgtctaaccaaagaaaatggctcatagtctaccatcaggcaactcttatctcttctctcctctggctgattctagtaaatggttctcattcccacaatccatttttacaaagcataggcaaagaaatctacacaagaggaaccattgcacatacacccatgaccatgggcgcaattgtccgaacagtttcatcctgcagaggtgcacgctttacccacatgactcgaacttacttcccacacctgtagatagggaaggttcatgtcaaggccttcccaaaacaattctagtgatacctcatgcacgatagtcaatccactctcaaacaagtagtatgcgaaccttctgcatcctcacccttctccagaattcggggatgtcacctcactgcacatcccgacatttctcacctattggcaaatgaggtatattgttctggctaattacatagccagccatgtcctataccactcatgtgatcgtactgtatttatgatcagtgtaattccacaaggaatcgatccttatatgcaaatatagaggattgcctccaataaggccgctttgcatcgtgtgttttcgaaaataacttctattttcacaaacattgcaacaccacgtgttgggattttaaaggttttgcaatctagttttacatgtcgacaagcaatgcttttgtgagtgggaccatcggcaatatgaccaagagcacagttaccgaggtaccatggggtggagtgacaaggcgtactggtatcaatcaacctataggattgatgcaactatcaggtaggtccatcggtttgtcacacaaaccaaggccagtcaatttagtgtgcacactagtaatgtaatttgcaaataaaacattttgtaaaatggggaccatatatggtcaagggtgacttgcctctgtcttcatcttcaaaatctcgagaacccgctccaaaaataatttccatcatcgaagactgcatgcaagatggagaaaataacacaaaatcttacaaagaaaatactatacttagcaactaatagtgccattggtagatctcattttttacaaaaatttggagacttgaacggggtcaagcggagatatggataaaaagatattgattttctggaatttttggaaaagattaatgaattttggaaaagagtattctcaagaatattctttttgtcagactggcatgtggggtccacatgtcagtgatagggtgagagggagggaggtaatgtggacttacgtatacggaagggggtaatgggctcggcccaaagaggagggaggcataatggactttgcaatgtggatcgggcttagtgggtcggcctcaccagctcaagcggagagatgctgcagcatgggggagggaggttaaggaggtggggcctagtgtcatcaacactttatttgaaatcacctttaaatggtctctagcccacatgtcaatgaggtacgaggagggattagcatggatgagcggtgtcagtgggatctgacgatggggtggcggtccaaattttgccgacgaatgacggcggtccgcgagcagtggcgaccaccatgagaataagtgggagtatgggagtccttatgcgggctcagatgtggatgggggtggacaacggtgacaaatggcaggttcagacatcagtgacggactactccagccgtgcgacgtaatgtcactggtggcaaccaaagaggtggcagaggtgggtgggctatggttcgggtggaggcggtgcacggagagagagagaggaaaaggaagaaaagaggctaaatggggctcatcgaatgagagggagcataagagaaggcggcaccactcttgttgacttaagcttgagctcttccagctagcatggggaggccagctagtgagcacactgggggaagagaagaggagagggtccacaggttcatagccataaggtggtgctaggcgacaagtaagaatggaggggtgcgcggcgtggattagtgcggctggctagtgggcccgtgggattggctgtgcggcggacgttcatgctgacatgggtgagcgggtgtgtgcgggggtacgatgtgcgctcctgggctggcctgtggccgtggggcggtggcggtgcgagggatcaagttgggccgaagaaggaaaggaggggacgtctctatagggaacattagcacttcataatttcaagagaatatatatgaagggtagttgaaggatttgaattgtggtttgaatcaaaatttgatatttgagctcacaaaaagttttggatttcattcaagaggcttttgactgggatttagaatatttttgagaaaaggtcttgatcttcagtataaattgaagaacaaaaggatagaaaaaaatggaaaattcaaggaggtttggatttgaaaatttgaaatttgaataggagatatttggtgggggggggcattgatcaggaagaggcttcagggacaaacttgatgagaccttggcatttgggtttttattagagtaagtttcataatggatcagtttttattaccttcattgcatgatggactaggtggtagcataacttttcactttgggctaggtattattaccataaattcacttaacactagtggcccatatgtcagtcaatgtccgtaacccttatctctctcgaacactggtggccaacaattaacagatactcaacctaatcatagctacccatcatcaacttctctcctgaagcagcttgttggatggaggtttagcttgagagattgcaggactaggagggttgagcttgatgcagtgacgggtgtgggcgagatcgaccgagtggcctgagctgacaaaggtcgagctcaaacttgagctccaatgcacaagcagggattggaggaggtcaagctagattggtggcacgatcttgatggtctgctcaccgccgatggtgagctcaagtgcggagcaacgctcaatgcagctccagtgcaaggtcgagcttgatgcagtgtagggcaggggcttgatcaccggccagcggcagctcactcaaggtcctggtctcccagagccttgctcatctatggtagcgaccttcagctagatggcaggtacacctttacagattgggtacaatacaactcaatggagaagagagttggagaagaacaccggttcaatgtgcaactattgtacagttaacaggcccaatgtgaaaatataggtttacctctagttcactgtgcaaccaatgtaaatattagtggtccaatatgtaattcacttcttttattaaaatagtttttaacagaccataaaatagggcatgcttaatagtttacaaatagtttacaaagggtgatttaattgagatctttggcacgcaaacgtagctacgctcagagaatctagatttttgacatagcagggttcgtgttaaaatagttttgtcaattgcatggaattcgaggtgttatagtctgcgggggtcagcgtcaaggagattggcatggacccgtatgacatcagcaccaacagggctggtgctaagctcgcggtccctttttattgaagttttctaacgcagtgtttcgaaataagttttcaaagtgaaacaatttgtcaaattttcggcctccttattacattcgtctgcaatatactacggagtatatgtccacagggtgttcgatgttttcctgaacgaaaagctgacctactttcggaaatccttcttcggcctggtgggtaccatatcagcgatgctagtgaaggtggagaaaggctccttctgcaggatggaaggggtacggctaatgctggcgcgcgttttgctggttctccagctggtggtgctggtggtgatcctctcccctctcgcggtgttctacctgttcggcctcctcatcaccgccggcctctcgctgtggcgcttgctgcagcgcgactacggcgccggcgaggaggcggccaacctcgcgccggcgctcaacgtgctctactcgctggcgctcgtccagggcgccctcttcttctactacttcacctcgcgcctcctcgggaggcggctggcgaacttggtcgccggagtttacagcttcggcggcgagggggaggaggaggatgacggcgggcgcacgtcggtggtggagtacatgcggcagacgaggaacggatgcgagaaggacccgtcgtcggtgagagggaggaacctcgtcacgttcgccgtgacgatgatgaaggagtcgtcgtcgtcgtcgctgtcgtccggcgactactcctccggggctaggatcctcgacaagctcctgtcacaggcctggctgcgggagcagcacgagctcatcaggcagcttgttgggt

SEQ ID NO: 5576 - DNA, 27149 bp, Oryza sativa
cgacgacgacagcgcccagtcctccgatcactacaagaagctcatggtgcagggcctcgtcatcctccacaagctagccgccgcggagcacaaccggcggatcatcatcaacagcacccagggacggcagctgctctccatggccatggcgcccgtcagcgccgacctgctccaccgcatcgaccacgaagcgtggaacgacatcgtcgcctgctcgctgcagctcatgtgccggctcgtcaccgcccccggcgagaccggcgacaagctgcgttcccaggtgctgaacgacaaggacgccatcggcaccatggagaggatcctcaactgcgacggatgcaacgagaagaggctctatattctcgccattaacatcctcacgcagcttcccatggcggcgaagaacaaggtggtggacgaggcttcgagcatgagcgtcgagagcagaaggaaattcaccaagctacttctactcatctataccgacgaagagaaggacgcctttatgagacaaatggcaggtgaagcattggcaatgctgtccgaacgaagcaagagcgacgccacaatcatcttgaaagcaagtgacagcactctcaaggacctcaccgcaatgctcttggatgtaaatagcaacagaggatacagaatatgtgcagctgaaatcctggagcatctgtacattcgatacaccaagcaagatggctatctcaacaatctgacggaagccatgaaagatgtgttgccaaaggtgatcaatatcgaataaatgaatatattatttagtttgtttcatgttgattaactaataagagcaatgtctgtaacaatatatatatatatatatatatatatatatatatatatatatatatatcttgctgttcgtttcaggtgctcggagaaatttttcttgtgtcatggacgcataaagaaaagcaaccaggaatgacagaacaaggaacagagggagttaatttctcggcacaaaaagctgacattgaaagtcaagatcccgttgcttgtcaacatgaaaaggttaaagaggaaaacgaaaaggttaaagaggaaaatgaaaaagttaaagagcaagatgaaaaggttaaagagcaaactgtggatatgaaactttatgcagctttactgtcacttagtgaggcaatatttcaaagattggtcaatgatgataaagatttggctgaactgactgataaaattgccccaggaggaggcactgcatttagcttcgccggaaagctcaaggagatggtagaaggaaacagtgaacaagcaacagccaattgcctgagaatgctgaagattactaccaggatgatcatatcattgataaatctcaatggagccaaagtcggagcagacctggagagcttgatgcattctctgttaaaagcttcagaaaagatgttggaactggagggcttcatgattttctctagcagcgatcgtaccgaaagcacgaatcctgccaacattctcgcttccctcgtgaaagaagcacaggagcttctggagaagaagaggcaggcacaaactacacccgctccatcaatggagaccagctgattgagtaaacagactatcaacacgatcgtatgctgatctgcagactgttggcagtaatacctggaaactgacaccgtacaatccctgaaaactgtctctgtaatctgtatgtgtgctgaaacttatctatcttgtcaattgtcccatctatttcaaaaactttcaagttgaactttacaacaaactgttgagctttattggcagttcgtataatatcctcttggaacagtagataaaacctatctgaagaggtgaagaggccaaggatctgcatcaacctactgcacattcagtacttgctcacctatgttaggggtgaaacaactattacataattcgggtattttgtatgcattttaaaacaagttggataatcagagacaccaattctgatgtactcgtctaataaatttatccaggacttcggacggaactcagcccatctgaagtattcagttagtttgttaggctttgttagatagggttgttagtcaattagaatcaatcaatcaagaaagttaaatctatatctagtcctcccttctatgtccatcctcattcaagctctgggacagggaggctgcaggcctcgcccttcgcccttccgtcgagcaccccaattcaatctacgcacacaatatcttggtatcaaattcaagcgatcctttcctagctttcaccgtggctgccatcatgacgacctccatggccttcgtcattcatccatggccatgcaaaacgccatcacagagatcaaggatgggctccacaaagtgacaaaatcggtattggccctccgcgcggggtttgaggcaaaaaaggtgcggggagaaacaacgacgatgacgacgacgccgtctctgtcggccacgtggtcggaggtggaattgctgcaagccactcgctgatgtggcgccactttctcagccgttgtccttatccaaggctgtggtagtggtgccatgcctcgtcatagtccagtctattattcaacccctgtgctacatccgtagtctagagaggttgtgtaatatctataaaagtgaagatacaagatataggatgggactctcttctcattcttcattctatcatcctcaagcacaagtccaacaatgagcagcccccctcctctttatgtagctataatgcacatatggacggtttagatgtgggcccaattagtgtatatatagaaggtttccatgttgcatatatggaaggtttcttgacactcctcccttgggtactcaccgtgtgatgtctatgcctcatcaaaactccagaaaacccagtgggaaaaaattgaagaaagagtacatagcgtacgcttgcaatgtcgcacggattgcctctttaaaaacctggataagaaacttttgggaaaacttatctaaggaaaaaagagtacaatgcacccaattctttgttcaatcattctagattgattttgggtacttgatttctatatcaagattctgtaatgagtcggcgaaattctccccctaaattttgcatttctctaagtctcattattccgatttcttggacacacctattcaaaagatgtcaataatgagttagtggacaaatctgcaggacttatgcattacttagttcgttgcttctatgcaattgatgcacatagaagagcttggggttcatgtgcttagtgagtttgctcctcaagtaactcatttgcatatatgcgacatatactgctttagtttcataaatggtggggggttgagatagttttcaaactgcgattgctgttgcaggtaaccatctctcaaaaccatacctagactttgaataattcaacgatgcttagttcggtttagttcaactggccaagtattcttgtgctgctacgacacactcgtgtttgggaattttgtcccaatttggcggtaattaattattctaaagccatgcaccatgaacatttctatatgtggttggactgatgtactagacttccatctgtcgtatgcctttagctgcaagcgtaagtatgatttggatttggccaaatatttcaaattaaacataaattcaaaacgaacgagtttgtttcttcaattattttctagtttattctattctttatgtgttggttcgggacctagtacttcttcatgtactattatgcaagtgttcgatccaagctcctgaaatgcattcattaattctatcgtcaatgcttaccaacattcaggttgatttcttcttttcaacttctagttcattaattccattcaaatcctggttgactgctaatgagttttgttgtctaaaagagacattacccataataggtctcattgccaacttctactggttgcatgaggctctatgcgagtatccatggacatacaaggagatgattttcatatgcttcttcttcttcttcttattgcttaatgcctcttgatgtgggcatgtaccaatgttagtgtgcactccagcagttggttttcttccttgatgggaaggtgcggtacacctattttgaggtttcgtgccgtttgctagatctcaactagccccccttctattcgatggggtactttttgtgactttgagtatgatagtccctcttgccctgtttcaccagacgtctccagttactttaggggcatgaggagccggagtttcttgtccaattgtttcttttgttcgaggcctctagacatgatgagggatacctttgctttcttcggtatttcaccctcctccggtgcattaattcatgcaacttagtcaaactcttcgaaatcataaaagtatttacaaagtgattttggcagtttcaattctttctgcatactacattcactactagtgcggtgtaacatgtattagtccctttctactatcatatttgctgacatatcctatttaggggttcattctctccaagcctcgaacaaggatactttgctgactgaatttcagtacattgacttcaagcctctcgtgacattgatggtacaaggtttaccatatcattgatttcttgcttgctcaacggccctcatgtcacatttttgaaggggcatttctattcagcacttatgtacctgctacttcccaactacagcagcatattttggttcaaaaaacagaacaaaaagttgagcccagtgagtacagctacacatagaagaacaaatttttgtgtaataatacattggaagatggcctatatcatgatagtcaataaaacatgcatgtatttgttctgaattcacaattaaaacaaattggattggatgaatttctaatgttctgttaccttctcaagcatataagcttactacagaagccttaaaagccatgttttaggtggggctttcctttgctgtgggaaagaatgtgcaacctctttgtacaaactgtagttaatgctggccaataaaaatagatgggggtagagtgctggcttatgctacttgtagcttttcatttttctcatgcatgattttcatggacgactatccattttgtattgtttttccgttgttgcattcgaccttaggtataggaggcatccaggagtccctcatctatacagcagtatattaaaaagttccatggaaatttaaaagcaggaacttgcacttcttcagtatgcaatcatgatttccactaatttagttgtctattcagatttcagaagatgacagatggatctactgcctggttggaggattaaaccatctttgctatcctaatcgatgttaaagagagcttcttcaatcctataaactcataatctctcgctaaggcatgtgaagttgtaacaagaccaatggacgacgattagcccaagcagaagtgtcccacccttttcttccgcctttctctactgcaaaaatagattgaaagatgctagaaaagaagcgttcttggtaatacaggaacatgaggaaaataaatagactataagctgctttgacatgggtgagtacacctgttatttttatgcaggtcctattttttttatcaaataaactttgcctcatattcatatcattaacggtttggaccatcatcaaaatgcatgtaattggacagttttactctatgtggtgctaatatgagctatcacagttattttatgccaaagtattgcacaatgaacaagttaatggttaaatacgataaggaaaaataatttcggctatgagaacatgttccagcaacaaaataattatgaagagtctatgacccaagcttgggaatatgttattgctgaaacaaatatgatatcttgtttggtcaaatcattacaaggttccctcccttcctctattatcttaacctccagcctaaccggtccctctctttctattccaccgttgggcccagcagtcatccaggtgagctggtgtcttgaggccctctcacccatgctgctgcttaggtatgagccgaaccagttgtgccacgtccaaccatttaatgcgttgtgcctgcctatcttctccctccagctacaaaaccattacttttcagttcattacatgaataagcaaaaaaagaacattattagagttgtcgaattagacttatgactgaattgaaggttgattaagcctgaagactaaaacaaaccattttaagagtaaaccttcaacaacaacaacatttatgttagcatacttagaacaggataaatattatgtgccttccatcacatttcaaatatctatatataaactaataatataaagatacaattctattattgacaatggttttgacttttgataatgcccttctgataggatatgtgtaatttttccaaatttactaatttaaacaaataaagaaattgtatacaaaataacctcatgccagtaaagagacccatgctgggctcccatatggcaaccaagcaattaaggcaaatcgattacactttcaatatttgagcttctacacatgaggcatcagaatgtctggtatcatgcttcagattcctcgtgctagttctttccaccgaactagagatttctcatgccaattcacaattgaattcccatctggttgtctgttcaggcagttaacaagacattccccacttttatgctacaacaagggcctcatcctatatacctatacaaatcatcctcactaatatgaatttgctgccatgaggtgcagccacgtcacttaaattgtttcagccgttagatgagcatctatcaacaatagcaaccgtcagatcaaaagatcaaaagctcagatagcatactggtacatgtccatttatttggcccatcccaaccgccgcttccattacggcccattgcatttgcaccagccgcctctcccaaaattttctccgatcaccacagccatcgcttcgcctccgtcttccgctctggcgccctcccatctcctcccaaccctagcgcgcgcgttcagagttccacaccgcgcacacgccgccacctgcatttctctcgtgtcgtctgcgctccgctcgcaccacctagcaatccccgatcccctgcggcgcatccaagggaaacgccccgcgtctcatccctttcccctccccggcgacaggcaggggaatcgacggccaccgcctcagtccgcttcgtctttgggtcttccctgcctaccgccgacaaccaccaacgagcagcttttcatgttttccatgaaaacaattacttcctgtagctgtagcgtaacagccaaatcaccgttgcccttcattgaaatatgaatattagtcgatggtaacgcccgtctacaaaagttgattgccttgcatttttcatagtcacacgccggaatcagcagtctcttttccgttgcattggcgacctgcagcaaggtgccatttttgttccacccatcctccttccttgctatacactttcttatttgtttgtctccttcacctgtccttcctgcagaattgcctcttgctttctctaaactttccttcacaatgtgctgtacgcctttacatgtgcaattttcttaacattttctctcttttttctgtgtatgtacattctgattcggctacctatcggggttgtgggggaggtaaaggtaaatcctgatgcccaattttactgcaggtgagagaatcataccaattaaaggtattttgctgttctggagcaatcgatcaagtaattcgttacttttaggggtgtcaaccttatgtatgtatgatttgcaaagctgtccatcattgttttattatatatactcatatagctagagattttgtaggcgaatttcttatgtctttgatacttgacatattttgtaacgtgaaccttccatcgccacaaactactatgtgcacggttgttttttcctggtaaaacactaaaacatgaatggtctcagctcatcaccagacaattggatggaaggaataaaccgaatccggtctcttcctcttcaagcttacattggtggaaatattgaagggcttcatcttacatgatctcactggtacgtaaacttgagttcagcatataaatatagtagtatgtgttttctcaatgtttacaaccactgcatagcacagcaccatttggtttcatgaagctcactcactgtatcgattagcatctggttatccaagaacaattcaagttattatggctttacctagccatgtgttgtctacacatttttttgtttaatctatgattacaatcaactgcacaattttcctttttttcccttcctgcacatgtcgtttagtctgtaaacaatagaaatcccctgtcaacttataggtgagtctgttagattgctatgtcgcatattatatccccatcaacatatatgattatgtcagttcattggcttctctttttttctttaaaaaaaagctatttcataatcctacaatatgctattccacaatgttccgcagcaacgcgcagggtaccatctagtttactaggaaaatagtccctattttgtttctttggatacacagtgtgtacttatcttgctatcgaactacttgctctctctaaaccttaatttgtaaactaaggcctctgagtgttttcagtcatatgcctatgttgaaaacaaatagttggcttaagcgtgcacatttgaaaattggttttcataggcgagccacgagcagcttaagccactttcttgtgaaaataaaattttaataaataacacatatctatacataacttttccatataaaattggatgaagattaactttataataaaattttagatcttgacgagacctacaactttgtagttgataaccttttcatttgagaatttgttagaggccgaaacattcattacaagatctcatatatatttttataaaatatcatatatatctttcaaacatcaaagttatagggctcgatcagatctacaactttggtactaatgacctttttatttaagatcatttagaggaccaaataagcgtttcaagtcttgtagatgtaatgttttagaaaatagtgtgatggtaagaatagatgtgtgtggactatgggtcttgagttcgagtccttaacaccacacatgtgcgtacatagagaaataaagaaaatgatgtggcttgtgacttggtgtataaatgtgtatagacgcctactcaaattcaaaatgtgtatagaaattatcatagttgggcagtccagctatgataatctctagttccatagacaccaagaggggggcgggtcactcaaccacttatcaaaatgggttttgaccatctgcaaagatcgatcatttatgtagcactggctttcactcattttttaagcatgggcaagggaggcatctggaaattggttttcatggctgctatgaaggagacttgagagttgaatctcctgttcagcaattgcgctcatcatcgatcacctccaactgcgatgaagtcattcccattaaagcggaagcgcccagcatgtgtcgctctctttgatcatgaaatccaccaataccagttaggtgatctttctcttgctttattccttcatcttgccttccatgtcatccaaggattttgtttcaagagttgtgcgtgagaggagcacataccactattactatgtgggaactatatacaaatgttaacttagacgaactttggaaggatactaacacagcacaagagcaattagctgatttttggaaaaggttagctatggagctttaaactggtatggatggaaaatttccatttggcattgtgcagcttgaacacatttcaattatgttatataggtttgatgcatcttaattttttagtcccctccagaaactttgcattaaaattgtgcatattttcatttcaatatcagagaccaagagttgattcttccactatggtctcactttttatatgacagaaccaccataactactagaaccgtcaaaccaaaaccatatataccacgaattttaatttgcacttggcttcttgatgtactacactactgaaaaagaatgttttcacaggtggccaaaatggctctatatatgcaggtggccacaggttctgcctgcaactaaaagtctgcgaagatagattgatatagttgtgatatgggcctcgtttctagtagtgcaacatgcacatgggctcgtttttattgtgcctgtaattatgtaaggcaagtgaaaaattgaattcacataacaataatgttggcaaagaagaggttcatcttgcttcgctacagatataaaaaaggagtgtgttgtagacccaataaaacaatagtacaatgctagctgacatgaaggtttttccccaagcaactttttttacatgccctcgctccattttgaaattatcagaaaaccgatgtttgagtactggattggatggcctcggggacatcagtttctatttcagatacaggcatacagctacagtttttgtgatagctgagtgcacacaaacctcaccgagtcgacaccgcacactgacatcaacctgagaagaacaaacaatcgttgatgccactgtgatcttaagtgtgggttgtggtggtgactctacgcgagcatcatctctgaatctctgtacacacaaacatttgcttgtgaaatgcttacccttgcacctgatattacaacggccaccaacgacaggaaaatgttttaccgacagacaacaacctactgcaagatgtgatggtgtaacaatatggcctagccgtattgttttgctccatgggaaaaaatgtactacagcctttctttgaaccaacacgacacaagtgatcaagcattgggccgggttcacctgatatcactcacggcgtaacatgagtaatgtgttaatccaacttggcctagtgacaaatcgatcctgggcagtagtttctggtgtgactgtcactactacaaaaatcgtttttctgtacaagggggtcggtaggttccatggccgcttgtggcggcgcctgcaaaaaccgcccccccgggggcgggttgattagccacatgcgaagatccattatcgcatgcggctgcttaagacagccgcatgcgataataggtctattttcgcatgcggctggcttaagggaccgcatgcgatgatcggccatatatgctcctccaggcctgagcttgaccatttgaaaacgaagctttctctctcctaaagcaagcaccaattagggggggaggttttcaactcgaaatttttacttgaactctatacgaaaggtgaagaactctctatcctgcttcatttggctccatttttgttatatttcgttggtggaaagtggagtttttttaatattttgacaaggtttgttctaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcatggatgtatgagatgtggagaacgcagccgatatttattaaggaagtatctaaatttattgatcaggctaaggcgcatgctttgagggagaatatgacaaagatcttttgtccgtgccgtcattgcaagaatcagaaattgttggtagatcctggtgaaatattgggtcacataatggagtacggattcaccaccaactacaaggtttggacctatcacggggaattcgccaatccggaagatgacgatgaagagttaagtttcgagatgaatgaggcagagaattttataatcgaagacatgtcgcgtgaaagaatggttgtcgatgtttccaccgatagtgatgatttcgatggtggttttgatttagaggatatgctacgccatgttgaaccagatgtgctagcgggcaggtcacgaggattggagaattggcaggcattagagaaggcatcgaaggatcgtcttttcgatgaaacgaagggatgtgataaggatttcacagtcttgcgttcagtgcttgaacttctgagattgaaggctaaacatggatggtcggacacaagttttaatgatctgatgagtttgttgcgtgtgttgcttcctaagcctaactttgtaccatcgaacacgtatgaagcgaagaaactcatatgtcctttatctcttggtgtagaaaagattcatgcttgtaagaatcactgcatattataccgtaaagaatatgcggaattgaaatgttgcccaacgtgtggcacaagtcggtataaaacggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccggaaaatagatggtatgattcgacatcccgccgacgctcgccagtggaagacatttgatgcaaaacacccagaatttgctaaggatcctaggaatgtaaggtttgcgttgagcactgatggaatgaacccgtttggtgacttaagcagctcgcacagcacatggccagtccttctcacaatgtataatcttccaacatggatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgtaaacttttcattatctgggcagattaaagggaagactggatgtctgatatgtctggaaaaaacttcatacaaatacctgacgtcgtctttgaagacagtgtacatgcgacatcgacggttcctaccacaaagacataggtaccgtaagatggctagattgttcgataatacagtggagaatgacaatgccccagtagcaagaggtggtacatacatgtatgagataacaaagaagattaaggttgtatatggaaaaggaaagaagaagacagtaaagaggaagaaagctgatggtgacaacggtactgcgtcgcctttcaagaagcactcaattttcttcaaatacttagattactggaagaacctagagattcgacatgcaattgatgttatgcacctcgagaagaacgtgtttgatagcaccgttggcacattgctggacatcccgagtaaaacgaaggatggattgaagtcacgtaacgaccttgtagatttgtccatacggcataaccttcacccagtagtgctgccaaatgggaagaccgagattcctcctgcttgttactcgttgacacttgaagagaaaaaagccttctgtaaatgtttacaaggggttagagtgcctactggtttcgcatcgaacatcaggaagctagtatcaatgaaggatttgtccatttcgggatacaatgcgcatgactgtcataggttgctaacggtgttcctaccaattgctataagggcagtcaaaccagtccatacaaaggtggttataacaaagttgtgctactttttcaatcgaatttcgcagaaggtatttgatcctttggaattaggtccgcttcagacatttgccgtcgagactgtatgccagcttgagatgtatttcccaccatcatttttagatatgatggagcatttgatcattcacatcgtccctcagattattgaacttggtccattatacttacatcagatgtgggcctatgagcgttacatgtcgatcctcaaaggctatgtacgcaatcgcactcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcaataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctatggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcaccgcacaaaacagtgggatccgtgtcgaagcgattgacacgagtggagaaaagaggtcgtattatgggaccattcaagaaatatgggaactggactatggcctaaacatccagatccctgtgctctattgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatatcgtacgttcgagcagatggtgttgccaaggttattaagtcatagttatttcgtaacctttagttctcattgtattccaaatgtacgtgcatgaatttaggtcccccttatgtagtaatcattagcatgtaacatttgattacgagttttgagcaattttcatgagttttcttagtgccaaaaacatttggaatgtataattgtggcgaaatattgggaaaaaaatatatatggacagtttacttagagaaaaaaaaatatgagtttttttggtaaaaagatctttctatgcggacgacttaagccagccggatggaaagatctttttcccatgcggccggctttatggcccgcacggaaagatctttttcgcatgcggctggcttaacagcccgcatggaaatatctttttcgcatgcggccggcttaacagcccgcatggaaagatctttttcgcatgcggccggcttatgtcgaccgcatggaaagatatttttttcatgcggtcccttaagccgcccgcatgcgatgatctgcgcctatatatagggagagcggggagccaaaattttctaagtcccggctcccgcgaaaccctagccgccaggctgccaaaatttcccaagtcgccgtcgccgtcgtccccgccaccgccggctcctccccaaagtcgccctgccccacgccgtcgccgccgccgccgtcaggacctctccccctcgccgttgccgtcgccgccgccaggacctctcccccctcgccgtcgccgtcgccgtcgccgccgccaggtcaccgtcgccaccgcacgaaacgctcccccctcgccgttgccatcgccgccgccaggtcgtccccgccgccaagtcgtccccgctaccgccggctcctccccgaagtcgccccgcccctcgccgtcgccgaggccactgccaggacctctcccccctcgccgtcgccgtcgccgccgctaggtcgccgtcgccgccgcacggacctctcccccctcgccgttgccatcgccgccgccaggtcgtccccgccgccaggtcgtccccgctgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattgagatttatgtataattgggacttttgttaaattggcacctatgttaaattgtgacttatgtttaaattgagacttatgttatattgggatttatgtataattgtgatttttgttaaactgagatttatgtataattgggacttttgttaaattgggacctatgtcaaatggagatttctgtttaattgtgactgatgctaaattgggacctatgttaaattgggacttatgtgaaattaagttattgggacttatgtgaaaataagttaaattgtgacctatgttaaattgagatttatgtataattgggacttatgttaaattgagatttatgtataattgggacttatgttaaattaggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagtgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgctgaaaatcgttagccatgtattattccctaactatgatgtgacatgaacctaatggtgtatagagttacctattctgtgcagatggtagtccgacgccgctcgaaacgtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtccgagctcgcgaagaagaacaaatatccccatagattggggtcgagcggatacgctggtcacgtcgatcaatggcaggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccagtaacccacacaatccgcacagcaaacaactaatgtacccagcagtgtaggctcagtgcagacaactaccttccctgtggatagtataactggaccaactccgtgcagtctcgtcgtaccaatcggccgtgctggaaagactaagaaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcctgcagcaggatcttcaaccccatcttcatcgcaggcaatgactgctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccggccccgcaaccagttcaagcctctcccacctccctagctaaacagcatgctcccccggctccgccctcagttcaaacctctccacctacgccccaatctgctctggtagaacaagtgcacataccagatggtactacatccgaaccaaagtctaatactttggaactgagtcgtataattccaaagttgatatcgacatacgacccaaaggagattgacaaggataaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcgctttcatgagtggtcctaatgggatattttttatctctttccaagaccattacgccctctacaagctagataaaatggacgttaatctcgttgcggctttctgtctgtaagtctgaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagagaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctcgaataagcctatcttatatgtagagaccactacatattattccttgtatatccgaaagaccaattgatcatatcattggaccccgcacactatgacaaggagacatttatggaatttctcactattttgaatttgtaagtgataaacatttcattactataaattgtttaggtcgatcaccggtcttctaactactaataaaacaattgtttccttcaaacagagcacacaagtactaccgcaaaagaggtggaccagtacatattccatcccagaagaagttatctgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccgtcgcgatgtctacaacgcaagaggtctcttctacgacaaccagagtgaactcgcaatggacgacaaatttaaacctctcagagagtgggagaaagaacatatgcaataacatgtacactacttatacatatgcaataacatgaaaaaactgtgccacttgctattatatatttgtatgtaaattacgattgaattaatggttatgtattacatgtttgttactgcggcacttgtcttatcttatatgcttactactccgaaatacgataataaatccctcaataatttaatattaattacgaatcaccaaaatgctagaataaatattattttagctattcggaaattgaatttcgcatgcggtctacttaagacgcccgcatgcgaaaatagaacttcgcatgcggtcttcttaggtcgaccgcatgggaaaatatatcttcgcatgcggcttcttatatggaccgcatgcgaagatctattttcgcatgcggccgtcttaagggaccgcatgcgaagatcgatcttcgcatgcggctgcgacggccgcatgcgcaaatggtgatctttgcagaccatttcgcgcatgcgggctggccaaccgcatgtgaagatcgattccgcccgtatgcaaaaacgctttctgtagtagtgtgttaatttcaccacgaacaagcaataagtccagtgcaatatctttgagtggagttcccagaatatttgtcccatgtgtccccgtggtacggtaggggtggttgataattttggaagattattgggaatagaaagttcattttttaggcaaataattaaatgtgcaacacatatggttctatgacaaataattaaatagaatattgtcacagctctaactccagctccacttctcctggatctgaagctcaaccaaacagtttcagctccacctaaaataagagtgaagctgggtggagctctctcacgaaatgatctagagaggtggagctggatttaggcagctccacaattccactccagacccaactcctttagctaaatttaggagttggaccctactaaacaggccctgcataagaaatccttatctctccaataggtttgagtttaactattctactagcagtttcatcctcatggtctataaaaaacactcgctagattaaaacttggataaatattaataagagaagggcaggtctatagctagaaacaagggtttttatgggtggtggaagtagtaaaaagcatggtggacgttttctgacgagttaagatagcgagttattaactactccctccatctaaaaaaaagttagcttctaactataaatttgaattttgttgaggttcataaccataaattcttttttttaatggagagagtacttaatttgaagcatcaagtataaaatacaagtacatgaagacgtcatgtcacacttaaatccggtaccaaaatttgtttcagagaggtataaagcattgcatttcttgttgagtcatccaatgaagttgaacgattagcaatgtagtactataaatcgagacatgcatgtccagattgatattcatatcatcagaaagtgttccctccggttctatgttgctgtattatgggatggaaagagtaatttcgttagtttgcacatacataatattataggaagtagaggcatcatgagtgaaatgtgttcaaaacatgtacgtttcttctcccaatttcgatccaagggcacttcatgttcatgaagtttgatcccctcgaaaaaaaaatgttcatgaagtttgtgggaattctgcggcatcctgtcacaccgagttgggtacagaaattatgtggatttccaatgattatcctaaacttgtacacgtggatcatgcataggttccgacttccgagccgagacgaggagatcagtcataatcaggaattaggcagaatttatgctccaaaggaaacaacagccaactattacatatttttggcttaaaccctaaaaaagtagctaccataaagtgaaacagaatataagtaatcactccacaagcaaaagaagtgatacatcttattcatacaaaaatgctattagaaaatctccattgaaagttggcaaaaatttgtttgtataaccgtaatctctacagtacaacaagcaagatcaatggattcttcctcctcattacacctttgtaggtttgctcaaaaccgaagccaatatgttgctatgaagagtatatgcatataagatttagttatagttttgatattgagtctatgccaacaagccaattaccaaacatatgggcaaaattatgagaaaattttaaaccaaaggatacaagaactgttctccaaagaaatttagcaatataacaatcaaagaatacatgttggatattctcatcatgcataaaaaacaatattttgtattaccatttcaattcatttttgctaaattttccagggttaaaaccacccctttatgcaagtagtacataaaggtcttaattttaattttacgagacatcttcaatctttataaaacttgtttactctctgcgtaaccattagcaattagagctacatagagtgaacataaaacaatccattctggtgaaaattccatataaacatatccttatcaccattaagttgaatatgcacaattttcgcaaccacattattccaattttcaaaatttgtcccactaaattccttctaaagtaaacattaagtgaaactgtactcataacagttataattgatgcattttttctacaaacaatgttgtatagagatggaagtgtttcttaaaggaggaattctcattgcatccatcttcccataatctaatttgttttccactgtttactatgaaaaatccaaggctcaaaatttatctttatctttcattaagcccgacaaaaaagggagtcacccggttatctgactacctcagtgatcgtttgattcttaaatatttttttctccttagtaaatcttgcaaaacaccatcctcattaatcaacttaaataaccatttacttagtagatattgattttgcacatctatcttaagaattcctagtccaccctgtccttttatttgacaaataatattccatctcattggtatattctttttcttatattcatcgctttgtcaaaataatctaataaacaattttttgaagtactcttcttggaatctaaaaaacgacatcgtagatatatgtaccaatgaatgatttttttttgctggtaccgcaagcagctagcaggttgaaacttcataccggtaaagaatgttgctcaataatgctatgatctgcattgttattcatcaagaagcagagtaatttatgaatgctcaatttctaccgttggatttttctttttttttaaaaaaaatgaatagtttatggtgatccgttctgtttcgcatcgatcttattcttcaaaaaggaaaaatgaaatgcacagataatgcctttttaacatagacaagtacactcacactcactggtggagaaactatctttagtcggtcgaccaaattccacaatagtcccggtttcattaaaaaccgggattaaaaacgacttttagttccggttaaaaaaattttgatctttagtcccggttaaaagatgttttttagtcccggttcatcctctgtcagaggcatgtcagggggccgaggatctttactcccggttgatactaccaaccgaactaaagatctaaatgatctaccaaccgggactaaagtggtaatctttactcctggttggtagtatcaaccgggactaaaattcaacatagtatataatccctattccttatcctctcctccacaatcacaaccacttcctcacctacggatcgatcctcctctcttctcccccttcccctctcctccccttcctccttccttccccctcccttcctcctccctcccctggagacggatgaggctgctcctccttccttccccttcctcctccctcccctggagatggatgaggccgctgatgaggccacgccgcgcggacacggtggacgaacggacgtgccgcgtctgcgcaggcgtgcggcgcagacgaccgtctctttttttttttgatattttgtgattcacttagatgtaattttgtgattcattgtatggatttgagatgtataatctgtgatgtatttgatttgtgcgtaatttttttaggatttgtgatgttttagatttgtgtgtataagtaactttaagatttgtgatgtggatttgggatttgtgatgtggatttgagatgttactttatttgggatttgtggtttgatttgggatgtgcatgccatctgattcggaaaaaaataaaaaagtaacaaaaaaaaaggaccatccgggattgtccctatcctctctttagtcctggttggtaacaccaaccgggactaaagatccctctctttagtcccggttggtgttatcaactgggactaaagatagatctttactcccggttatttcgcccgggactaaagatagctatctttagtcctagattcgtagtcccggttaggaaaccgggactataggggggttataaaccgggagtaaagatagtttctccaccagtgactcattgtttccatcgtatggtcagggtatagtgctcattttggaagattatttggaatagattgcgttttaaggcaaataattcaatgtgcaatgcatatgcttatatgagaaagaaataactgggatattattagaaattactgcatataagaaatccttatcccttgaataggtttgagtttaacttaattgtactagtagtttcatgctcacggtctacacaaaataaaaagaactcactaaccgtcggggccagggttacacgccccgacggtaagcacggtaaccatggtaaccgtggcaaactgtacgaaaccatgtaaaatttatcaaattttcaaattatcttttaaatttatttgaatttaaggaggttgccgtggttttccttttaccgtaccccgtcgtaagcacggtaaccgcacggttgctgacggttttgcaaaccctgctcactagtggtgaaacctcaaatagatattacaaagggagagaactcactagtgataaaacctcgaataaatattgaaatgggaggagcaggtgcatagctagaattagaaataaggcattttaagggatggagagagtagtaaataagcatggtgacatcccttctttctataaagttacgactcaaagctaaaacctcagcgtgccacgtcatcactaattctcagtcgttcaatcggtggatgagatcgcgtataaaccattggatgagaaggtccctagtgagatgtcgagttatcctgatgagcatagccaaatcattgcaaaaagcccaactgatgagcaaggcccatcccattgccctgccccaactgttcgctctccttccccgcttgccgtccttcctcacgcagcaagccagcaccataatctcacccccccccctatgcctcttctgcttccgtcgcacctgttttgctcatcttccctgggtgcttagaaaaacggaaaccctgggcgccaaactctcacccttcacctccctggtgagtaatggccacttatttggtatttcattgcaataatctttctttttaaatagtgtaactgatgataagccaaacttcctggatttatacgcctatgaccatgtaatcactactcagaaataagcagtaccctccctctcctccattgcggcagcaattctttcctcttttccaggtcccatttcccctttctctctcgcatgtgttgctttgttaccttatactggagacaaccaagaagtatttcattgattttaagagtacgtgagtggcgagctacatttttgcacattgcattcattttggcaagcaacaaagcaagcaagcatgtggttgctggtcgtctgttgatttatttaatgagtattttccctttctacctctggcaatgttttatttggtgctaccatgtcttataacagaagccttcttacggtgttcaatgatgctcatacagccattattttattcccaattcttaataactgtacaatttggatatttttctatgatataaaattttgctttctagcaaaatggattgtttatgtcacagtttattttgtccatatttctgtattgcgcatcaaaagaatacaagatactgtgatgtgtgtatacctatcttcccttttttttctcttccatggttatagttcattgaattgcaaaacgtttgaagtttttttgattgaatcctttgaaatcccacagcaatgcacagggtatcatctagttatcacacaagttaaagacacagagatttattacactactcctgcttactttggagcatcaagtactccctccgtcccattttaagcgtagccatcgagtactccctcggtcttatttgaatttttttttaaaaaaaaagctaaaaaaaacagaagttatacataaatactattcatattttataatctaacaacaacaaaaattttaatcataaaatttaaaataagctgaacaatcaaagttggacacgaatacttatgactgcgtttaaaatgggacggatggagtatcaaatactagtaggtcaagacgtcaagtcacttaaatcggtagaggtaccaaaagtttcagataagtataaaacattacactacatgttaagtcgagaccatgaaatgaagttgaatggtaccaccattaccacatagaaattcacatatccagttggtccatatatataataggattgagaggcatcaggataacacattacaatgaaatgtgttcgatatgtgcgtttcttcctcatgtttgtttgaataaaatgctgtggcgagctgctgcttccagtatgggtagaaatgatgtacgggtatgtagaaatgatgtgaagcccatgaatttggagccaagaataggatgaatagtcacgtattccctccgtccaaaaaaagacaaaccctgggtttctgtgccaacatttgactgtccgttttatatgaaatttttttataattagtattttcattattgttagatgataaaacatgattaatactttatatgtgacttatctttttaatttttttcataattttttcaaataagacagacggtcaaaacgttggacatgaaaaccagggtttgtctttttttttaggacggagggagtaggaattaggcacaatgctccaaaggaatcaaccgtgaattcagt

SEQ ID NO: 5577 - DNA, 1108 bp, Oryza sativa
ttccggccagagccactcggcctgctgtttgttgccccaaagaaggacaacatggagacgatcgtctcgcaggatgcgcttgtaatcacgtggaactcgtcgccagacaccgcagatcttgcccgtggcattctgatagacactgagagtgcccgccaaggtggtctccagttgatgctcctcaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacggaaagtctaacctacatctaactagggaagtgctttgtatttgaggatgtgcggactctggggttctgaattcatgggt

SEQ ID NO: 5578 - DNA, 7538 bp, Oryza sativa
tttgaaaaggaaaagggatttattacgtcagcgggctagggtttcgcggtggaccgggcgcacggcggcggttcacaaccggcggcggtggctcggcggctcgacagctcggacggcgcaagctcgccggcgaacggcggcactacggcacaaacggagggcaccaacaggtagcggacggcacggcgaactcaccggcgaccaagggagcggcggaagaccaacggacggcgacggagatgacgaaggaacggcggcagactgcggcttgacgacggcgacgatgctccggcggtttccgacggtgatgaagcggcggacgaggacggcgacgacttggcgaccacgacgacgaccttcccgagtgacggcgacgtctggaacggcggcggcgcacggctggagcgacggcggcgacggcggcgctagggcacacggcgctagagctctacgggcgacgagaggcgaaggcgagggtggctgcgggtagaggagacaccggggagccttttaaaggggctaggaggcggcggcgaaggcccacggcggccggcgacgagaaggaaacttcgtggcttgaaggaaagaggccgatccgaatcgaactcgattccacgaacttccaaaacgttttagccgatgattccaacggagaaaaggtagaggagattccggagatcatttcccctcttttgattcggccggagaaggaaaggaacggccggatttggaagggaacggcggcggcggcgcgctagggtttcggccgggcgacggcggctcggggaagacgaacctgacaggtggaccctacctgtcagtgagcgagggagcgcgcgcgcggcggcggactgggccggactgggccgtggagagagagaagagaggttttgggccgactttcggcccaaagccaaaagaagactttttaaaacatttttcaatttaaattatttcttaaatgcaaatccatttattaaaaatacttccttagctcaaataaatcccagaaaaatctaggaattatagaattaagcaaagtatttaataaaattttatctggccccattttatattggaatttattaattaaaattagatcttctcttcaaggcttttaaaattatttcaaaaaaaattccatttaaacaacaatttatatatttatgattttcagggtgtgacaaacctaccccccttaaacagaatctcgtcctcgagattcggaagaactggcgaacagatgcggatgagctgacttcaattcatcttctcgttcccaagttgattattcttccgagtgattactccattgaactttacaaaaacggataacttgattcctggttcttctctcatctgtttccaagatacggattggtttctcaacataggtcagatcctcttggacttctatctgttcaagattagcttcttcggtaggtacccttaaacactttttcaattgcgacacatggaacacattatggactcctgccaaagattgaggtaactccaactgataagcaacctctcctcttctactgacgatcttataaggtcccacaaaacgcggtgacaattttcctttggtgtgaaaacaatgaacccctcgaagaggcgtgacacgaagatacacataatctccttcttcaaaactcaaatctctgcggcgattgtcggcataactcttatgtcgggactgggccacacgcaatctttcttgaatgatttttaccttttcttctgcttccctcaggatatcagtcccgaaaacctgacgttctcccgtttgatcccacaaaagtggagtgcggcacttctgaccatacagtgcttcgtaaggggccatctgaagactagcttgataactgttgttgtacgaaaattctgcataaggtagattcttatcccaacttccaccgaaatctaaagcacaagctctcaacatatcttccaaaatctgattcaccctttcggtttgtccgtctgtctgcggatgataagcagtactaaagttcagcttagaacccatctcttcctgaagcttcttccaaaaatttgaagtaaactgactgcctcgatcagacactatcttcttagggacgccatgcaaacacacaatcctggccatatacaattccgccaaccgacttccagaataagttgtctttaccggaatgaaatgagccactttggtaagtctgtcgactatcacccaaatagagtcatggcctgatgacgttctgggtaaactagtgataaaatccatacctatttcttcccatttccattcaggaatcttcaaaggctgcaataaaccggcgggtttctgatgttctgccttgacgcgctgacaaacatcacatactgctacgtattctgcgatttcacgcttcatacttgcccaccaaaatcgttccttgagatcctggtacattttggtactaccaggatgaatggagtataaagtatcatgagcttctttcagaattgcatcttttaaatctttgttgtcggggacgcaaattctctcacctaaccatacagttccttgctcatcttccaagaaaccgatagcttttcctcttctcatattcttcttgatctcttgaatatcaggatcattaatttgggcttctctaacttgatcaattagtgtgggcttcgcttctaaggctgcaacaaaacctctactgacaattcccaaatttaatctttcaaattccttgcataattccaatggcaactgtcgtccttctgtagcattgcaatagcctttcctgctaagagcgtctgctacaacattagcctttcccgggtgataatgaattcacatgtcataatccttaattaattccaaccatctcctttgtctcatgttcagatctggctgagtaaagatatactttaaactcttgtgatcagtgtacacctctgtacgagtaccaaaaagataatgacgccaaatcttcaacgcatgaaccactgcagctaactcaatatcatgagtagggtagttcttctcatgcggacgtaactgacgagatgcataggcaaccaccttcccatcttgcatcagaacgcaacctaacccaagtttggatgcatcgcaatacacttggaaacccttctttggatcaggtaaaatcaaaataggagctgatatcaagcgattcttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgtttccagttggttacggattccacattgctaggatcaacggcaactcctcctgctgagatgacgtgaccaaggaacttcacttcagacaaccaaaattcacacttgctaaacttagcatacagttgatgttctcgtagcttctctagtacaaggcgaagatgttcttcatgctcttctttggttcgggagcagataagaatgtcatcaataaagaccaccacgaacttgtctaggtattccataaataccttattcatcaagttcatgaagaaagcaggggcattggtaagtccaaaagacataacagtacattcaaacaatccatacctagtggtaaaagctgtcttaggtatatcttcctctttgattcttaactggtgataccctgatcgaagatctatcttggagaaaacagtggcacctttaagctgatcaaacaaatcatcaattctgggtagtggatacttattcttgatagtcacatcgtttagtgcacgatagtccacacacatcctctgggtatgatctttctttttcacaaaaataaccggagctccccatggtgatgaactcggtctgatgtatcctttctgaagcaaatcatctacttgccttttgacttctgccaactcgttggctgccattctataaggtctcttatggatcggagttgttccaggtaccaaatctattctgaactctatatcccttttaggcggcataccaggtaaatcatctgggaacacatcgggatactcccggactataggaatctcttccaaagttatctggttcagtcttgaccttaaagactcagaagacaatgcatgaacagttacaactcgaccatcattgctagtgagagttacttttctgttagcacagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggacgtctaagatcttctacttccatcccatgatttcccgcaaaactcatagataaaaattaatgtgtagcaccagaatcgaaaagcactgttgcaggaactgagttaacaaggaacgtacccaaaatcacatctggagcatcttgagcttctgcagcagcaacatgattgacacgggcctttgatgctgatgcggtagagttgctctgggcagggacaaccttcacgcgtcggggcttcggacacttgtcagcataatgtcctgggtctccacagttgaagcacactacgggcttgctgccttgctccctcttggcaggctgttgctgtgtcgaaactgcaacagggcgtggagcttgattgcggatgttgttgccagcattgttgttgaagaactgacgccgcggacgaacaacagacgaagaacctccatgtggcatggactggggtcctaaagtaagacgcggcctttgattatttcccggttgtgtcttgaattgagcaatccggcgtttcttctgttccatgcgattgtatttgtcctcctgacgaatagccttatccactaacttctggaaatcaggataatctccagccatgagtggataagaaagctcatcattaagtccttccaagaacttctcctggcgctcttcatcattgcgcacatcttccggagcataacgagccagacgattgaactcgtgcagatactccgtgacagagcgagacccctgagtgagcgacctgaattccttcttcttgagagacaccactcccgatggtatatgcgtcttccggaaagcagcggtgaattcaagccaagtaataggttcagcagtagtcctattaaggcggaagtgatcccaccattcagaggcagggccatgcaactgatgtgatgcaaatgagaccttttcctgatcagtgcattgaagcaaatccaacttcttctctatggcatgcagccaatcaccagcttcaacaggattagtggtactagagaaaataggcggcctcacacgaagaaattctgctaacttgttctggggaggtgcatggttatttccctggttctgctggttctgaagttgctgcatcatcatgttcattaactgagtctgttgagcaagaacttgagcaagtgttgggttcccttcattgttgttattggggttgttggggccattcccattgctgcgagtgatcaccatctggcatggacagggcacaagaagagaaaccgggggaaactacttaggacagagaattactttaacttttattgatcttaactgagtttcattattacagaactgaagactctcacaccactaaactcaccaactccctaacactcgaaagcaaacaaacgcatgcacttacattccaccactgatgtaaatcacatgcgagacacacacaaccaaacttaaagcaagcaaactaacacaacgatctaagacaacgacttaacaagtcactctagttcttccgagcatcggaggtcgattgaaggctcgttcggctcgtcttcatcatcttgagttgctacccactcaatcttggaatgggtgcgctttgattcttctccttcatcatcacttatgataatgaccggaggatccgctagggctggggcaacttctttctccaccacacggacctttggcgccaattggtagcgagggacaaatagagctctcttccttgcggtgagacgaatcctggccttctgcggcggtgcttctccttttaatgcagctagttccttctccaaacgatccaccttgtcttctagcttgcaaatcttaccacgattccggtcttcacgatcttgagctgctaacacagtctccgcacgacttttatccatagcccacagcatctcaaccaaatgccttgtggtagcatcattctcaattccttcagtctcaaggtaactgccacggtcacttccctggggttggcgaggatggtagcgatactcagcgtcggccaactgatcactgtagcgatcgcgaagctctcctatggcgatccttgccacctcctgacatgcatggatgtagtttcttcctccagcttcgaacatcactgaggggatatcttcactattactgttcaaggtgactttgactcggcacttctcttcatgacgatcatgaggaatctgagcataaaaaggggcagtcccaaatccaatgacaaaggacatcgtacgcaactcctggacaaatccctcaacaccaaacaagtactcaggcttgtagcgcggcatctaaagacaagtgaaaggagggagttaagacatttatccaattaatagcacaagtttttggattaatttgaataaagttagaaaatcaaagtaaaaaggtaagtagatcaagtaaaccaagcttgcaacataaattgaaaacagttggaaacaaggttacaaattttatacttttgaataacaggttccaaaagaaataaaagaaagttataaaatcaacttgctaaatttattttattgtagcaagattaaataaaacaatattgtaaaacttttgctggtaaatgagccattagtacagtaatagatgtacagtactaataacactggaataaatttttgaatgaaaaccattaaaagggattatgaagtgcatgtgccattagtttggtttaattaaaagagaaggggaagagaacagttctacttttccaatatttttagagggcttctatgggtaaccatttggcataacctagggtcaaggaggctctgataccaacttgtcacgcatggaatttctatccaaaattccaaacgcttacatgtgtgtgagccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggtgcagacggctccactccacaagcagcttgaccagggctacacctaatcctccacaccatcagcttcactgtagaactcttcctctgatgaatgattgcaaggtgagtatatgacatactcagcaagccacgcagcaaatatgca

SEQ ID NO: 5579 - DNA, 523 bp, Oryza sativa
aatgggtcctatgccaaccaatatacctccgcctccaccaggccaaaatccctacatgcctggcccgccgcgtccatactccatgcctccaccgccacacatgccaaccatggcaaccatggtcaaccccattgggattcctcagcctccaccacctttgcctccacaaccacctgctgaggagcagccacctcaacctgatgaaccagaacctaaaaggctgagaacagatgacgcttctcttataccagcagaacagttccttgctcagcacccggtaatacttcttgatatatttcttctccactttcctgttttctactaaacattcttgttagtcttgttctttttgtatgcgtatattgaattttaagaatttccatgtgctaatttcttctcttccctgcagggccctgctcacatctcagtgtctgtacccaaccttgatgaaggaaacctgcgaggccaagtgttggagatcggtgtccaatcactctcagacacagttggcagtctaaaggag

SEQ ID NO: 5580 - DNA, 764 bp, Oryza sativa
  unsure (1)..(764): unsure at all n locations
cattcaaatagtgaacatcttgtaagatgacaagtaggcagtgaactttcaagacaagcacatttcacaacagcaaaacagcagaagctaaaacatatattttaagtaacagatggccataaagagatatgtatgtctgacattcaaatagtgcaaataacagtgtttcaccacgtttaaacataacatgagaatacagaaattaataggcagcaaccaacaaaaatattctcctttatagctgcaagttcagttgcaagcaataacctgccagtgcactgagatacaagaaagctcatttctttctcccaccacgctccctcagtgttaaattgatcaccactccagggccaatgttgtagtaagcaagagtgagattgtctttgaggaaactagtccgcacgctcaacttctgcttattagcagnnnnnnnnnnnnnnnnnnnnnnnnnctcctttagactgccaactgtgtctgagagtgattggacaccgatctccaacacttggcctcgcaggtttccttcatcaaggttgggtacagacactgagatgtgagcagggccctgcagggaagagaagaaattagcacatggaaattcttaaaattcaatatacgcatacaaaaagaacaagactaacaagaatgtttagtagaaaacaggaaagtggagaagaaatatatcaagaagtattaccgggtgctgagcaaggaactgttctgctggtataagagaagcgtcatctgttctcagccttttaggt

SEQ ID NO: 5581 - DNA, 1136 bp, Oryza sativa
tgcaaggccgtgtatttggccacctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 5582 - DNA, 18825 bp, Oryza sativa
  unsure (1)..(18825): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgctttttcgccggcgggcgcagaggcggaggtgggcttttgcttttttgggcgatcgcggctgatggatgcaggctcgcttttgatctccgatttggtttcgatttttttttttttttgtgagagggggaaggaggtggtggaagaaccgggagggaaacggctttttcgaacgttggtggggcaacggctctgccttcgaccttcgtaaccttcaggcaggaaacaaatggcttttgaaggaatttttggaggatatccttcgaaataaataaatggctctcctaaactgctttggaattcattagagttgtctttaaatcatatataggaattttgaaggatttttcaaaatgaggttcaacatcttgaaaaaaaaatttgtttgtgcatagacatttctacattgaaaaaaaatcctccattgatatacttgtgttttttatacactccatccaacataggcatttctatatttattagttctcttatgtatttccatttgtaggattttaggtgccaggtcactctaaccctacgggtttctttttattcatgtgtttcgaaaaaaaaccattcttaccaagctcatcttgccgttaaaaaaactaaatggtttagattgtaatatcatatataactttataaacatgtaaatataattcaatttagatagtgagggggaatacaaattcaacagctggcgctagtaatttagcggctagatttcatttggtacccagtagtaccattagctcgaggtattttctgtcataccataacaaacttctctaagaatgtgggttggccatttccaccgctggttttttccaaccttcaattgtaaataggtttatgcatatatatttgtagaagtgagcgacactattatataattcgtcgagatattttcactgttacttagatgctacgagagaaatgggtctaatattacagtcgaaataaaaaatttcctcgtgcttagattgagtttgttgtttgttaccgtgttttagtcttgcaaggtgtatggtctagtgtgagatttagtagaattctttacatctcgtttgtgtgagtattttctttaccttttttctatgagtgattgctttttgtgtggtgtgatgactgatgactgtgtgtcgtttgctaggtgggtaagggtgctttagggagcactaagtggtctactttgccatctcaaggggaaaaagtaatctgctttgggggaaataatgcatggtgatgggctagctacctcatggtggccaaaggctgaggttttgggctatatgatatactatgtgacaataatgtcaaatattaattcacaaaatttgactttgttctttatcaggttgtgatgttattttcttttatgttgaccatttttacgaaacaattccatcacatcactgtactacctccatctcaaaaatatcttatttccggctatgttcatgtgcatagctaaaaatggtcacaagaaggaaaatttcaacacaatactacgtgtatttttttttaacaatgaatagcagtaaacctaaacaataactatgaatgcacacaactatttcaatatctttctcaattataggacaagtctaaattgcacatatattaaaggaagaagataatggctactccagtggttgttaagaagtttaactctgtggagaccctttttattacagtatgtaaaggtaaataatgttgggatgattgtgtgatcccgaattcccgatcgatcggtgtcggtgggatggaccattcataatatgtttggtgtacttggtgagttttacacgatcgatcgatatgatttttgctctaaagcaacattgtactcgaaagcaacaaaaagaagctaagcgcgtatgtaaagccacgcacctaccaaatcattcgaggaatccatgtgctatgcatatacttagttcccaagtattgcactacatgcatgtcctgtgtgaccagttgtggttggcaatttcaattccatttctgggtaattcagttgatgaatctattgtcgattggcatatccacgtatgtaggttgtctaatcaatattggaataatatatacccattccgaggacataaatatttgacatttttgatagaatatgatcaaacttttatgaaactttaggccatcagtttaatattaaattatttttataaagtgtaagaggtttatatattaggacagagattggaggcaaatcattgaatatttgaatgccattttttatttctaaactaagcatcgagaaattattgagggttaaagttttaagagtttaatcatgtttttaataataaatatgaaccaaaccgtgtactctaaagattaatttatgaacgaaaggagtatgtataaccatcttccatcattttgcatgtttactacatcaacccgacatggatatataaactactatctatctctacaaatataatagatccatgcgggagcgcctaatgggcgggtgatcatggcacgcgattggcccacacccgaggcgcacacgactcccaccctaactcccaaccccctcccacggtgtgacttgttaaaaatatattttagattgattaaaaaacaaccaaaaaagaaaaaaaatcaaatgcgctaaaaatatacatgggtatagactttatacataaaaatatatatacattgtaaactttgcaggtacaaacttttggtaataacaaaaaagattgaaattcaatatgaatttgagtgggatatataaacttccgactataaacttttaagtgtgtaaactttaggtgtataaacttttcgtatataaagtttagatataatatgcggttctagaaaaggaaaagataagaaaaaaaaaggggaaaaggtgattgcggggagcgatcacacggtaattagcaaattcagatccatgttgctatgtacaggtgcaatcctgcacctaccatatagttcaccaactgagttttacacctgcgttactcattcttcaaatccaactaaccgtattcatccacattcaattgaacgactcaagagatcatcccatgctcaacctcccctcctctctcgcacggaagctagcgcccatctccgcacaccctctccaccgcactcccatcctctctctctctctctcttgcactcacccagaaaccctatgcccgcgcccccttctccaccatgctgccaccaccatcgaatccctctccacagtgatctgctacggatcctgcgtcttctgctatccatcacgccgccaccgggactcctcacccacgcatgccatcgatcccgatttaccttggccttggtcttggtcttgttttctttttgctgaccatgctttgccttgttcttgttttctttttgctgtttgcatggctgatgtggaaaacctagctgattgagtgactagataattagttgattgagtgactaattaaaggaagactagcaaaggcgacatggatagatcaggaacaaaaggtgaacagtgtgttttagatggacgtagttctagttactagacatgcgttttttacctgagcacaccggcacagcactcagccaagcacgtcttggctcactttaagaccgtgtaacttcaaaaggtgaaaaataactaaagttgcctgattatattaattaggggacgagccacttgtacacaactagatcgatgaagtgacctttgagaaagatgccagagatttcaacatgctttgcattttgtaagcaaagctatccacaaagccattgtgtcccagctccagactgactgtgcatacagatcgagtgtgaatgcgtgattggtactatgctttggtagcctagcatgcaccgatagtgcagtggtaagaggtgtgtgattttaaccccgaagtctcatgtttaatttttaacatgctcacaatttcttcttacaaaatgtttggagggagtccctccaaatctcgtttttttttaaaaaaaaaactttggtagcagcttccagcaaaacaaaaacgaaattgctaaaaaaccgtcgcaagttttttgtgcaaaaataatatagctgtagtgtaactacagtgtaattatactacagttacattgttactacattgtagtctctacatataaagttgcatatattattttaatacttatataaaatttatattttagttatagttgaattatattatagttagatttgatagtttttttaaagatagtcctaataaaaaaacagagagagagagagagagggtcttggttgctgggcctccacagagtagaattgccaagtgcaccatcggcctatgaaaagctcaacactaacagaagcccggtcgtcctcttctggcccaaggtttgtctcagcccagtctcatttacttggatgttttgaagttattcatttttcttacatttttcaaggacgtaactacacagctagtggtagttagtttgtctaaatcagctaccattctatctataaaaaacaccatccacctatactttaagtacaattttctcttaaactactcatccgatctacgatttgattacaccgttgtgttcataacaattaaatctttacaacaagatctcacatcattatattttgataaaaaatcacaaattacttttatgatatgtctaaattacttttagatttcactaagttacttcttagatatataaaagtaaattcagtaaagcctaaaagtattttacatatattatagaagtaattagaacaaaacgaaggtaacttcggcatgtcatttgaattaaatccgttgtagaaataaaaacatgactctatctagaaattaaattaatcagcacaaattatggaattaactaaaaacaataataaaagtaatcacctcaaagcattacgaatgtataggaagtattttaatcaaatctaaaaagtaaattatatatatgataatttgttcaatgaaaaaaaacattaattaaagttactttctttttatataagttacttctataatatatgtaaattacttttaggctttactaaatttacttttatatgtctaagaagtaacttagtgaaatctaaaagtaatttagacatatcataaaagtaatttgtgatttttcatcaaaatataatcatgtgagatcttgttgtaaagatttaattattacgaacacaacggtataatcggattagtaatttaaaagaaaattttatttgaagcatagataatagaaatatttcccctacttacttaatggattagtactatagtaaagtaagattcttccagctaacacatatatggattctggatgtccgtcgctatttatgactaaattgagagtgctctcgaattagattttgcgatttttcaagtacaagccaacgctcacacaaacaccatatatactcatgtccacacgattacacggagcgttcaaacacagggtctaaatacgattgaaggccaagccttacacatgctttgacccctgaacacatccaaacaaacaaattctaggaattaggagagaaaatgcaataattatataattcagaaaatgaactagaagtcaggagctaaaaaaacccagttttttcatattcttataaattggctaccaaccagtagcttctcataatgttaatcttcccctaaacaggcccagagatttgaatccattagatccgtgagaagctatcctaaccgaattatacccttttatttaagctatattgaattttaggaattcacaaaggtgatggccgggacaacactactacactaggcggacgtgccccacgagacacgatcagggggtgcgcgcattatttcgattatagaaggaaaaagagaaattctaaattttaccatcgacattatcggagccatcggaattataagtgaaacagcatatttgcaaacaaagaataatttgtgaataaaacttttatatacatgttcttagcgatataaaagcaaatgctgaaaaataaatttcgatgaaaaaaaccttaaaatcagctccaaatttaaggttaacaatttaaattttgcctgatgagcataagcataagcgaaaagataaagccatatgtcgttaatagatgtaaagttctaccgaatgccatcttacgggtaattttatcccttttcgttatcgccttcatttgcccactcatcgccgaggtgcccacccataagttaaaccatatatgagccgcgcctatgagtttgttaaagttttgtgagggcattttagacattttaaataaataaaatcggactaactgaatgggatggacgaaaacctgcatatgatggcatttataagacaaactcatttatgcactttactgatggcatttgttagaatttctcaaggaaaaaaaaaagaggattgattggcaagcagggtacgttgtacactgaacaagcagagcttatattggtacaaatatttttttttcaattttttctggagaaatgctaacactgtgatatatatccacggattttcataatttactctatgcacatcaacctatttccctaatttctacaacaattcatcgatttattcatatttattgctcccacaaggggctgtacacttgctcatcaatggagccatctccatagtacaaatgctcgtcgtcgtacacgcaccagctcgccgccgccggcaacgccaactccggcggccagccgtacccgaacgccccgccgccgtagccgtcgaggtcgtcggaaaacatgtcctccagccgtctgatcccagctgctgctgcgccgtcgtcgtcgctcgccggcccggcggcggccatgctctcgtcgctgtccctcgtcgccgtcgccgccgccaccgccccggtggcgccgccaccgccgatctcggcctcgagcgaccggatcacgcggctcagctgatcggcgtcgccgtcgccgtcggtcgttgccgccggcgacggcgagtagtcgtcccccatctcctcctcgccatcaagaagctccatgaggagcaccactccgtcgtcgtcggacgtcgccggcgccgccacggccatctcctggtcgacgaggccgccggcgccggtgccgccatggtagtagtactggtactcgccggcgacaccgccgccgccctggctccgcatcatcttgtccatctgcgagcaatggatggagagatgatttcttggcttctcgcccttcttggttgccaaggtgcaatggggtttatatatatggttatcagctagcttaattagcttgcaattaattaactagtttaattagccacttggttagttaatacctccattcaattctacctcccacctgtcatgtgtaccctcttcatctctcataaaacataaatatagtagcagatacgatatattctagatcttcgaatctaaatataaatatgttcagattcgtagtactactatgcgtcacatctaattttatattcgtttttttattatgtagggagtatcatgattggtgtcatcgattagatcattagcaatttggtttttatttaatacaaatggattagtgatcataattggttttcgggtggacaattaacggccgtgcttaattatagtaggaacggtaggttttgggaggcaacaagagaggaggtgattggattgtgagttgatcatggagaggtgaggagacagctaacaggttgggcaggatcctgcattggcctacattattgccaaattatcctgctatccacgtcagtgtagcgtacgtccttgcctgtgtacttgattgtgaatctgcttatgacagttttctgcgaatatttttaggtacacttataggcaccatgatttgaaccgtaagattggatatatatccactaaagcctcgttctttttcatactacatcataaaaaccgattttcgtgacaccgactacctgcgaaaatagatccacttttacgcagacctctaggccaatttctcgtgatggcaagcttgccgaaagactgtggcaagcttctttctgggcgtcagtccttttccggcagcggcttgccaccgcaagatggccatgctagatgggtcagtgcgggatagaggctatgttacctggatacgtcacaaatgcaacgtatccgtatcagatacgtggagggatacggatacgtatcggatacgatccgatacgtatcgcgtacgtatcagcgattttcgcaattttcgaacaattaaaataaatctggatacgttctcgatacgtccgcatggcaacgatcaatatgctgtctccacttttctcgcctgatgcccaaccctcgcggcactttcccccgccgccgccgccgcccgagacgccaaaggccgaactctgagccgccgccgccaagcgccgaacgcagcgccaccgtcgctacatgccggaccttcagacgccgaatgcagatctgcgtctagatgtattcaccgcctccaccaccggacccaacgccaacaggcacaatgccgccgtagcagccactgacttcctgctcccggtgaggcaagttccattgaacgatttgacttgttttgcttgcctcttcgatgcttgagtgcatgtgatcttatctgttcgatcttgttcctctttcctgttttcttggcagaagtgcaatatacagagatagctagtattttttttagatctgatgatttttgggattggaagtgtcaatgcatctagcactcctagagctagtgcggttgctaatctagctgcagattcatcattcctccaaatgatggtgagaagaagccactgtgggatgcggtgatatgttgagttgttagagaagaaatagaatagtcaaagagtatacggaaaaatcaaagagttttttttagatatattagttgtgctatttctcaactagtctacacctgccatcgtttcactttcacccacctgaatcaactacaagagataatcagaaaaattgctacattgtaattagctaatttctttgaatagttgatatttgtctttatatatagatatttatatacatatatgtgaacgtatccccgtatccatgtttttcagaaaatgacgtatccccgtatcgacgtatcgcgtatccgtatccgtatccccgtatctgggtaacgtaggatagaggggaagacaggggatccattcttctctctcaccctctccctttccaacccaaccacgtggacgaagctggagaacaccggagttcaagacccttctttgttggtcggccgacgacgaggcatcggcgcggtgcctgcgcgtcgaaggggactagctggtggttactgctgaatctaacatgtctcattggtgcgggagagtaggaactacgggcgaaagcctagccttcaggccggcaatggcgacgcctacgggcgtcgctttccccatggttcgttgctgcgttttctctcctctcccaatggtttcttcaagtgaaaaccacgtcctggttctctaggacgggcagcggcggtgctcttggcgtcatttccttcttggaggcgtcgtttagaagacccatcccttaggggtgttatgggcttgttctgtttttaacagtaggatcagacgtagacgcgtggtgtggttatcttttctttttcctgactatagtctcccaggactgtagacttatatttttttcctattatatcaatagaaacgtcgcactatcttgtgcgagttgttttaaaaaaaatgctcgtgaaaataccggcctacatgcttgaggaaaacaactattggtataaaatcaagtgaggcgcaggcgagagcgacgacactcactaagttcccggccctcccccgccccagcaaatccactggccctctctccgtctcctctcccttctagcttcgtctctcgcttgtcctacctcccctctctctcgactgcgaatcggtcagcgacgggagtaggaggtgtcaacaagccctgggagtggcggagcgacgatgggcctagcggggagcggtagatactgcacccatagttgccgggcgccgtggatcaacagcagtgggctcgggaagcgacggatcgatgatgggcatacaacggggagcagcagattcgacggctgcgcccctcaagagtggcggcttcggcgcccacaatcaccgggaacaaagtggtggatcgatcgacggcggcatgctcgagaggtagcgaactggcaatcaaagcgatgtgctcggggaggtgatgaatcaacaattcaacagccacgggcccaggaagaggtggattcgactatcgtgattgtcggcaccggcagatggatggcgatgggccaagcggggttcggcggatctagtgaccacaatggattgctgcggtgaggatggcagcttcagtgatgaatttttgcaaatgggtatcgaagcggggttctggaattattttttttggttttttagttcttttttcaaaactttgtgcaattgggagtattgatgtacccgtttaggaaaatcattttttctagatggccctcttaaggaggctttctacgaaaatcattttcatatacggtttcggtacccgcttgtaaaaatcgtaacttttcatacatacatcttgctggaggcagtagtggtgcccgtatgtgaaaaaccattttaaccatttgggaagatctgttttgtagtagtgctaggatttgaagtgttcgtgcccgaatccgtttgtatatatagtggtaacttgtgttgaagcctagggaggggtttcttcttctatgcctcgactgatagggtagtcagcgagcaaaggtactgtggatcgaatgtacccacgctggcgatggcgaaggaattggccaaaggtgagggttggtaaagaccgagggatgagataggatagaaataaacttattttgtgatacttattttgtgattaataaatgggactaaaaataaatttattttaagactgagtaacttagatgtgagtagcagcagcacgacatgccgcagacttcgataattaattaattaatcgccgctgcaatttaaaatcacgtcggcgccgtcgtgtggctggacgggagttggcccactacctgtacgtgtgttcgttggcttcttcgtcgtgaccgattggatatttaattttccaaagaaacttacaattaggtcgcgttttagttgatgtttcgtgtctggtgtccctttcttcttccttgctctcggaagcaacttgcattgtgcagttaagctgtttcaagcagggtttacaagaccatttttttttttgtgaaaaccatttgaaaaccgttcattatagctaaattcaatcctaccacataacagactatcttcgacgttcaccgacagtgataaaaatatcacttctatgcttgttcgcaccaaacccgctcaaaatctgaagaatcaacggtgatacaatggtgctactacgtaccgtgaaccagaaactgatacctaaacctcaattattagttcggggacacctcctaagtccgaggagcctgttctcctcagactagaggtctgtgagggcaaattttcagctctaaaacctttaaaggccgataaaagctcgatgcacgatttcacgcagtttttttttcttatttcaaagtatatggccatttttgtgcgttgtatgttttatttggtcatttatattgatctattttcgactattctctaaatataactatcattttatcacaaacaagattaactatatagttactaaaactgtacgaaaatatagacatagtagagttcgagatttttaaggctacaattgctagtaactcccgaagtattgggattggtttacttaactccgtaaaggacgaaaccggatattctacccctgaagtatgaaaaccggttcaaataacccctaccatagttttgtaggtgattttgtcatgtaaatgattacgtgccagcggtattggcttgcatgacacaaagattagtctaataaacccaagtttgtctaactattacttttcactcactgatcggcaagattaaaatttattactccatctatccaatagtataaggcatggtcaaacttggtacggttgacttataatttctcatgtactataaagtttatagcaacaaaactataatcatatgaaagtaaattcaaatgtcaatacaatataatattcttaacaaataaaatttaatttatattatactaattaatggttaaatattttagaagttgaatcttgaaatgcttacaagtcttatatcatgggatggagggagtatatcttaatactaatttacatcattcttaggctgattcacttattgcatagcctgttacaatagtctcctttaggtccaagaggccaaaatcattgccatgtcatcatgtgcatagcaaaaccattctagagggttatttaaactggttttgatatatatacattttttttgtggggggggggggggttagaatatcatgttttgtacttcggcggttacatagactagcctcaataattcagaggtgaagtagacttattccaaactcctatttcttcttaacaattccctctaaccaaacgcacttaacgtatttcaatatttttaagcacatatcttagcgtattgcatagaaaaaacatacttttaagcacctattaaacatctaggttttagaggtggcatttatgaattcagccccaatacttcagggatgaagtagacttatttctatgaatttaaagtgcgaggtctctgtatgtaaaaaacaaaactcccataaccaattcctccactagcttcatcctataaactctcaatttcttcctttcttctgggtttccttacaagcagcacaagggacatgttcaatacgagattaagcgtgcctcatgcgtcaacgtcgcacgaaacgcctcgcccatatctgacatggcaacaatatcggatatttttaaagctaccctctaactgtgcgttggaggtggtctaatgactctagctagagacgatccactgtgtgcggtgtcttgattttgctgttgatttgattctcactcattaattactctagattaaataagctgatttctttgattttcttttactgcacgtgtgaacagtgatatttaatgacaatatattcaccccatcataaataaatatatattatttaactttctttagtctttaaagtaaaactttaacaataattttatattagaataagtactacgataatactccctgtggagggagtacccctttggacatgtagaatgatgtttaataacgggctctcttcgttatcatgtaagtaaatttggtaataatgtggaagaaaaagaaggaagaaaagaaaaacgtcgttgctacacgtgacattggctcagagtcgactcttagcatttagtatttattaacgaaaaatttgttacatgagggtggagaaaaggaaaaagtgataataaaaaatatttagtgcattaatggttaaagaccttattatctctactattgcagtaggatgctctctaacgacatgaattattaatacagagagttaatattagactctacttcgtacctttttacatggcttaaaggcaaatcaaacaaagcattaattctataagttatatattgattattgtcagtatttcaaaatatcaaaactttgattaagtattattttagactttaaatatatttataaccgaaaagagtaatgtataattctttctataagaaaataattaaattgtccttgtcctatttagccgacactgagctagctagcccctctcatgcattacatagaggccaatggccggatcacatggagatgtctgcttaatcagttgcttctgcacgatgccatccatgatcgataggccgatatgatcgatttgtgtgccttgtagatttggatctgatcgatgatatccgggggaatttcccagctgccaagtgccaactagtgataggaaaccgacggccaccattgaacgtgcgccctactagccacggtgctgggcgtccatccatccgtccatgtcaaaggtgctttcctcgtgggcttgtggtcgtattctagtagtccttgcaaggtatggttgtcaacagcaataatcgaaaccatttatatattattttgttgtttcaatttgtactatcaattatactgtatttcattatcgtattattatagtcctattcggatgtctaggcaatggctataacccagtgccataagcacagataagcagtggactcagcagccgcagccataaaagataaaaccatatgttgaacagattctatagcccacctttagtatgagtgtaacagtatataatatgtagtgacccgttcaaaacattttcttaaagatagacatcgcatgcaacactgtaggtactccgaaatattaattgttatgtaaatttcaccgtctataaaggaaaattttggtcatgataaagctgaaatattgcaaggaattgaaatctgaaaattttgatcaccttagttatgtctaagatttttttttaagtaaggttatgtctaagaattaaggaattggaatcgtcaagaaagctattctacaagctagttctacaccctaattatatagttttgtgtttgccaggagggaaaagaaaaacataagaattgaagttttatatagatgtatacatgcttagaatcgtatgcacaatcattcataagtgcgcacatcttcggttttcggcgcatctatctgctcattgtgactgctgcggtcccagattcggattatatcaatctctttgatgatgtcctctcatctaggcataggtcatgtactatatgaactttggatgtacttcctcatcactcttttctttttacaaatgatgttttaatttaccctagagcacaaattaagtccaatagctcctactaatagcccccacgcatgcatcatttccaaccaattcatttcaaatattccattatcatgttcctattaaaaaaaaactccaccggcaaaagaaagaccaccccaaccgctttttcaagctaagagaaacctcaaccaaagctaatagcgaaagggcacacactctggcatcttgacacacagatccgccctcacggtttgggccttaacatgtgttttgagaccattgccttgtgtatgactgccgacttaccataggtcagtttttaacatttgttttgatccaagggatgagtgagtgatcatttttaaatcaagtccgaaaattcacttgctagtggagtcaaactcgggaactggtagttgctactaaagcattatagtgaatataatagcagactacaagttagctgtaagcatacatggaggagataagagaagaaagagaaggaaagcggattacagatttatagccagctgcaacacggactccaatacgttatgtgtataagatgtgggagcatatattaatgatgtagtatatgtttatagataattattgtatgaatgagctattaaattggctataaatgaattggagtcgatagttggctatactattaaacttgctcttacaaccactatgatacaaatcacaaggttgtttttatttctatgggttgggaaccatttcctgcgctcggaaaacggaagggtccattagcgcgtgattaattcagtattagctaattttttttcaaaaatgaatcaatatttttttaaaacaactttcgtatacttttttttaaaaaaaacgcaccatttagcagcttgaagaacgtacgtgcggaacacgaggaagacgggttgggaacactgagcaaagaacacagggttagaaaacatcgaaggagaccacctctcgcatggcttagatatatagcatggtgcgaaagattaacgacaaaattatataactgtagacaaccatgaattagctagggcgtgtccgttggaaggagatagagcgaaaaaaaatatttgctttttcatgtgcacattttctgaaccgttaaatggcacattcttcttttaaagaaatatatagaaaagttttctttacaaaatcttattaatctacttttaagtttagaataattaatatttaattaataatatgttgatcattcacatcgttttacatatattctcaatcttctttttctcctctcaaacacatccttaccccttaggaattcaccagaaagcagacatacattatgcaagtactactaattaattgtcttattgtatgctggcaacttcgagagaatcctgagaatttttggttgccagctcactgaaatcacatatgaatgtgatctcaagaaaatgtaggattttctgatcttgtgtcggccgaaacttctcatggacgcatcaaggacaatgtaccacttgcttgatcattcctgtgcccaactgcctaattgtctccatggcatcagggcataggcacctggaccaggaatcaatctaccggcaaggccgaccaaactcttgttgctaattaatcacccaacttgatttatcttaaagtccatgattaaaaaccgaagtgataaaggcaataattatgcttgttagctctaattaagtctaccggtcagaaggtagctgttggatatatcatatatattcgggtgtctaggttggggcccttggtgattagtctccatttgtcataaaataaattaacttttatatacgaatttagacataggctatgttaagatttattttgggatatatgaagtatgttcctattgttcctccatccaaaagtcagacctgtttcttttggcatcaagactaaaaaataattaactcattcacaacgtgacaaaaccaacaaacatgtaatcaataagtataaaatagctttttagtttcgattaacaatttaatttagcacatagtgactacaaataggatttatttctttttgaaaaaccaaagagttgaatagttcttagaattttagcaggagggagtagtatagactacgggtgtttaattaagatgagattagagaaggcattaataagtgatgattaattgggttgggatcgtgtgtaggaggatttgacccactataaatgcgcataatgcaaaggtgacatgcatatgtgctgcatttttttttcgattgatgattgtgtgattgaaaagatgccaagtgagatctaagtgagctggagaccaaatctttgccgatatttgatacgaaccagcctggagtacaggaggagatgacataagctgccctgatctttgcagcgtgtggtcgcgtactttgcccaagtattgcatactccattatttagagccacacgggacataaatttataataactctgattccatttctttcatataatgaaatgaaataattgccgcaccaaatttgatttcacaaggatctagaaagacgtctctaaacaaaaataattttcaaaattaatcatagagaattctaccatcgtcagaaggttgtattatttcttaaaaaaacacagcacaaatgtagatggtcacaactcacaacacacactctacttttataaacatcttcaaaatactggaccaatatatcttgagattaataaagttagcatgaacatctaactgttaacgggtatatcgttacaactgacagaaattactcgtgataaatctcagtaaattcatcaggcacaatcgcaagtacctgaggcaatcgagtgcaatgataacagttgatgataattttcctctactttttttctgcgaggggcgttgatatctttcattggtggtacggatctaattactgtcacgaattcggccgacgacggccacgatataactgaattttttttaatttttaattttatttagtaaaatattgacaaaactatttttaattaaagttttacaaatctacacccctaacgtccttgggagggtgtttttaaaaaatcactcttctagaggacattttttaaaaatcacccttctagagaacattttttatgatatggcacacgtcctttggcgttttttaatggttgtgtgaaatttaaaaggtgacaccctttagcactctaggacggcggtaatagggctacctgttaaatagcgacctacgatattttgcaaacagccccctcatagcactctagaagggcggcaaggggtcaacctgcaaaatagccaggcaccctccatgtggttattagaatacaccaacggacatgtgccacgtcataaaaaacatcctttgaaaggatgattttttaaaaaagccctccctgaggatgttaagggtgtagatatataaaactttgatgaaaaaaattatttttgtaaatattttattaaataaattaaaaattttaaaaattcgacatagcttgacctactactgaattcagcccacctacttctgctcaaagacacgagtgaattaagcccacctattttggacaacgaaatcagcccacgagtcaactaagatgcctacttaaggtgtgtttagttcacgctaaaattggaaagactaaagtgtacggacagtccttggggtgtgtctctaagttcctaaactctcaaaatatatatccaaatcctagaacttgtcatagtgtgtcatttaggtcc

SEQ ID NO: 5583 - DNA, 1898 bp, Oryza sativa
agaagaatgagaagagaatgaaaaagaaaaataaaagaagaaaaaaagaaaatgacatgtcacgtctatgtggcatgccacatcagcgccacgtaggatcctagaggggatgtgtcgatttgggacctaaatgatacactttgataagttctaggacctggatatgcgttttgagagtttagggacctatatgacacaaccctataagtttaaggaccgccaatgcactttactcaattggaaatttgattgaaattagaacgatgtgacgggaaagttagaagtttatgtgtgtaggaaagttttgatgtgatggaaaagttaagaagtttaaagaaaaagttgggaactaacccaagccttaattcagagcaagagtggattaagccgacaacgaccccatcaactaattaggcctttaaattcagcccactgctctgctctaatcacgtccgggttcggggattacaaaaaagaaaactccatagtgcctccttcaactatggagcaagtatgatttacctcccgcaaccgtatactataacacattcttttaacattcaaaaccagaccaatttgcctcctttggtgctttgcatattggttttatccaatgtgacgcggttttacctgacgtgccacatttaacttgattcacatgttctcacacatgttattcaaggaaaaaaaataaaaataatagtacggcccacatgttagccctcccttactgcttccccctctctccctcatgctctttcctctaactagacatttgggcgcacgttgtgcgccctatcagtgagggcaggtagcacaacaatgagagcactcgagcaaaccaaataatccaaagcatagttctattggggagtccatgaaagtataataaaatatattgctgtagacggaatttatgtttttacttgtcaatatcagataaaaccataaccatatggaacaacataaccattttttggacagatagtacgtaaaaaatgtgccagaaaaaacattctttccactgttacatagtttgcagtacataacaaattgtgccacggaaatatcagccaatgtgttgcgcatcctatcaatggacagacagtataatcaaggagccaaagggctaatatttagaacaccacatagttggttgtctgaaaggccattcttaaggcttgattataatcagtttttatatgcaatacaatcaataaaatttgccaaccacattggctcgctaaactgtagaatacatgcaacaccggagtttcatctaagcaaaagtaacggaacaacattagctttcagtcttgaagtacctcagaaccttagtatgtttaactgctatagtaagtttaagtgctatgcatctaaaattagataatatataccccatctgtattttaatgtatgacgccgttgaccttttgataaacgtttgacctttcgtcttattcaaaaaatttatgtaattatcatttattttattatgacttcatttataatcaaatattctttaagcatgacataagtatttttatatttacataataaaattgaataagacgaatggtcaaacgttggttaaaaagtaaacgacgtcattaaaatacggagggagtataattgaagcagtgcttcagagagatgccgttggggagtgcgcataagctgcagctcatggtttttgtaacgttgatcctgcaacaccttcttgatggcaactcttttcctgtctccaagcacttagcgtaaatgtcaaaaccacatcatttcgattcagaacatatcaaagaaatgtactccctccgttttaaaatgtttgacaccgttgactttttagtacgtgtttgaccattcgtcttattcaaaaaatttaagtaattatttat

SEQ ID NO: 5584 - DNA, 1182 bp, Oryza sativa
tcgaaccgggggaagtataatacacactaagcatgcatttccataagaccaagcacattacgtggaagacaatcccgaatgaatcatttcctagaactcgctctgccatatatctaattgtctgcagtgaaggtaaaaagcatcacatgagaaatagagcacaatatctcagattgacatattctatgttgtgcatcagagtcccagcttaccatgactaactaaaattagaagtgaagcatatctattaccttccctagaaagaacagattgtgaaatagcgaacataaaaggaaatcatctttcataaaccgttgcatcaactttgttctatctatggtagaggaatagaccaaatgaaacctcctgtattacatgcacagtatcaaatggaaccaaatttcttgtttgcaattttttaacggcgagaatcttaagttgaacaacaaaaaaatatggggaagggaacactacaacctcatcaaggaaaaaagtggaagcaaggtatgctctgtcatagtggctggtggaatcagagaatgaaaatcagtcttcagaacttctctgtcaaggtagaagtggaaggaaaattgctccagcttctgtgttgtgcttctgaccacacaatttccatcatattgttaggctgtgccatccatcagctgatattgtgagacattgtatgcattatgagattgtagaacatattggcaggttggtagctgatattataccataaggaactatatgcattatgaaactgtagagcaaatgatttcagatctaacctgcattgtccagattaacttgctaggttattatatgccacttggacatgaaacatcagattgatcaagtctcaaccaccttctgttagtaattctcagaagataatgaccatcttctgttagtaattctcagatgataatgattaaatgaatgttgcaatttaggctgcatggattgattaaacaaaaagcagtaatgcaaacaaatgattcaatatttccatcctttattttacttcaatgggtaaattgaaattagaaataatctgcaacagagaagctacaaacagtagcctaggaagtataaagagaatgcagtggtgatcgattgatctagcctaaaagttgctttgacacatacatttcgaagtaccaacagataaaactcaactct

SEQ ID NO: 5585 - DNA, 4441 bp, Oryza sativa
gaggaaggggacggagaggattgcttggaggcaaccacggtggtggagcttcggcaaatctccaccatggcgccagtcggggcagcaatggagtggcatgatctggagggggtgtcgatggcagagtgtagtggagggcacgtgggagtggtcgtcaacggcggagaaaagcgagcgatggccggccggccgtcgccgccgtgagggcaagagagagagcaagaggggaacagcggtcgagtggcggctagggtttgggggaggtggagcctggagggatgttcggtttcgcaaaaagacccctcactttacgcttttcagagcgcactcctgttttccgaattttctcttcttagcataagatatttcatatttcagagggccggggcgtaagaatacatggctgaggaatgtacgtctagggatctataacaaattatcggtaaaatcaagaggttttttgaaaagtgatcagtcccacaacccggcgctcgctcgcgaaatcttgctacctgggcgttcgggggcgacgtggatagcgcggcgatcgaacacacgactccaaatcgctgtgggagcttcagttgggggcaggttttaatttaaccgattcttgtgtcctcctccaacacctttcatctctacgagggttttcactttcgatttcaccgaaaattttgaccttttcgataaaactgatattcccaaaattttgagatcctcggcactttttggacaaaaagtttatgaaattttaacacaatttaattgaattaaactaaaatttgaccaaattcacaaaaaattgagaaaaaccaaaatttttggtcgagatagtggcttgccgaggagagggggtatccaaaattgcaatcactgatccctaccaccatgcctctcccatgcactaccttcgctctagccacactctctcaacaggccttctccgggcgtgtagccacccacacggtggttggtctgggtgtccatggagtttttatttgtcaaggcaataagttatatgcggtacttcatctgtttataaatattttgatacgtaaaacaagatttagtcaaaagttaaaacttagacaatcacttttgtattacagtaagtttataaagaatctagtaattaagtttatgatattacatacaacaatgcttttcaaagcaaatatactcatactattttttttacttttaaagtaagcattatatttgagaaacttttgatagctaaagttttaaaagttcgtcctaacatcaaatatatgaatggagacagtaaataaatactccattagtcattattttttaataaacggtgccattgacttttaggataacgtttaaccattcatctattttttaaaaaaaattatataaatatcatttattttttttggcatgttttatcattaaagaaactttaagtttgtcttatactttagcatatactccctccgtttcgtaatgtaagtcattctagcattacctatattcatatatatgtctagatttattaacatctatatgaatatgtgcaatgctagaatgacttacattatgaaatagaggaagtatatgttaatttttaaaataagacaaaggctgtgttcgctggtgctcgttcccagcaggaacagtatgcacagaaaacgaaacggtctattagcgtgtgattaattaagtattagctaattttttttaaaaaaatggatcaatatgtttttttaagcaactttcgtatagaaattttttttaaaaaaaacacaccgtttagcagtttgaaaagcgtgcatacggaaaatgagggagagggttggtaacctggaggtctgaacacagccaaaggagcaaacgttatttgaacacagcaaaaattaaagatgtttttgccggtacttttggtacgtcatccgtgtatgagtcggtttttaagttcattcacttttagaaatacaaatccgtatttgagtcggtttttaagttacttcatttttgggaatatataaggaatcgtataaataatctcttaaaaaactcgcatgctaacttaagatgatcgggcttctaattgtagcacatgtttttctaacaaaatatatatccaagcgaatttaacacaatgaatttcaccttaactaaacctataataataataagattaaaatagtcttcacctattgcaacgcacatgcatttttctagtctactagcaaatatgcccgtgcgttgcaacgggtgaaaaaacgtaatgataatatacgtttttcatgcttaaccatgtcgataacaattagaaaattagaactacgaaactttattttctagataacaattagaaaattagaactacgaaactttattttctagcgcgttttcttttatgctttattctgacatttttccctcacgtgttttttaaaccgtttttattttctcgcgcatttattccttttttaatatactgtagaaacttctctttttatagttagataagattagattagagataaagaagatatataaatggactaaaaaacgacgaatataaatttgacttttttcctccgcgcttttttccgtccttttaattattttctcgtgcatttcttttacgaagggtttttttcaccactttcacataatgtcaaaccttactagatataataggattccattttttttaccgcatcacgtataattcctttttctttaaaaacagacaattttatggcccttttttatcgcgtcaacggagtcagaattgttttgattttttcccctttttttggatcggacagattttttttttgcccggtttatttcgcccgatcgattttttttaccgcgtcacatataattccttttactttgtatttttttcgccctttttttaccgcgtcgacggagtcggattcgttttgatttttttctccctttactttggaattttttcgccctgttttcaccacgtcgacggagtcggattcgttttgatttttcccctttttggctttttttgataggacagatttgtttttttttcgccccgtttttttatcggacttttatcttttttttcgcctggtttttttattttttttaccgcgtcacatataattcctttttctttatcggaaagttttttttcgcctttttttaccgcgtcgatggagtcagattcttttcagctttttccttttcttttatcggacaaattttttttttcgcccattttttttctcctgtttttttcggatcggactatttttttcttttttcgcccggtcgatttttttaccacgatatatataattcctttttctttggaataggacagttttctttttatttttttaaactctttttaccgcgtcgatgtagtcggattcgtttcgatttttttcctttttttgctttcttttttgtcggacagatttgttttttttccacccggtttttttccgcccaggtttttttatcggacttttctttttttttttgctccacgatacatataattcatttttctttggaataggacagttttcttttcatttttttaaactctttttaccgcgtcaatgtagtcggattcgtttcggtattttttccttttttccctttttttttgtcggacatatttgttttttttccgcccggttttttttcgccaggtttttttatcggacttttctttttttttcgctcggtttttttctcccgttttttgacggacgacagaagcacctagagaagtgttttttttcttttctccaatccaatacagatcggatctcttccagggaaatcagattttttttctccagggaatcggactctttttttcgctttttttattcattaaacggtttgtctctcggacttttttttcctttttaagggatcgggtgtttttttgccagggacgggtgtttttttcgcccggttttttttttcactttttttttggatcagactttttttttcgtccggtttttttgatcagacaaacttggttttttctgcccgttttttttcacccggtttttttgacggacgatggaagcacctcttattttttaagtagatagtagatagatagattaaaaagatgtagtaaaaacacgtacgaaaaaagtggctactttcaaatgctactttaacaactgttgctactttcaactctggctggaaatagttggcatatgtgacgtggtctcatgtctattcgtgtattagtgtattctaattctactaatcggattaggataggccgatcatagagttgatatatagcctcttctccaacggtaatctccctccgacgatgcactggtagagaaaccatctttggtcggtcgacccattatccataatagtcccggttccattaaaaaccgggactaaaaatgatttttagtcccggtta

SEQ ID NO: 5586 - DNA, 14962 bp, Oryza sativa
agatgtgaatctgtaatgtattattgtgtaagatgggaatctgtgatgaattttttagaaccctgtgatgtaatttttttaagagtttgtaatgtatttggagatgatttgtttgaggatttggagatgttctataatatgtgatgatttggatatgggaggggatggtgtgaaatcaatattcaatattaaaagcagaaaaaaaaagaaaaaatatctttagtcccggttggtgttatcaaccgggactaaagatgctcccatctttagtcccggttatttaaaccgggactaaagatagcgatctttagtcccggattcgtagtcccggttaaaaaaccgggactacagggggttacgaaccgggactaaaaagcatttctccaccagttatggtattctccacgagtatgacatactttggacatgcaaggactcaaaggagaatgtgaagacgtaactgattacatattatatactgtacattacaattaagaaaaacatgcaagacaatacagcagttaactagtaagagaaacattaggtacccaccgtttctatcgataggccggaatacaatttcttacgtgaccaacgatcgaggcaacgaccccgtatatatatatatacagcatgaatgcacacagctggatctcaagaaggaaagaaaagctaatctattatattattaaagaaatagaaaaatgagcctctacgttcgctctcatggcctagaaattctcacattaattggagaaaaagaaaaagcagagtccatataaaaatacaatttagaaatagctgaaattcggaattaaaaaataaagaatattagaagaggagactagagttcatatagaaatataattagaaaatagctgaaattcggaattaaaaataaggaatattagaagatgagtatagagtccatataaaaatataattaggaaataataaaaattcgtaattaaaaataaggaatattagaagtagagtatagtgtccatatagaaatacaattaagaaaaaaaatagaaattcggaattaaaaaataaggaatattagaagtagagtataaagtccatatagaaatacaattagaaaataatagaaattcggaattaaaaataaggaatattagaagtagagtagagtccatatataaatacaattaagaaaaaaaatagaaattcggaattaaaaaaataaggaatattagaagtagagtataaagtccatactaaaattcggaataaacataataaaattaaaagtagtgcttagagtccgtataaaaatataatttataaataactaaaattcaaaattaagaaaaacatgggaagaagagtttaaagtcaatataggaatacaatttagaagtaactgaaatttgaaattaagtttagagtccacgtagaaatacaattagaaataatgaaaattcagaaattaaaacaataaatattaaaagacgagtctaaagtccatataagaagaatatatataatttacagataactaaaatttaatattaaaaataattaataactaacacgtatgtaaaatacaatatgaatattacacattagtggtttcgtaaagttattgcaaaatttaaaatgatgttgtcattttaatatatttgaataatataatgagaaaacatatgtgctattatatgagagaaaatataatgatactagccgcacaatctgtacgggccaccatgctagttaaggtgaagacaattgattaagaagcaaccttgatcgagctagcaacaacagcgtcgaccagagaggaggaagaagagatcgaagaagatatggcggtggcggcgccatccttccccgggatggtgcaatggtgggaggagtggcagctccgcgtgctcgctctcaccagcctcttcctccagctcttcctcctcgtctcggccacgttccgcaagtaccgcgtcccgcgctcctccggtcatgcatctggctggcctacctcggcggcgacgcgctggcgatctacgccctcgccaccgtcttcaaccggcacaggcaaacggccagcacagatcatggctccgtgctggaggtgatgtgggtgcccgtcttcctcgtccacctcggcggccaggacagcataaccgcgtacaacatcgaggacaacgagctgtgggcgcggcacgccgtggccatgtcgtccgaggcggcggtggccgtctacgtgttctggaggtcatggtccggcggccaggtgccggagagctccccggcgctgttgctgttcgccgctgggttcctcaagctaggcgagcggctgtgggctctccggcgagccagctttaccaggctagccgccgtgaggtcctccgccgccggccggaggacgccggcgagggaggaggaggaggacgccggcgatgatcatattccgttagagagctatgtacacctagcaagcggctacgtacagagccaggctactggtgaccatgtccctaggcccaaagacaattacgtgttccatgtccatccgctgatcgaacccgagctccaagatgtgctcatggagctcttcgtcgacttccctgcaccctatcctcgccgccttgcctacctcaggtcgttcttggcgcttgaggacgacgacgcctacgaggagctctgcgccctgctaaatcaggcgttccagttcttctacaccaagaaagaggccgcgtacaccgtcgtcggcatctaccttcgcacccttcaccatgctcctgggcatcgcggccattgcaagcttcaacgacagtcgcaaggacgggtttgacggcagcgatgtcgtggtgtcatacgtcctgctctgctcgacgctcgtgctcgagatctgcgccctgctgtggctagccgattggcgattcgtcacgtcgcggatccagccggagatgcagcgcacggttgcgcagttcaacctaatcggcttcgccactcgtagacggtggccaaccatggtggtgatgcggatagcggcgttgttcagatgcaaaaagtatgtcaaccagcactggtatcttgggcatctttcgtcaacccccataatcatagagttcatcggcaaagacttgaaatctagatgggtggatgatctaaccaacgccgccgcctaccggagattcaatgaccggagaggccagtggactctccggcgagagaggtgctaccaagagttgggatggagcgtgaccgagctgccgtttgacgaggccgtccttgtctggcacatcgccacggacatctacctcgattgcaataatggcatcgaaaatccaccggctaccgccgatgagcgcgccgccgtgaaatgctcgcgtgagatatccaactacatgatgtacctgctcttgttccaaccggacatgctaatgcccggcacccgacagagcctgtttgctgtggcctgtcgcgaaatcaagcacgcgttgagggaccagaggcagcggctcgatgagaggggagttgcacgttggatttctgaaaacccaaatgctgcacaacctggagaccatctcgcagctgcacgtaggcttgccgaagcgatgatgcagatgaacgatgcaggaaggatgttgaaggttatcagtggggtgtgggtggagatgatatgctactccgcgagcagatgcaggggattcctgcacgccaagagcttgggtgccggcggggagttcctcactgtcgtctggctcctactacatagaatgggcatggaggtcttggccgacaagctccagaagccggagattcctcgacatgtacaaattcttccttagctttgtttttaatccataatcctctgttaaaatgttttgaggacaattgtcatctacatgttgaatgaatgaatgaaattaatgaatcagacatttgagggtgatcattgtgtaaacaaccattctagttcttgtattctatctatctaccatatatagttcaccaactgagcggggtctcatgtacatatacaactgacacttatattacttattcatcaaatccaatgtcccacgtacatatacaataattagatggtcacgattgactccacatccctctgacacccgccgcctcatcccacccgacccacgccccgctaccctctccacccgtgatccctcccctaaccctaatgtgcgccgatgccagtaacgatgaagaaagggaaagagaggagggagggagagaagacccggtcaaaccaaacatgtagacaccacgtcagctgaaaccgtcatccaaactgtcttaggatcaagtttgcaccggtttttagagttgaaggttgcattgcatctcgtattttagttcaatgatgaattttagactcggtgtcaaaatgaaggatctaaagtgaacttattccatgaacccacaccacgtacttcccatcaaagaattcgtcggtccaacccacacgaactggcgaaattggttgggaataagttcacttagactcccgttgagtaatcaaatcttatttgtatccctgaactacaataccagatagctcgaccacccaactattaaaaccgatgcaacttgactccctcgacagttttcaagggcggtttcgctaatgttgcgcctacgtggtggtattgacctagtcttcgtttcatgtgatgttgacatggctcttatgtggcattaaaattaaaaaaaatacatgtgggacctatttctcattcacataaaaatattataaaacccactgacgtggtagggcccacgtgtcattctctctccttcccttcttcctcttcccttctctctctttctttccgtatttctcctcccctttgacgtgcgcggggagcaggggccagatcggtagtggtggcggtggcaggtgggggttggagaggcggacgggcgctggagcggcgacggcagcatgtggagagagggaagaggataaggaaggatgaggtggctaccttgcgacggtgcgagaatttggattggtggcgatggcagccggagagggaagagagagagagagagaagggggcggtggtggatgaggatttgggagcgggaaggcgagcatggggtagtgtggcgaaaagcgaagctcgctggcctttttataggtgagcgctagtgctacacggtgcgggagagaggcggtggtgtggctcccggtgtggcatgtatgtgctggccgtggcagtggcacaatgagcatttggcgtgggtgacagcgccatgatgacgttgggcagcgtggggaagatgggatgcagggcggccgcgacgcgacgatgatgggttgagttggacggcgccctttccgccatccaattggtcgcaggcggcgatttaaatgacacgcttccaacaggcgtcgctgtccttctcccgtcctttccctcctaatccaagctgtccacacgactcccgtcctccactctttgcttcggtatctttcgttcatcgagaaccgccgccattcaccagaataccgtcagccaccatcggtcgtcgatgcgctcgcctgcctccacgtcgcacggcttcagcaagaggtggccgctgatcgccccaccacgctcagggcgctcgacatggggctaatcataggggggaaacctcttccgggccgacctcgagcccgccatagcgcgcatcatcgccgaccctggtaacgacggtgaagcgaaggccatcgatgaggagacccagccggtccttggttatctcccgcagcagcgtagccctccgcccctcctccgccggcggcgccctagcccgtggccaaatgccaccgcctatgctcctgctcccgccccccccctccaaacgaagagaaaggggagagagaaagagagaagggaagaggaagaagggaaggagagagaatgatacgttggcctcacatgtcagtgagtcctacaatatttttttatgtaaatgataaatggatcacacatacatttttttaattctaatactacataagcaccatatcaacatcacgtgaaatgaagaccaaatcaatattgctacgtaggcacaacgtcaacgaaatcaccctccaaaaccgctgaggaagtcaagttgcaccggttttaatagttgaggagtcgagatattcggtattgtagttcaggatacgaatcaaattcggtcactagataagggaatcacactgaacttattccaattggctgacatatttttagcctacgattcagcccatccaaagacgaaagaattaggccagataggccgggaatgcatctcatctcatgttagaattgctcgccacggcaggcctgcagcagacttgatatagtttctttacgagaacccttcaattgagagttcagacaagctcagatggcaggaaaaatgcaattatcacatcaattatgctaatactgggagtctgggacgccccaaaaggaaaagaaacaagaaaagctaatccagggacagaagccaccacaagctaataattcactaataatcttgtatggagtgccaaacttttacatccaaaaagttccaaataacatgaaaacctggaaatttcagagcacatgcatttcactttccttctgttctcccctcttttttctaccagaaacgctaattccaaacggagaagtggagggcaaaataaccagcaaaacaggtgtggcctatgcctttgcctgtacagcctgcatcttctgttgcaacttgaagatctacagaaacaaatatattttttagtgaggtcttcaaaataatcctatttcatagggttcaactaaatgcaatgtcattattgtcctatgtcatgctctgatgatgtgcaaagtacagccaagtcaatagttctagaaaagatttgtagcaattaaactaaactaatctgttaaccgtgccaagataattgaaccttttacggttagtatggcatcatgtaagaatgcaggaacctaccagcaaaacaatttcaccaatactatctcagtgtcatgctcaaaatagagaagtcagattaagattctttccaaaaacatatatcccagtttttaatctcagtcctaagactgaaaagacattgcaaacctgtatgagcacacatattgcagcagtttcagctagtttgataagatgtatttggtttgtactctactgtctagtttctagatgtctactccaaagaaccagacaacttcagcacagaacatacagtagatgtccaagcaaagaagacaaaagaacgtctagggggccgccccgtcttcaataaggaactatctttctgggcaacacacatgttgatgtattataggctgaaaacaaccgaaatacccaatcgtggtgatcaatggatgaggatgcaaactgaaattttttaaaaaaactacaaactttaaggctctctgcgtaatcaaacagataaagagagaggaatgcacgggagaccctgagaggaaggaagatttcagatagttgcgtcaagagtcacgaccagcttgcaagccaaccatggcacgggttcagcactagcttcctcacctccaagctgctgcctttttcattcagtatgcctctcctatttgactcagcatactatttgccatagcatactgaatgactctgtgtcctagttgattcagcacaagaccacctactattccatctcacaaaagtacaaaaacctttacaagcatcaaagctatggcaaagatttggggtagttgtatggtggatcaagactgcaaaataatcctagctacttggattagcccaaaaataagtcccagcgagaaggaaatatgggcttataagaaacataatcaagtatccctaagttcacgccaagagtcaaagagaacatcaccatgtttgaatacttgaacaaccaaatttattttatttcacaactctttaaccaaccattctcaccaacaatgtggcatataagtttaaacattgatggatatcattctaatccttttgccaagtaccttctttgtagttcctccattttcaaatacttggtgcaccagacttctcgaaaaaatttatcacgatttacccctatgcatgcacctacttttccacctcgtcatcagttcttgagataataatatggtattgtttgtcattttttattcaaagtacaattgcatatatgcatgtcctggttaagagtataaattattcaaaaacagaggggtaatttcttcttcagcaagggatctcaagtatttttttttctttattttcaatttccatcaacgtgtccaattcaacctatcattaaaactaaactaggggcaggcagtagctatgcatagtttagaaattgcacatcatattcatctgtaaaaaatcaggtatttattatctatattgatcagaaaatcaaatagattgtagagtatatagcctgtgaaaacagtaatgtctactccgaaattcaggccacaattttaaatggtcctacataaaaaggaaggacaaatctctcataaccactgaaatttcaccaattcagttatttggcatacgttgtcttaaatgcccgtctaggtccagggcctatgtgtcacagacattaaacgatcgtgcgaaatctacaattccagtagggaatcgccaccaaaaaagaaacaattacttctatgctagtccgcgtatcacctttgaattgatgttcctaactgacctgccaataaaaccagaaataataacaagaagatgaacataccgattccttcttgctgttctgcttttcctccaagtccttgagcgctcgatccatccgcttcctgccgccaaagaatcaaccccccagcatcagcacaactcgatacaccccaaaaacagatcaagttaatcagatcaccaaacaacatcatctcaatggctactcacagctcagcggagatgtactcgatgcgcttcttgacgttggccttcgcctccgcgagatcctgcttgaccagcaccggcccgatcagcttgtacacgttcgcctcgtcattcaccagctccagctcctgcgcgagaccagatcgaatcagaaacccacaccaaaaaaaaagaggaaaaatccacatagagcggaagcaagagagcgcggcgagcagggcatgccttgaggacgagctcgttctcgccgacctggatggtgtactgcttgcggacctggtggttcttggagatgtctgcgagggggaaggaacggacagagctagggttagggtttcgggattccgaggtgacgagaaggaaggggaggggaagggggggtttcgagcgtgcctttctggatcttgctgagggcgttggcctgggactcgaggtcgcgctgcatctcgcggacggccgccggggtggacgacgacgccgccgccgccgccattggtggtgctgcctctgctcccctccgccgccgccgccgccggattccggtgtggtgcggaatgctagagttggtgtggtttggccgtttgggctttcgctggctttcttttccctttgttctgagttctgacatcgggtactattttgggcctagatgggctcaatttggcctagctaatctaacccaaaaaatgcaaaatgggctgagaaaagcaaatgttattgtttgggggaaaaagtacaccgaaggtccctcaaaaacgccctcaaaccgcaaaaccagatatgcggtgtcccttaactatacaaaaccattcacccgaggtccttcggtggttatgaccccagttttggcctatgtgggacccacgtgggccccacatatcactgtgccacgtcatcaccatctctctctttcccttcgtcctctctctctcacttttcctctctctaggctggcgacaggcgacgctggaacaggcctcccatcccgacagccaacgcctcgctcttcttcacctacaacgaggccacgcacccgctcacgccgccggcctcctctgtttgtgtttggtgagtggtgtttgatcggcgtcggtgtttggtggatgccgtgcaagccgagcggatgcgcgcggggctggaggaagcgcagcgacggcacgtccgggcgctggtggcggccgcggcgcgcgccccgacggggagggtgcgtgcggcggaggccaagctggatcgcgcatgctgccgcaacgcggagctagaggagaaggtccgccagatgagggcggaggggcaggcgtggatgggcgttgccaagagccacgaggccgttgccaccggcctccacgccacactcgactagctcctccagtccccctatgccgtcgccgccgccacgggggagggcgacgccgaggacgcgcagtcatgctgcttcgagaccccaggcggcggcgccgccgccactgccgctgacgcggtgtccggggcgacgtcgtgcaaggcctgccgtgtcacggaggcgtttgtgccgttgctcccgtgccgccgcctgtgcctgtgcggcacctgcgaggccgccgttgatgcttgccccgtctgcgccaccaccaagattgcctccgtccatgtcctcctctcctgcagtcactcatatgtgccacaccagccacttcatggagtaggaaatttcgatagcgcaacagctatggccagaccgaaaccgggcatccgtcagccaactccggtgtcaagcaagctaacaacaatcatcctgtcccaagttacatggaaattcatgctagggaagccacggttctgtgcatcagtgatctccgggccatgcgagttttgtcggtggaaacaacagtgttcggtgcggtgaattgaatggttgattgccgatctcatctgccgcaggtaccattgcttcaaatatttggcagcccgggtcggcacgcacgccgccccgtctccccgtcggccgttgctcgtcggttgtcctccccatcggccgccgcccgtcccggtaccccttctccccgccgatcctcacctgtcgacgacgtcccggcgccgctccccactcgccggccaccgcagctccgcgcctccgcttcgctggccgccgcgcgctcacacgccgcctccgccgttcgccactcaaccccccctcgccgcccggttgtctgctccctacccgtcggccggcctgagaagagtgcgagagagagagaatggaggaagggagagaagaagaggggaaaggggaattgacgtggcacgctgacatgtggagcccacgtgggtcccacgcgccacataggctaaaactgaggtcaaaaccactcaaaggacctcaggtcactggttttgtatagttaagggaccccgcatatctggttttgcggttcgaggacgttttttatcccgatgacaagttgagggaccttcggtgtactttttccttgtttgggatcacctatacatttgtcaatagatgtaattatagtacaatcgagaagtaattacactgcaacttgcatgtgacttgtatgtaactttcaaatatctctccgtaacatgattttggtgaaacggaagtcgtggggatgaatcctttcactgtgtgcgcatagtgacttttttccttcttcacttgtacaaatcttgaaaaaaatataatggttcaaaattatgtgaaagttacattgaattatatgtaagctgtatgtaaattacagtgtaattacatgcaagttagcatgtaattatactacgattatagtgtgattacatctgtcaaatttttaggagaaaatttatcgacaaatatatagcaaaattgtattgttttgtggctcaatgtccataaaagacagagttttttaaaaaaattacagtaatatatttttcttttacaaatttacgaaaatatacttctcccaccctttaggaggttatcttttttataaaccgccttctgagagagcagctctaatgggtttgttcgttagcaggatgctacaaccggctgcggtgatagctgcactgcaagcagtgtaatttctgctactctactgtagcggcttatgaatctctctactgaataggtccaatgacatagcgcggaggggttggagtttaacatattgtttgcatgaacagatatgtgtagaacctggtttttgctggaattaaatggaattatcgagggagtgggataaactgtgtctttcccataggacttcatttgccacaatcacgtacgcctgtaaaaaaaaaattaaaatcctatttgggtccttcccgctctctatctagacggtaactcgaaaaccgtctattagaaggacagaaagggcctatatgcaaaatttctaacgtgtccctaggccccgaaccctctacgtcatttcattagatatatcctctaggattgtaaaaaagaataatgtatttctataaacttaaaaggaaaaatagttgaaaacattgaaaaagcaagtgttggaagatgggccggcctatattggattagacttctagccgagaacattttttgcaaggtaggcccatgtactttgttagttgcatatattttgcaaaagtaaactcctctgtgtttctcttcctcttgctatggttgtttcttttttaatgagtttttttttgttttcaaaaagtgggtctctttcaatggtaatttatcttttatgagttcctttttttccctttttttgtggaggagacttaggagaacttcttggtgtaccacaagctacaaaaaagagactccaaacttgcaacttgggaggattcctcagcccatcatatgcaaaggccaagatgagcttctctgcagaacaaatgattgggtttggactggccaacagccatgcttgcaaacaacaccaagagcaagtagtcaaaacagcaccttcttttcctccgtttccccatcaaattccctctctcatcctctctttacaaggaatttcttcttgatggccttctttctaattcctctttcaaaaattccccactgttcattttgtgcctacaaaacatgaaagaagaatcataacggccattgattataaaactatatatgttgccacaattgatggaatggaaccatttgggcgacccatttgtgtgcacgctttgcctacattggtactactacttttgcataatatcaagaccgccaatttgagaatctgagcctaacccaaaaggagcatatgaatatatgatctccttttgttttcctcttccacttcttgttcttctcataaaatgttggcacttggatgcatattattggatcctcagccccacatacttgtggaggtctctccttagactccaacccactttctcgagataattcctagaaaaagctaattgcattgtgttgccccctcttccaaatttgattgtgtggggaggacaagagaatatcggtgcactcccacttaaactaactcttggtgctagtggaagttatggttaattgctttctttattgaaagaaagggtgagagtgtgagacttccctttgatggacaccttgaggaccacacaatctcagccaactattgccaattcgacgctcactatcaatctcattttggggtccattgatttgtacatctagttttctaggactggtctaaaaaacaatgcaagaacattgctgcacaatgagtcccaaaagagactatggtttgtatgcaagtttttaggaaccaaactgaatatgttgacggctctttcagtgagatcttgaaaagtatgatctattctatatcaaagaatcaattgtgtatatgcacaatgtaacactgaaatttttaaaattaattatatatactttaataactttatttctaatatatatataatttaatagattttatttacagaaatgtgatgccaatggaatatcatttgttatctgtataattacaatgtaaaaaaggagataaaactagttaaaaggaagtgcacgagtttattagaatcaggtagaaatagtatgataaatattatcatggtcatacatattttttgtggttcctaattatgcacatagcttagctaggaccagatgaataccatatgaccagaaatccagaattgtatcaacctagtttattttgcactagggatagtaggggtttctctagtagcgcttgtttgcatagtttaagtgttcaagttgctacttatttttaccaatattatcatttttgcatgcaaatgagcaatttcatcaatataacctgcgttatttcacaccaataaattattaggagttcgtatgctaatataaatttctggtttgaaatggtacagatagaaaggaattacgtcacctggtcacaaaagacacttttatcccatagaggcaattttcgcctctatattgtagaatcatacacctagaaaaattttacaagtttatgagatttttttatgacaaacatgcacctatcattcttcacacattcaaagctccaagctatacattctagattaaaaagtagggttaattggatccatgccattgcaaatttatctattcagaaaaatatcactacaatttgtctatacgtagctgtgctactggaattttacaaaattagaaccataccactgccgtcacgttctccatccatctcttttttttttgtcttcttccttctttctcccgtatcctctcactctgctttctttgcccggcacggcgaaggccaaggtggtcgccatggccactaaccctccgaccacggcctagccactaatggagccgctcctccagctcggccgcgcggcaacgggtggcgtcgagctcaacctcgttctcccacagccgccgcaccgctgacgccaatgcgtctcgaagcagcagcactgggcgtcatcagccacgccaatgaggggtcaaagttgttgacttgggcagggacggcatgaaggaggaggtcaagacatgtggcggtgacctcgtcagttagagagcgaggcggaaggagct

SEQ ID NO: 5587 - DNA, 18013 bp, Oryza sativa
aggcatccagcacggctcagatatggtcaccgttgatcccgttgctggcccgcctggacaggaggaaggcaaggcacgcggcgcaatcaaagtcaccgacttgggcagggacaatgcgaaggaggtggagacaagcggcggtgacctcgtcggtgagagagcaaggcggaaggagctcgggtcgatctggtcgtcgtcattgtcgttcccatcgctggtatccgacgcagcttagatctggtcgctgtcgatcccatcgtagaccggcctagacaggaggacgacacgcgcgtcggcgaggcgcacggtgccgaagtgccgaacatgagccctcgctggcacccagcaccgcggcacgtagctacttggtttgcctagcgtcgctgccacgccgtgaatggcttcctcttcctccttggctccaccatggtcatcttggtctcgccgtacagccatgttcgagctcaagagacgggagaaagaaggaagaagacaggaaaaaaaaaagatatggatggaaaacgtgacggcagtgacatggtcctaattttgtaaaattccagtgacatggctacaaatagatgaactgtaacaacatttttcttaaatggcaaatttgtaatgacatgggtccaattaaccctaaaaaatatcataaacaacagcatcttcagctccatgcatggttcacgaaatcgatcagttttcgtgaaacctctaggtctcggcttataaaaatcagtcagtatttggtggtttctgtacagcattgaccgaaagtcaattggttttaccagtttttagtaaatcagtgaggagcgattttcacttcgaaaacgaaaggtgaccactgacttcaatacttcatgcattcagcatttttcttaagagtaaatttcacaaaactacatgtattttgcacaatttatcacaaaactacagatttaagagcttgtttcacaaaactacagatttagtatgcccgtttatcacaaaactacaggtactttgtacaatctatcataaaactacagatttaagaacttgtttcacaaaactatagaattagtgtattcgtttatcatagaactacacattgagtgtcttcatttatcacaaaactacaaatttagtgtctccattatcacaaaactacaggttttgacaatgctaaaacctgtagttttgtgataatgaagacattaaacctatagttttatgataaatgaagatattaaatctgtagttttgtgaaacaagttcttaaatctgtagttttgtgatatattgtgtaaaatacctgtagttttgtgataaacgaagacattaaatttgtagttttgtgaaataagttcttaaatctgtagtattgtgatagatcatgcaaagtatatgtagttttatgaaatttactcttttcttaatgaccggagaggggatggtgcttaattttagaatttaatttaaagggttttttttcatgctttctgttttttaagttgtgtttccatcagaaaataattttattttgcactcatctcacacaaaccaatacaaagacaaaaaaaagagagatcaaaataacatccaatttaacaaaccccaatgcaattatctcccactctaacaaactccaatgcattaatcctccactttattccctcgctttttattacactagaaaaaatgcccatccgttgcaacgggtgaaaactatttaaattttgttattgttataggtttagttaaagtgaaatttactatgggattcgcttgaatatatattttcttagaaaatcatgagttgcagctaggagtctaatcgtcttaagttagcatgcgagtttattttaaagagatttctatacaactccttttgtattttcaaaagcggaccaacttaaaaacggagtcaaacatggatatgtattttcaaatgcgaatgaaacttaaaaaccgactcaaacacgaatgacctaccaaagtaccggcaaaaacatctttaatttttataattgtagagatacactaaagtactttttatttgcttctggcttgtatatctcttctctactattataaaaattgaagatatttttgccggtatatttatacatcatcattgtttgagtcggttttaagttcgttctcttttggaaatacatatttgtgtttaagtcaaattttaagttcgcttgcttttagaaatataaaaggagtcgtataagaaatctctttaaaaaaactcgtatactaatttaagatgcaaatcggactaataattgcagctcatgattttctaaaagaaaaatatgtccaagcaaattcacacagttaagttcaccttagctaaaccgtataacaataataagattaaaataatcttcacccgttgcaatgcacgagtattttttctagtcccataaaaaagtaaaaaaaaaatctggaaaacagtgttttttttaatcaccggtgccaatcgtctgtagtacaagaaagaaagacgcatgcattgccttgggccctaggtgataactaagtacaaattccacctttaaaaagttctttcgtgagtattttaattggtcaattatctagtggctccaggggcttgatcatctgccaaactctcttgtgctccagtaagtcccccccatgaagaacaagaaccgaatagtacccttacacacctctagagaactcaaaaggcatcgatccatcttatccttgcactgatcgatcttccaaagtccaaactcaacttaaactaccactatggcgtaaaacaaactacagctgctcatcatcatcattggctcattgtcacacatttgagatcgactgatcatgtaacgtgaagatcgagctggcgccgccctgcagtgccgctgcatgctgctgctcctgctccgtgccgaactcgattctttctcctcgtggctttcgtgactaaagaggagaaaaaaaaaatctttagagcagcatatgccatggctgaatagccagatgatttccgataattatttaagtgtgcaaacaaatgaattaactattttaaaatttgatttagaatatttctctcagaaaacatacatcgtttttttttttttgcaaaaatcacatcatttaaaaatcacttggctgggaatttgtcttgggtaacacacgactaaagcaacagaaaataacattaaaacaggtgaaaagaaaacacctaaactaattaaaattaaatctcgaaattcaaactatggcttataatacatagactaatttgaaattaaatctcaaaattcaaattatggctttgtttgatttagattattgacgcgaatttatctatttgattattgatcacaagaatagttaaaatattttaacaaagaaaactaactaataactcagaacgtataagcaattcagcgaaagaaagttgtctgagaaaacatatttctcgaaacatggagcaaaattatccgtttcaataatccgataaacacacagaaaaggacatgcgcacaaatgtaattaagcgggcaagctgcagaggtactccctccgtcccgaaaagtcacatccagtactacgaatctagacatctctatccagattcgttgtattagaacggagggagtacacaactacacaaacgcgcatgcaacacgaagttgatctgtcggtcggcacagcggccgtggcagcatcgacggccatttgtcgaagctgcatggacgctgccctctgggcgaacctactactaatctcccgagaggaacggggaggaggccgaccaccactggggtcgttttctggagcctctgcctatgcaatattgcatgtaatttgcatttgcacacccggccggtggccactgccggtgcaggtgcagcagcgacgtactactagtctactactactactactactacttctacctcatccccctggatggatagctcatagctgggttcagacttgatctagctacatcgtcatcatcagtgatgtgaaactaacattggcttagctagctagctaggtgcgcatcgcaccgcatgcagcagtgagtggctcatatgtgctgggagttgggaccagaccggtttggtcagaattatcggcaaccggtggtaaacggccaatatcattacaaatttaaatttgttttattattttttcattctcaagtttgtaactgcacggccggatgtgaggacctgcaagtcacagtgatgtgtgaggtttacatacaagaatagagttaaatacccgtccacgaatataagaacttctagcatttaaaattttatccataaatataagcatttccgaagaactacttccccctccaaccacccctcagtaactgtttgcgcagttttatcccaattgtagtattataaagggcctttcccatctcaaaagctagccgttgaggtgaggagctcccctacttatatattaggtccattgccctttcacaaccaatataagactattcaacaccaatcaccccttatttaaccataggcatcatagtcttttcgcttcatttttaatctctctagaagcccttatatttgtggacggagagaccgagagagaatagacaacgctgtcaatgattaatcagggtgtggcatgaattgttcaatgggggtctaccagaggtactaacatgtaatgaccaaaggatcaagtggctggatgatcaagaattcgttgttggaaccttatcatgatcattgatttaattgacagctcacttagagaggagaggctccattaatctgcatggccaaattatttggactgtgattatctataatttgcagaggttcaggtatgctcaatctggtaaattcctggaatcattttctctttctggttcatataagaacactaaattatttccatataatcctctaagataagcaatcacaagatatgaaggaaatattgacacgcaattaaggaatttttcactttaaaaacaaacaattcctcctttttttttaaaaaaaaaagaaacaattccttacctctcatatcatatcccaaatcttcattcataaggtctggcaaagattctaaatcacccctggaatcatttcgttgtcgacagcactatcacctttcacaaattctgcttcatctgtttgtggaaattgtactctgaaagggaccaatacaaatagaaggcagtaagttagtaatcaaccatggcgtgcacattcaacatgttattttcgtgaatccaagtaaaaatcaataaattcgacaaagactaaagatatatcgatcacacccataatcatgtgcacggtaatatccttgttgcaaatatctgtgtccaaattttgacacaccttgtcagccatgaaaaacaagcaacttattgaccaattttattatcagataaaatagtataagctaaaattataacaaattatcattgtaactgtgaaaggcaaaagcgtatcaaccacgctgtcatcaagttcacaaacagaaccatgataccaaaaagggcatgcaaaaggtatggccgtgtacgcaaacaaatgattccaaaatgctgatatgggaacaggagtgctcaaagagcagatcatataagccagataacaacaaggaatagaattagataagaccaatcaaaagtacagaatataaagagaaaagaagatgttactgaaaatgactaatcaggatggaaccatatcactgacgatttaaagatctgaactgaccatggtctatagaataggaagttaaccctcaacataaaaaatttcacaagtggctgtaacattattagccttcagcaacagctaaatatggcattcaattgataagcagattaaattagatttgaacttcacacataatttttgagacgttgcaatcagcatggtctatgtattaatggtactacccatgtgagaccttcccctgtgttgtttgaacataattgcaacaacgtttcaaccagctcatcattataaagacgaacaccatcgccacatctcctaataagtaagaacaccatcatccacagttgaaagatgcaacaagaaaatgggaatggacacatgcatgcacatgcctgcaaggaccgccacttcatcgttcaccactctcacatgatcacctgtgataatgcagacgacatcccaacagaagcaagatatcaggaacacaagaaacacaaggaagtggctgaaaattctggttgtcagattgttttaatggtcctgtaaagcaccagcttttcatagaacaatctattaaaagtactgtataaaagatattagcacaaaagtgtgtttgtaatacatcccctccaagctagttgatattgtaaaaccatcaaaccgttagtctgcttcacctggactatatttttagtattatattcttttttcaaaaattagaataaaaaatctatgagcagtgctgaacaaggcccttcaaaaagcagtagaaattcgttgatatcaaaagataattattccatcttaatgggataaactcaatgtagttgataagaatcgaaattacagaagatgcaaacgaatcaacaaaaaaaatgcatatttaatagaaaaaaggttgacatcccaggtagaggatggaccagtagtcacctgtatggaattctgcctctgaaagtatattgaagagcataccagatagggactcgtatggtttagcttttggccaggcccacaaagatagtactaatacacaaatagccctgaaatttctatttcctcgtgtccttcaaacacgtgcaatggcataatgatggctaggcaacaatggataactaatgcatttatcattgctaaattatagacaagttcaacatagttccttttttctggaaaggtttttaaaatagaaaatgagtaacattggacgttattttacaatttaaaaaaatgtatagtttaccttcaaggaaaagatttaaccagtatatgattgtcaatgactttgacatcataccagaaaattacagaagatgtacgaaaaaagtatccccagcagcacatcctaacatcaaagtaggcaccacttattgttgtcagccagtatgccatagtaccctgcatgacatgtgagcatctgtcaggatagcaattagcaagtgctatatccagccagcaaaatcattacaaaagtaaatcatacgcttattattcagttataacatcgacaagcccaacaattagtgtaccaagaagaaggttttttcctttgtctagaatataacttcggggtccattgcaaagcacaagatatgaagtgggtaccatctgaccaagtactggctgattcaccaagaacgcgatacaagacagaacttcaaataagattgtaaacaagtgaaacttttgccagagatcacaataatggagatacagtctgttcattcctcactggtcccatgaaaacaggcagcccaatcagtgcaccggataaacactaattgcagcaactggtaggcatcagaacacggaggctacttagactgagtgactgacaagagattgtggatgatcttattagccattcatctgctttaattagttgagatgaacgtagagaatggatccttcacccccactaaaacaaatcttagttgaacacaactaccaaaagaatatacccaacgattaagtccattgcagattactggcagaaatgacatccatgattccggccgtcctgttcacatttgcacaaacatgtggatggcagtgctaagaaaaacatatgtcagaagtaaatttgactgagattaacagaatgccacttactgatgcacgagttctttttttaacctttgacttgggaaccaatggctactacaaaagtaacaattatgaagaagcatagctatccagaaattaattactagtcacaattgccacttcagcacaaggactggatgcacaacacaccagcaaaacaatacacaccacagactgttcttggttgaatcgaggagagcaccagtccacagaaggagcctgcacattcaccagagcaaatggttggagaggagcctgttggttcttgctcaacagaaggcattcgcaagagaatctatccttgcagatcagctggaaataaattgcttcaggagttaatttgactgcagctgatcatctaccaaaagaagtcaactctgtctcgtgatagaatctgccgacttgtcttagctaacagcttcccacatctcccatctaaaacacgcatgccctgtccgttgttttcctcgtaaggtacaggacacgagcagtttccggttcccttctttttaaaattcctcaccttgaccctgcatgttcatcatgtgcagcatacatatatatatatatataaagacccagcctccacaccctctgcaaacagagttgggtggccaagaacaagaacagcaaagcaaccatgacccaagctcactcaaaatcttgcttccaccagttctgggatggactccagatcaagaggagcagcgatagcttcactgtagagctactgccatcccttggtgcaactataaaccactccaacaagttgcagaagttcatcatatcgccttatgatccccggtacaggtgaggttcacactgcactttctgtacctatcacatgctgcaaggcatataagtaaacagcagttgctgacatgatctttgtttgctttgtctgtgtgtctctcagatcctgggagctgttccttatagtcctagttgtttactctgcctggatttgtccgtttgaactagcattcctgagggacttaccatctaagcttttgctagttgagaacattgtggatatattctttgccattgatattgttttgacgttcttcgttgcttatgtcgatagcaaaacacatcttcttgtggatgaccgaaagagaattgcaatgaggtgtgttcctgcgttactcattcctatgatactttcatgttagaaaccccacatttggaattgaaaaaggcccaaacgattctgccctgacattagcaaactacgatcatctgcaggtacctatccacttggtttatctttgatgtatgttcaacagcaccatttcaaccaatcatccttctatttacacacaaggggaatgacattgctttcaaggtactcaatttgctcaggctgtggcgtcttcaccgagtcagttcactatttgccaggttcaaaatcttgtccaggttctccataatttgatggcgaatcacaagtgacaactgcaacaatttaatcattctattttatcaggctggagaaagacatccgattcaactatttctggactaggtgctcaaaacttatttctgtaagtccttctgaacaaaagaaacttaccttctgtgttctgtgcaaaaatttttctatcttgcaaagtactagttatgtgcctataggaagaaataagctggttcttatgtgtataaaatatgtattgaccaaaatgcaggtgaccctcttcgcagtacattgtgcaggatgcttcaattatatgattgctgacagatatcccaacccagagaaaacatggataggagctgtgatgtcaactttcagatcagagagcttatggactagatatattactgctctttactggtccattacaacactgacaacaacaggatatggggacctacatgctgaaaatccaacagagatgctatttgatattgtctatatgatgtttaatctgggcttgacagcttatctcattggcaacatgaccaacctagttgtccatgggaccagccgcaccaggaaatttgtaagtttctctacttaccagcaaaaatgtcaatggcaaatcttctgtctacagaaagatcattcagaaatgtagtttttagtgagatttatatagtgctgaatgcagcagattatggcagacaagtgaaaattttagcatttggaatgccattacagatgtgatacactaccctttgatcataaaaatacaaataagctgcatatggatgccatacaaataaatgatgtcaaagatctgagaacaaactagcattttggttttatgcgtggtgggatgtatggttacatataaaatcatgcttattcaagagcatctacacagttatacaatttatatgaattgtgtcataggaattagttatatctaagacatccaggggatcaacaccctaagaactaagcaccatacattcataatatccaatgggtataagaactattatagtttcatttacaaaaaaaaatggtcatgctggaccattcttttaagttcttgtgcaaatggcagaggcgggttttcaaccatagagcaaagcaagggaataaatgaatagaatcctgttcttgtagtattccacaaggtacaagttcttgtatccctacgtcatttgaccattctaagggacaacaacatcaacaaaatatcattcaactcaagggcaagaatactaaaagaggtctgaagtgaatgcaaatagcatagtcatcattttaactaaaacggttactactaccagcattgttgttccaatatatgtactgctatattgatgatcctttaaaaaatatatgtgcagagggactcaatccaagcagcatcagagtttgcagcacgcaatcagctacctgagaacataaagcagcaagtgctatctcacttctgcctacaattcaagacagagggactcaaccagcaggtcatgttagactgtctaccaaaaggaatccgctcaagcatagcatacagcttattctttccgatcatccggcaagcctatctcttcaatggagtatctggcaatttcattgcagaactggtaaaatcatgaaataattcaatattttcgtagtaccatacaaaagcaatactttccagtctttactaattgaatatgttgaacaaaacaggtcatggaagtgcaggctgagtacttcccaccaaaggaagatataatattgcagaatgaaggagaagcagatgtttacatagtagtttcaggagcagtggttagtattctatctccaatttagttcagacatgaaatttcactaaggctttatctgtacgctaattgcgcttttcttaatgctttttctatgtagaatataataacaacaatacatgggaatgagcaggtacaggttttctctgtatatatctattccagatatcagtaagatttattcagatttaccaaaaattatgaattgtttgaaaacaggtatatgagaaaattgcagagggagaaatgtttggagaggttggttctttatgtaacataccccagccatttacttgccgcacagcggagctatcacagcttttaagaataagcaaaacaaggcttagagagatcattgaagaaaacagggaagacagtaacattctaatgaacaacctagttcaggtataacttcaattttattttcaaacaattatactgcattttttacagctaatcagaagttaacaactctattccaatgtacagaagctgaagctacgagaaagtttacctgacatgaatcaaccagaccgaagattcttgagcaagtatgagctattccacgttcctcgagaagcatggctgctgaaaaagtcacaactacattacacagagcacacaagtagggattctagtaacaacactccagtatttggaggtgacagatattccagacagttacttggagaagcaacccgatcttcggcatcagaaaacgaaaatagcagtatgacagataaagaagagaaccatgatgaagttcacacaaactgtgagatcaaaaaaagaacggaagagcactgtatccagataaactctgaagatagcagctccacatacagtcagcgaacaatgaatgcaacagtgcagacagggtctccacataaaacagaagaaaacataacaagaagaattccagatgagtactacataaaagaagcaaacaaaagagttacaattcacaaatatcgtcataactcaacagtctctgctgcgcaaaatggaaagcttatcaagctgcctacatcattggaggaactgttcaaaattggcagtaagtaaaattaagttttaaactacctattttaactgtgtttcgcctatgcaatttactgagtggatagcagatgtaaatctgcaatttactgtatatcagctacggtagtatgtatttactctcatcatatatattcttcgcatggcaggtcagaagtttcaaggttttcatcctagaaaggtggtcagtagagattatgctgaaatagatgatgtcagtgttatccgcgatggcgaccatctattccttcttgagatgtagagaagaaaacgccataacaacctaactggacaagttagaactctggcataagtaatggatgcacatcaagattcagaactgaagatatgaagaggaatgacattttgacacttcaatttgtttaatagttactgacatgatgtaaatgcctgatattgtatgacaaataagcaaggcagccttaatgcatgcagtcatgcaaaaaatcatgaaagcatgtggccgaaagcagttgtgtaggtttctactgcaaggatttttaacctgaaattgtacatccattcatctcttttaataggaagaaaatgagcatgttaataacagccctgattcattacttccctagacttgacgacttgtgctacacaataataggagtatattgttcctcttggtgtttgtgctctattgtatcgtaattggtgtagtccgatgcaactacttcatatttcaaggactatcaaggtgtatcttgtactctctttatcccaatttgatcatcacttgtttatttgtgtcaagactaaatgagcatcacttaatgcactacgtgcaacccaccaagattaatttctgttggtccaactacatgcaatatttaaaacttgatgtaatccatggaacacaaaaaaacgtagcaccttaaccgatgagaatcaattacagaatgatgaatgttttattgtccttgatctatgctccctttgcttaggtgatgatcaaaatgggatggagggagtaatgcctaactagtaatcagtaaaactttttcaacttaagttctgaaataccatgagtcaataaatgaacagcagcaagactattggattttactgttgacttcttgagacgtgtactaaagcaatagtagatactgcgattctcgtcatccaaaacatatccagcggtgatctagccagcctaactaaaaatgtgtccataatccccagaactctaatacatctaattctgcatcagtcactttgaagaaaaaaaataactccaaaatctcaaaattagacgagagcacttcactcacaaacaaacaaacaaacaaacaagaaaggcgtagggtgcggggtgccccgccagaatacctgcaattttgcgagggcccaagtgcaaaactcgcccctacagtgcgtgcgagaaagagacgaggagatggtggtaggtcacctggcgacggcgccggtcggagagcagagcggccccgcccgtggtggcgggctccacgcggagccaccggtggaagccggcggcgaggaggcagaggatcgttggcacgcgcgtgggttggggtggggggggggggttggaggcgcgaatgcaggcgccattgacggcccgtccccacgagccgcggcgagcgatcgcgccggccgtgtgggacccgacggccgccgtggtgtggccgcgccgcgtgggaccctatccggggatggaaacagtgaactggaccgtcgaccatttttctcacacggatccaccaaatctgtgtaggtccattttgcctccctcggctatagcctcaccctgatatttcaattttgatatacatctgttgataaattttctcctaaaatttagcaaatataattacatacattgtaacttgcatatacttccgagcgtccaaaaaaaccaacctagaggaaccagattcgttatactaggaggggaaggttggctctttttggaacggagggagtacagtgtaatttgcatgtaactttcaaaattctcttcataacatgatatttcgttgaaacggaggtcatgggaacgaatcctcttacatgtgtgcgcgtgctgcgacttttttcctttctcacttgcacaaatcttgaagcaaatctaacggtttaaaattatataaaagttacatacaatgtacaattatattgtagttaaatgcaaattacagtgtaattatactacggttgtactgggattacatctatcaaaattttaaaataaaaatttatcgacaaatgtataggtgatcccgataatgaatttggacacctctcctcctaggttgagtttttttttctgttggacggtgggagtataggtgccattacattcaacaaaagaaaatttaagaaaaaataaaaataaggtgatgtgtagcaattcccaaaaatatggcgcagcagatacgatccgtgtaaggaagatggaggccttgttaccaaactagccatgctccaacgatctgagatgcattactccgagaataagttcatctaaggtcctttaattttacacctaatcagattttcgcgtccttgaacaatctcaaaaccagatacaaccggtccctaaaatgtcaaatcgggggcaaataaggtccctcggcggtttaaaaggtggttttggctgacgtgacgtctatgtggctagtttgactggtttttttttcccacgtagcattgacgtggcggttacgtggcaattatatcttggaaaaataataaaaatcatggacccacatgccagcttaaaaaatggtgggacccatgtgttagcgacaaaaaaaaataaatatggtggggacaacgtgggccccacgagtcatttcctctcctctcggctcttcctctccttcccggattgggattcgatgacattcccccgccgaccccgacctcttcttcgtcatcctcagccagttcggcgtcatcacccgtgcccacatccctctccccctgcgccccgacctcagaaaagtaagagagagggagagccgccgaggtccatcgagatcacctcgccccgcccgtgcccctgccacggcggccgcgccgccaccagtccaccaccgtcgcgcagaaccctgtcgcgctgctgcagctctgggtcgaccgcaggtgcctcatcttcccgttcctccacgccgactacatcccgggctccctccgccgcttcctcgccggcgccgcggactgcttcgtcggtgtcagcgtggacaaggacgccgagcggctgagcgacgaccacagcctccccgcggggaacaccgccgaccttcgcaccctcgcggcgcagaggctgggctgcccggagctcatacaggccggcctacaggccgtggtgcacgtcatcatgggcgcccacctcgtcaagctgcagagggtgaccatgagccgctgggacgccttctgcctctccaacgagtagatctggtacactgcatcgacgcctacgtctccttcgaggtcggccggaggctgctccgcgcttgatactgaggccatccacaatgggtacccctgggtcgtctccccgctcacgccgttcgccgtccgtccgctgcgcgtgtccctggagagaggcgagacccccacgtggggaatgcgtgcctctagctcctcagctccctttttccggagacactccctcgagactacgcattgcagcgacccggtgccccgtcccctgtctcctcccccagtgtttcccctttttgccctcaccggcggcatggcaacgagagagtgagagaaaggagagatgcgacggcgacgaggatccgcgacggcgacgaccagatccggccaccgccgcggtagccgtcggccaccagccagcgacgggcgaagacggcttcctcgcgccgcggcagccgccggccaccagctggcgacgggctcggcttccgcgacggagacggtgacgatgacctggcgacgaccccacatgcacctcggcttcctccaccgccaccgccggccccgccacggtctcctggcggatctggccacggggggctagatccgcccacgatggcgccggatctgccccctccggccggcggcggcggcgagtaagagaggcggcggcgagggggagagagagagtggcgcggcggcgagagggagatgcgcacggcgcggcggcgagagggagacgcgcacggcgcggcggcgagagggagagagaggggcgcggtggcgagagggggcgagagggagaggcacgcggtggcgaagaaaaagagaagagggcatggtggcgaagaaaaagagaagaggggtaggaaagtaaaaatatgagtggggactttgtgggctaggacactcattgtgtacaggagtatctctaccaggttgctttagatcttgaggagtccatccaaggataccctacactgcgagctgagtttttctacgatgtcctcagttagtgaggatattctaggagtgtctcacattgtgatgccctgatagaccgtcgatcgaggcggtcaccgtggcacgaaccgcaattgcttgcatcctccgtgcctaattctacctagattagagattagattcagttgctgttgtctttcgctcatgctctcacgtaatgttaggcaaggatttatgagatttgaggtgttatgggtttatgcttagcactgaagaaattgaagaatcggatgaaaaaaaaggtgccgatcttctgatctagactatggttaatgaaactagctgggtggcctgcgcaattgcgcggctagcacccaaacaaaatcatatattttttagtatgattttacttaaaatttattaaatagctatctccgtatttctaattatataaagtcataccagctgctaccccttacttctgtcatatctttttttaagttaattgcactttggtccaccttttattaccaaagtttcactttgggctatcctctagctcatattttcactttggaccaggtaagattaccttgaccaccccaagtcattttctttagctgtatttactctataatattgtaaagaattacatgcgtaagttggaaaagattatcgggttacgggttgctgatgtgtttaaagttgaaaaagtcttttatgtattcataaaaagtttatgcgggtggtccaaagtaaaagaaaagtaaagtaacctagctcaaaatgaaaaaatgtattaaaagggtggtccaaagtgaaacattggtaataaaaggtggccctaaatgcaatttactccttttttttatttgcttgctcggtctaccattatttctattcattctccttgaaacctttaaaaattggatcttatagttttttgagtttattatcttgttgaatttcgtttttataatttctagaagtcccaccaaacgcggccattatactcctctacgatccgtccactgtctttttctctttattgtcattgagattttacaaatcgaaaataattatcgttcgagttcattttttactttctataagtcccgccaaaccgtcagcgacttttctattgtactccttggctcgcccgctgcctcccttctttatcgtcattgagattttaaaatcgaacataattatcattgtttttttttacttcttagaagttctgaacctttaaaatagtttttagagtttattgtctcaatggtttttttatataatctttagaagtctcgtcaaacgatactactgtactcctctacggctcatccgccgcctattctttattgtcattgggattctaaaaattgaacataaccatcattggaattcatttttttattttctaaaagtctcgccaaccgccagtggctctgcaactgtactcctatacaccctgcacgttgcttctttttattgtcatt

SEQ ID NO: 5588 - DNA, 69556 bp, Oryza sativa
  unsure (1)..(69556): unsure at all n locations
tcagaatttatattttttttcaaaatttaattaataccgtatattgttctttcaattttttttttgaatttcagttgtttcaaaatctacttgtgctctcttttaatttttctaaatttggatattattatattattttattctaaattttaattaatatcgtattgggttcttatatggattcttctttcaatattgcttatttttaattccgaattttagttgattttaaattgtattcctacttgaactcttattttatttttgctaattttggattttatttttatttttattccgaatattaactaatctcgtattgggttcttatatggacgcttctgtcaatattccttatttttaattctgaatttcaattatttttaaattatattcctacttggactctccttttattttctaatttcggattttattttatttttattcataattttgattaatctcgtattggattcttatatgaactcttctttcaatatttcttatttttaattctaaatttcagctatttttaaattgtatttctacttggactctccttttctttttctccgattaatgtgagaatttctagcccccacggtgaacgtggtgcctccttttaaagctgttttaataatataatagattccctaattataattgcggaaatgatgcctaccgggcgcctggcgggggtgaagcagatcgggcgctccccctgttggcggatgttaaatgaccgattctatactgccaacatatgcataaagtttagataataaaacatccaacatagtgataggtgcttaatctcacatattccacaagtgttggtgtatagttgtatgcagatgataaaccctgaagttgggaggcaaatcggactaaagtgaggaaaattatgtatccatacaaggaggggttgtgaacttcatcgaaacatccgtaattcaacccaaaactccgagaaatggatggaggaaggtctagggagtctaccgaccgaaggccaggccagatgggcctggttcggccgaaccaccacttccaccgttggatgtggggtttggcgtggacgtcccagatgcatccctgatgacggttggagggcacttcggacatttccccttcgccaaccatcatacctacctctatataaaggcttcacttcctcatttcatacacacacttccaagcttgagctgaattataagaggctttattgtactatattgtatactagaataggaagagagtagaatagaaggagtcggaagaattccggagttgtcggtaatcttctcctatttcttttattctgtttattactctgaattcaatataatattcttcttgagtaatttagatttatcttgtgagaattatctcttggttagttcctaaatagcatacagaattattgttcgctataatcaactaaaatatagtgattgctttggtgagttataaacactaaattaaatattaattgcttaaacgtggtgattaggtaattattatccagtaattgctacgtatcccacagtacgtttgaggtgggtgtagaggtggtgacagccctcgagatcacttaagtcctccctgtccggatatgtagtagagcaacatctgagaacagcgggttgccagtgcctgaagtattgtgttaggattaaagttaagctttccctagacactgtttcttacttgtaaatcctctctatcctggtctatcctttgcttggtgtccttggatgaatcggaggaagatctgatcacacacgttcccttggattcgatacccttgaaatactccgtaggggaagtgctacatcggtatatccgtacgcttgcggattttatttgtgaccgtattaaataccaaccccctccccccgcgcgcccggccaccacgagcgtgatgcaggtgcctggccccaccacgttctctgcccccacctaccatgtgtctccatcacatactccattgcaacaaataacccatattttttgaaaaccctctattaaggaaattcgtttcattttttgtttcactaaaaatatttcacctagtatactcataatgtttcactatatatagatctatatatagatctaatgtagtagtgaatgatccttttaaaacaaatccctagtagaaaaagccggacaggtcatcgaaccatctggacgtctgggtcacaggtcgagcggttggaccaccgggtcaaccagttcaagtgcaagtgaaaaaccattatttactccatgtattcctttcaaatactatatatgtgttgctctattggctagcaaagtgtgcgatctccccagagacccacgttcgaatcccgggccacaaattactggtttgaaacattgttttatataaggtgaaacaacactcgattggtgtttaaacgattgaacattgttttatataaggtgtttaaacgattgaacattgtttgattgaacattgttttatataaggtgtttaaacgattgaacattgttttatataaggtgaaacaacacccgatttaaacgattgaaacattacgattgaaacattttcgatctacttactgaaacaattccgatatacttggtggagcatcgtgcaacatttttaaaaaaatcaataataagctaaaagaaattttcgtaatgtttcgatctacttagtgaaacaattccgatataattggtggagcatcatgcaacattttaaaaaaaaatcaataataagctaaaagaaattttcgtcccgatttaaacgattgaaacattacgattaaaacattttcgatctacttaatgaaacaattccgatatacttggtggagtatagtgcaacatttttaaaaaaatcaataataagctaaaagaaattttcgtcggaatatatccatgtgtggtcctttttttaagatttaattgcaacgaatttaatggtataatcggatcataatttggataaataatttaagagaaaaattagtttaaagtagttttgcacatatacatggcgctaacatcatgtcccagaggcccagaacctggcgaatcttaaaacgaagaaatattaaagtgtgtgatagtgtagcagccgacggcgatggttcctcctgcgagaccaatctcggtattgatccttctcgaacatgttttctttaaaagacatttaaggacatgtttgtagcagcttgtgattgtaggagtagtagtatcttcatcatttagggaaagtgtttttcatcctatcgagcaaataccccctcgttttttacatgttatctaattcttcataattttcttataaaactaaacaagatagattaatattaaatatatcactacacaaatatgcaaattcaaatttaacttcaacaggttataacaaaaataacacatataattgtaaatatatgttaattattttcatttttatttgttttttttaacttgtagaggtgaaatttaggtttgcatgtttgtggagtaatatactttaaagtaaatttcacaatactacatatatcacaaaactacatatttacgaaagtgtatcacaaaactagagatttaaaattatattttccacaaaaactacatatttaaaatatgatatcagaaaactacatatttaacatcaatttcatcacaaaactacaacttttataacctcaatatggcaatgaatggcaatgaatataatatttgataacttcgttactaaatctgtagttttgtgatatatatttttaaatctatagttttgtgatagtttggtcagagtatatgtagttttgtgaaatttactctatattttatattaatctatgttgtcaatattttcctaaaaaaattatgactatttaggtggtatgcaagaatgagagaatgtctccttgagggatggaaagccatctccctgtcatatatgattctcaccatctatttcatatatgcaggtaattttcagggcaacgcactggctccggttttgggcacagttacaaaggtgtgaggatgatggggagtcctaaaggttgcatgccgcaagttggagtcgatggttatgcaactatttgccaattatagatggaggttcacaaatagacttcaataaatgtgttctccttattttggcttggtttcttctgtttttgtttggtgtatcctatttagctaaactacgctcttttctggattgctacaatgtaataattggctgtagctctttttgagcaaaggctgggatgataaattccattatctaaaaaaaatatatgattctcaggaatttaactttgtgtcactaaaaagaggtgattttctgaggagaatttaacttttttttcgaggggaaaggaaggagccctgccaattgcaattaaggaaaatttatctatcttttgattaattttgagcatcatctctgcagatgaacaagataggattttaatggtgttgtcgagggcttggtatctccggcatgatatagtgcagtgccgcggtggagagggatctggtggagaagggggcggcggcggaggggtggcggtggagcttgaagcgcctggcacagcagtggtctgcgtggggcggcggagggaacaacagcgctcggcggagacaggtggtggcggtggcacagagacggtcgaggagagatcgggggcgacgcggaggaggactagagggagttgcgaggaatggtggcgcatagttggtcatcgaggcggagatcgtgggcggctgtcggtcatcgaggcagagatcgtgggtggcgcggacggcatggaggagggcgaggggagcggcgaaagatgggaggggatcaacgaggcgggcgtcggtgtcctggggacgtggttcgatgggggagtcacctccctggcggtggcggcagctgagagggtagaggagaacggcggcggtggagaatcgggtgtggagcggaagggtcgggagcggtggaggatgaggtgaggactgaggagggaggagcagcgcggtggggaggggcgatccaatcttgtgtcaggttggagtcaccgtcattgattggagagggcggcggcgatcatgggtctggagaggaggccggcgggcgtggctggtgaggaggcaacgcggcggcggggtgaggaggcgacgcagggaggagagcgaaagacgcggtgtggaggaaggaggagtgggcgttgggaggagatctatccgtgacgtgatggttgagattacgcgtgtttgtcagatgcgtctgctgtgtcaggaatcaagatcaccactacggattttttaagcactagagatataaaacggtattaggagtctagtagtagctacgatcatgaaccagcaacgcgtccatcatttcgtatacttcctccgtttctaaatatttgacgcctcttgcttttttaaatatgttggaccgttcgtcttattaaaaaaagtaattattaattcttttttatcattgttaaatatacttatatgtatacatatagttttacatatttcacaaaaatgtttttaataagatgaacggtcaaacatgtgctaaaaagtcaacgatgttaataaatatttaaaaatggagggagtacaatttttcacgtgcctaccgacaaccatatatatagcgcgtgcgcacagactgcacgtactagacaatcaagcaaccatatatatgcaacaagtaattatacggtgcagcacctaagaggcattggccggagaggaggaagacgtacgacatcagcaaagatcaagaggaagatgcactactacaaagaagagccaaatcggttttcctatgcggttggccagcccgtatgggaggaaaggtctgcgaaaatcgctattttcccatgtggctagagcacccgccatgcgaaaatgtgatttttgcatgcggttccctgagccaaccgcatgcaaagatatttttggcaaaaaaaaaataaaaatccaaaaaaaggcgaaaccctagccggtcgccggccgccgcccacgctggatccgcgccaccgcggccggccgccggacgagccagatccacgccattgcagggcccgacaccagatccgccgccgccaccgctttgccgctcccgagccagccatcgccgctctcgccgtcgctcgcctcggctggatccacaagtcccggcctctcccgagcgagccgccaccgctctcgccgttgccgtcgccgtcgacgtcggcgtggtcaaccgcggtggcgagggaggaggcgtggacgcccgcggcagcgagggcagaggagagttcgcccgcagcgtcgtctgcggcggcgaggtcgttccggcagttagggaggatgtgtggacgcccgcgacagcgtccgctcccgctcccggaggccgtggcggtggcgggcgcccgctcccagcgcctcgtcatcagccgtgcctcccgctgcccggcgctgcctgcatgcgcgagagaaagagagagggagaggttgaggagagaatgagagagagatagagttgaaggaagagaggggaaaatattcgtggtgggagagaagagaggagaagattgaaaaattttaaggtggcgagtagggaaaaaaccactaaatgaatttcgaataaaattttatgatagtaaatgaactcatatgaaaaagttaccaaaaacaaagttgtagaactcgttgagatctaccaattttattttggtcatttctccatccgagtttgattgaactatataaaatttgagatttaaaaatataagcaattcaaataattttttgggtagtaaatgatttcaaatggaaaagttgtcaacaacaaagttgtataacttatcaagatctataacttttgttgtttttatttttctatatgactttgtttgaacaatctgaattataatttcaaattatgacaacttcaaacaatatttttaaatactaaatgatttcaactgaaaaagtcatcaataacaaagttgtataactcatcaatatatataacttctattttggtcatttcttcatcccacaaagtgatttgtaaaattgttcacaaaatgtacatatctntaatatagttttataaactgtaaattttgtgaaaatgttactatcactttgttggatgaagaaatgaccaaaatagaagttataaatcttgatgagttatactttttcagctgaaatcatttactgcttcataatattatttgaagttttaaaattcaaatttttaattgataaaacaaagtcacaacaagaaatggccaaaataataacagtaaaaacacaataatgtgatagagcatgattttagaaacatttatgaaaaaagaatcatccaatttagagttcatatgagtaagatacactagttttaaatttttccaaattttattttcgtatacagctccttaagacgcccgtatgtaaaaatcgatttttccatgcgggtgcttaagtgagccgcatgcaaaaatgaggtcatttttacatgcggacctcttaagagtcccgtatgagaaaatcgatttttccgtacgggcgcattaaggagccgtctgtgaaaataccgctcgatttttacagacgtcactagtcatggtccgtttataaaaattatagggtctcgtatagaaaaatcacttttgtagtagtgatggcagttcagctaagaagcacgatgatatacaatggagtttctagaattatagtggattcactttgtttgcatcgttcacatactatgctctattgactattatcatacacaaaggagaaatagagaatgtcaacccacgttacaaattgggtagtatattagtaatttactatgctttacatataaaacagcactagtagtagctacgatcgatcgagaaccagcaacgcgcccatcgttttgtatagtctgatgcacaaattttcacgtggccagcaacgaccatatatatagcgcgtgggcacagactgcatgtacgaggcactcaagcgaccatatgcgatcgaagatcgaggaaagaggcattgaccggagaggaggaagacgagagcaataaagatcaagaggaagacgatggcagtagcatccttgccaccttcctccaatggaagaatggtagagccggccgggacgatggtgcagtggtgggaagaatggcagctgcgcgtgctcgttctcaccagcctcttcctccagtgcttcctcttcttctcggccaccttccgcaagcaccggatcccggcgatcctcagggcatccatctggctggcctacctcggcagcgacgccgtggcgatctacggcctcgccgccatcttcagccgacacgggaagaacgccggcgacgacggcggccgcggggaatcttccatgctggaggtgctgtgggcgcccgtcttcctgatccacctcgccggggcgcaggacagcataaccgcgtacgacgccgccgaggacaacgcgctgtgggcgcggcgcgcggtggccatgtcgtcccaggccgcggtggccgtctacgtgttctgcaggtcatggtccggcgggaaggtgccggcgcgctgcccggtggcgctgttcgtcaccgggttcctcaagatgggtctcatgctctgggctctgcggcgagccagcgctacgaggatagcaaccgtcggccggaaggcggcggcggtagaggccaactggtcgttagagagatacctgcagtgggcgagtaaatccgccatcgaagccaccaggaacattcagacgaacgacgacggcgacggcggcggcggcgagaatcgttcggcggctcgccgccatcgtagcgccaccagtgagctgcagctggacctcatagatctcgagtatcagaacgacctcatggagctcttcattgatttcccaaatacctacactagccggcttagctacctctcgttgttcttgaagctcgaaccctacgatgcatactgccggctttgcgacctcgtggattatgcgttccagatcttctacaccagcagaaacgccgcctaccccttcgccatctggttcgtattcctgcggttcatctttttcatgctggcctccacggccatcggaggctttgacgggcttgacagcaacatagacgggctcgacgccaacgatgtcaaggtaacctacatccttctatactctgaattcgtagtggaattcagtaacatgatttcgctgcgctaccataagtggccggtgtgcaagctagaaccacaaataaagcacactatcgcgcagttcagcctcatcggctgcgcttcccacagccgatggccaagggaaatggattctaatctctcgagaagatatcctctcattcatacgtgtcaaacagtgttgagtagagtagccatgtttttgagatgcaacaaccagcactactggtatcatgttgagcatagttcgtcgactgaaaaagccgtagatctcatccgcgaggacctgagatctgggtgggtggaggatgatctgcgcagcgccgccgcctaccggagattcaatgaccggcgaggccagtggactctccggcgggagcagtgctacggagagatgggatggagcgtggccaagctaccgttcgacgaggctgtcctcatctggcacatcgccacggacatatgcctccattgcacggaagacatcgacatctcatcgtcaccggctgccagcgccgacgaggtcaccgccgtgatggagatatccaactacatgatgtacctgctggcgtaccagccagacatgctgatgctcggcaccagacaaagcctgttcatggcggcccaccatgagatcgtgcacgccttgagacaccaggggcggcatcagcaacagcccagcgagagagaccttgcgcgatgcctcgccggcggcgacgacgacgagtactccaccccggccacggaggagcaagccggagctggcagcaggcttctcgagaggagaggaggaggaggccgccatctagcgcacgcacggcggctcgccggcgcgatgatgaagctggatgccggcaagaggctgagggtgatcggcggggtgtgggtggagatgatatgctactccgcgagcagatgcagcgggtctctacacttgaagagcttgggtgtcagcggccaggagttcctcaccgtcgtttggctcctgcttcaccggatgggcatggaggtgttggccgacaagctccacagaccagagctcgccggagacgatccggatgctgttggtgtgtaacctaccgtacctgttcttggccatgttcttaatcatttgcaggaacagcttttctcagtacggatgatgcaacaattgctgacactatcaaaacaagaaacttagatttggagccaggccattggagtgtgaagcctacatggagccaaatttgcacaagagttccagaaagtcttttgcaggtcaattggatatttggattccgagaggagataaataaattagcagacagactagcagaagaagcaaaatctaatcgaccctcttccactgtttatgtctgtcaaagcatttctcacctggcttatcccaatacaggatgtcatgcaaataacattagagacaatttcaacctcacgaactttgtaattcagcatgttctatgcttttgagtggtaataaagtgtttaagttcaaaaaaaaaaaaaacgtacctgggccccgtgggtatacacccgggagatgggttctaatctcctgttgttacgtccacccgtttctctcgtatactaactaaactagctgggtggcccgcacaattgcgtggctagcaaccaaacaatatttttcagtatgattttacttaaaatttattaaatagttatctcattgtattaagactttgaaagaccaaacattatcatccccgtatttctaattatataatttttaaaagtcacaccagctgctaccccttacttcaatcatatccttttttacttgcttactcgatctaccactatttttattcattctctttgaaacctttaaaaattggatcttagtttttagaggttattgtctcactgggtttcgtttttataatttctaaagtcccgccaaacgctgtcattatacttctctacggcctgtccactgtcttttctctttattattattgggattttaaaaatcgaacataactatcatttgagttcattttttattttctaaaagtcccaccaaactttcagcggctttgccattgtactcctttatggctcgcctgttgtctcccttttttattgtcattgagattttaaaattgaacatgattatcattagttttttttttactttttagaagttctgaaccttaattggaccttgtagtttttagagtttattgtcttgttaggttttaacttttagaagtcccgtcaaacgatgccagtatactcctctatggcccatccgctacctactctttattgtcattgggattccacaaatcgaacataactatagttggaattcatttttttattttctagaggtcccgctaaccatcggctgctctgcaactatactcttatacatcccgcccgctgcttctcctttttattgttattgagattttaaaaaccgaataagattataatggggtttatttttttactttctagaagtcccggcaatcgccttgctcgtttacttcacggcctgcctgtcgtccctccttttaatcgtcattaggattctatttggtgttttattaacaatttttatatgtagtatcaaccgctaccactctatttctttataggcatgttacttaatttatctcgttatgtgttttagatggtcttttctttcaatagtctttattttttatcaccaattttagttatttataaatttattcctaattaaaatattttttctttttataatttcagaatttatttttaaaaaatcttttttcttttaatatttttatatttttatttttgaatttcaggtgtttcaaaattatattcctactttgaactctcttttagttttctaattttggatattattttattttttattctgaattttaattaatcttgtattgggttcttatatggattcttctttcaatatttcttatttttaattccgaatttcagttaattttaaactgtttcctacttgaactcttcttttcttttttgctgatttcagattttatttttatttttattccgaatattaattaatctcgtattgggtttttatacggattcttctctcaatattctttatttttaatttcgaatttcagttgttttaaattgtattcctagttggactctcctattcttttctaatttcagattttattttatttttattctagattttgattaatctcgtattaggttcttatacggactcttctttccatattgcttatttttaatttcgaatttcagctatttttaaactgtatttctatttggactctccttttctttttctccgattaatgtgggaatttctagcccccacagcgaacgtggtgcctcctttcaaagctgttttaataatataatagataattatgaaaaaaattaaaaaaataacaagatagattaatatgtaatatatcactctacaaatatacaaattcaaattcgacatctacaggttgtaacaaaataacatattaaactctagctatatatatatatatatatatatatatatatatatatatatatatatatatatatatatatatatatatataactactatatggcgctacaggcaccacgtattagatggcgcctgacacaatcaacccccctccccacgcccacacattcaatttaaatagaccacgtagttaatttttaactcaacgacccaccaccccgccacccccacacgaactcgatctggtgcaagctacacagttaactgttaactcaaccacccaccccacacgcaagttaaattttaactctgcgacccacaacccaacccgtcccccacgcgcactcgatctggtgcataccacacagttaaattttaactcagctacccaccccacgcgcactcgatctgatgcataccacactgttaaattttaactcgacatactgactctatctggtgtgtgtgtgtgtgtatatatatatatattacggattcccatcatagaaaccgtccacccactctttctcttcctctccacattttacggatcagcgatgacttgtgattccttgtgcagagaggaggaacggcgacggcgattaggggatgaggagtggcagcgaggtggttccggtgatggcttggtgacgaggaggagcagcggtggtggttgggggatgagaggagtgacgaggaggaggagcggcggatccagtggtgccggggtgcgaggacgggcgcgatgttggcatgtgcggcgtcgacgggtgactgtgggcgggaggcgatgcggcggcggatttggccaccactctgcgccccatgcgcgcggatccggctacggcggcacggatccggcgcggttgtgggctgcgcgtccacagatccagcgcccccttcctcccgtgtggacctgcaagggtgaagactatgggcaagaggcgagacggcagcgaccattgcggcggtgagcttgtcctccggcatccatggagcagtggcgggcatccatggagacggaggcaccgagcatgcctctctccgagttttccattttcatcttcttcaccggtggaagaagcggccaccgcccgttgtttccgttctcaatatggaaaccaccaagagccacctttttcattcgacggatccagaaggagaagaaagctgccaggatcaacaacaccatcaatcaattatttttcctgattttagttggacgttgtcctgttatttgatctctccgatgtgttattgcattatttgtgtgtaattagtttctaatacatgtgattcctatatgattagatgcatccggacatcttgcaaaaaataaaaatgcaatctccatatcagtatattgacaattaaaaaattactatatgtaatgtttggagtaaaatatttactatatgtaatttgtcggtaaaagtaactaaatgatgtacgagaattgaatctgaccatacctaaaagaaacagaaattccattccctgtggagagaaaactaaatttaggtgtacaagcattattttcggatctaggactctgttcattatccacaacaacaggatgtatcgcatgaaaaaaaatccgcttattccggggcctcctctaaaagcttatcaaattaacgccaaatcaatgcacgctaggatttcgtagtttctggaccggcggatccggcgacatggagttgatttctatccggtgaattaattatcagttaatttccatcgacgtaattttctggggagatgtgcatcaaaacaataaaattctaataataaagtttgtattacgtcacacatcgccaccaccgcctaatgtctcaaagtttttcatctactcataccagtttacgataaattaaaatttaactcgcattccttgtcatgagaaacaacacacatccataaaaaaaagaatctacaaaatagttatttttcatcagcgatcatcgtctaccagtaaatttttaatttttaactacataaccaccaacccgtaatttaagttaatggcgactcattcatatagctgaaacataggtaaaattttaactcgacaacgaaatcactgcagcgcatcactcaacatagtattagttaaaatttaacttcgcattcagctttgtttggtccggtgggcgagggttcgttgcttcacgttgcgcaacgtttttcacaagttatttttttaactccacagtctgttggtttggtttggtgggcagtcttttctcgttgtgagtggcgtcatatatttccatggcacgcagcgcttgtgtgtggcgctacgtagcaatatatatatatatatatatatatatatatatatatatatatatatatatataggtaaattaactggtgctacatggaggggctccaataaaatccaccgtatacgtgctttgagatccgtgctactcaaatcagagtattatagacatactaacgggttaaacccgattagacctcttcatgcatggcgtgattgcctttccataatactctggccgtgtttccatataagatctttgcatgcatgcactaatttcctttccatataagcaaacatgtatgcaataatttccttttgattgcatggtaatttatttctatatgactgagtactttccttttagcacctgctcacaccgtttctctatcatgttgaattgatttatttctatgtatatggttttcactttccatttttctatgtatataagaccagctgatggtttgttgccggcctcgtgcttcattgttacctacgccgttatgccgctggtcgtcgactcgtccgcgaggttcgtcgccgttcatccgtgaggctcgtcgtctccaagttgtgtcggttcgatcgacagcacctattgcaggtatatatatatccagcggccaatcacagtgacgagtagcctgcattgcatgcatgttttagagcactaggtagatctggattagtatatgagaaaatatgttattatagcaggcaataatagtacatgtattttcactttgcaggatgctggggctccataatataatgcgtgtgtgcatggagaattggagaattgcagatgaatgaccatgatcgataatcacgatgatgctcttccatctatcaattttatttttttgtgtgtatatactcaatatgtgtactgtgtatatactcaatgtgagtatatactcactctgtataaatcatgatgttttcttgtactcaatatgcatgtgtgtgtgagtatactcaacgtgagcatatactcactcaaagtgtctgtatacatcgaatgttttactcaatatgcatgtgtatatactcatgcatgtgtgtgtatttagcatgcttgtgtatatactcattacatctgtataattaatatgcgtgtttatatactcaatatgtgtgtatgtcatctaattacatctggtcagctacctagctagagtagaaaaaaattaatataaggcctagctagtttcaaattcagttcaagaaaaaaaagtaagcttcttgaaatcaattattttcacggcatttaggtaggtatgtacccaacgagaagtaggtatttttccaagatatgcattttaaatgggtatatatatacacatcgtaatagtatgtgtgtttaaaacggtatatacccaaatatcttgtatatacagactttttttttacaataaataatagatttgtcaagtgtccagcatatattcaatcaatcgattaggcattatgtacatctatacctaagtttatatcactaactgaatacataatatatgacatatttgttcatgtcgatcttagacttccttcctttcatactcacagaaatggtatattggttcatgggatttttttccctttcatacccaatttttgagtatatgtcaagctgtgtatcttaaacatggaaagtgatccgcagtgcatattttgttactcaaatagctaaattaatggcgtcatgaatggaatgatttcgtacagctacattaccatataaatgtgctgcgatatatagtatccatgtttccaaatatatttccaattaattagcttccatgtttccaaatacttagtttccatttttcaccactatattaccatttattcaaacctcaccgtgcaatcatgtaagtttccatatttacaagatattatttccaatttcgcaggcatttaatgtttccatttttgaaatatacacgcaattatggaaattctctcatccacactgcatgcatgcatataaatgcattaattcctttttcaatctattcaaatatatgaaatccattcgctattaaatcctacactctaaacgggtctatacccattaagttcatacactcaaatgatcaaaccgatcagcaaaatatatatatatatatatatatatatatatatatatatatatatatatatatatatatatatatatatatatatatataatataaatattcgtatttttccggtcaacacatataatgtgcgtgagatttacacacatacaaaatgcgagtgggctagcaatagcgataaaaaaagtgcaaaaaaaaaaaaaagtggggggccgccgacgccaccagggagggagcctccgctaccggatccgtcaggggtggcggcgaccgcaggcggatccgacagcggcggctctacccgcggacgccgtcgatgccgccgctccccgccatcgccaccgcacctcgccgtcgcccgcgccgtgccggtgagacgggagggagagggggagagggagcagtccgccgtcaccgccgcacccgtcgtcgccgtcgacgctgccgtaaggacggccgtcgccgagggagcgtggacgccgatgatgccaccgcaccccgccgtcacccgcgtcgtgccagtgagacgggagggagagggggagagggagcagtccgccgtcgccgccgtcacccgtgccgtgccggtgagacggaagggagagggggagagggagcggcgccgccggaggggagaggagtggaagcggcgccggtggggagagggggaggggaagaggcgacgtagggagcgggggaggcggccgccggaggggagcgggaaaggcggcgtcgggggcgggggaggcggccggctcggctgtgggggaggggaagcggcggctgtggggtgaggggcagggggagaggcggctttaggggcgggggaggcggccggctcggctgggtggaggaggagggggagggggagggttagggttttcatcactttggaactaatctgagccgtccatcaaaacgaacggctcagatcgatcgagcgttgggccgccccacttgggccgaaagcggctcggcagtccaggaagattgaggaagagtatagggatccaaattagactttggtcgcggacgatggctgaagaagaaagtgggctgaaataggcctatagagataaaattatttttatttaaataaattctaaaatgatgtttgtattatcagaattagcaattaagctacgtaaattccaagaaaatttcaatgaatgtaattaataatatagaaaatttaataaaaaattaaatctaaccataacattttatttctcacacttactttacttataaattaatttaattatatatctaactacttaaaaaatacccaaatatttccaaccataacattttatttctcacacttactttacttataaattaatttaattatatacctacctacttaaaaaatacccaaatatttcaaaaaatttgtatttcatttaattagaatttaatatgttttaattcaattttatcttttttttctttccgttgcaacgctcgaccacttttgctataatttcaaagagtgtaattaatattgcagaaaatttatatttcattaaattagaatttaatatgttttaattcaattttcttgttttttctttcgtgatgcgagctaagcaggaatatttttatccatcttgattatcattagcgcaatgaataatttacctatcttagaacattattttatacatgttaatggtgtactttattgaatttaaccgttcctttacccgtagcgaagcacgggcattttgcgtgtgtgtgtatatatatgtatgtgtgtgtgtatatatatatatatatatatatatatatacacgcaaattaactggtgctatatggagtatgggctccaagattcaaattgagtatatactcaatttgaatgagtatgaaaattttttaaatgtttagatatgaacattaacttctttactaacaagttcaaacttgtttgaactgagtttaaactttttttttgttagattttggttctaggtatataatatccaaacatataatttattaggtatgtaataatgaattgtgaaataaagttgagtttaagttgttttgttgttaggtatttgtatgaatcaaattcatatacctaggtatatactcacaatttgaaaatttttaaaaatttgagagaatttgtgtgttttataccttagagcccgggcaccatgtgtgtgtatatatatatacatacatacatacatatacatatgtatgtattacacacacaatcaaaattgttatttttgttataaattttagaagttgaatttaaacttatatgtttgtggagtgatttattatatattaatctatcttatcaattttttgaattttttttataacaatttagttcacatgcaaaaaaacaggtggacgtccacccgactacttaaaagagtttcccaagaaacaaaaaggagaggcagcggatgggtcatacaggagtacaatggcaagccgccgatggttggtgggacttctagaaagtaaaaaatgaattccaacgatatttatgtttggtttttagaatcccaatgataataagggtaggcggcgggcgggtcgtagaatagtataatggtagcgtttgacgggatttctaaaaattataaaaaatgaaatcaaacgagatagtaaattataaaaactataaggtccaattttaagaggttagggcttctaaaaagtaaaaaaaaacaatgataaacatgtttgattttaaaatcttaatgacaataaaaaagggaagcagcgggcaaaccgtattggagtagagtgacttttgtcgctgacgttttggctgaacttctagaaagtaaaaaaaataaacttaaacgataattatgttcgatttttaaaatatcaatgacaataaagagaagagtcagtggatggaccgtagaggagtacaatggcagcatttgacgggacttctagaaaattataaaaacaaaacgtcaaaacccaatgggacaataaactctaaaaactataagacccaattttaaaaggtttcaaagaaaatgaataaaaagagtgatagatcgagcaagctaataaagaaggatatcacagaagtaacgggtagcaactggtgtaacttttaaaaattataaaattagaaacacgggaatgataaggtttggtctttcaaagtcttaatacaacgagataattatttattaaattttaagtaaaatcatacaaaaatatataattttgtataggtgctagccgcgcaattgcgcaggccatacaactagttatatattaatctatcttatcaattttttgattttttttctataacaaattagttcacatgaaaaaaacaggtggacgtccacctgactgcttaaaagagtttcctaggaaacgggtgttgtgtcaatatcctttctgatttaaatccaatgatgctgccactgcagttgaaccggatcatgcttgcgccaccaacagaatagatttgggaaactctattcatcccttaaaatggatgtcccctcattttttatgtcgcttaaaaaagtcactaaaaattttcataagatagatcaatatgtgatatattactttacaagcatgcatatttaaattcaacttatataagtaaaaacaaaaataaaaaatttggctatgaatagaacgtgtaatatatcatatattaatttatcttgattttttttaaaaaaatataactatttttaaaaatatcatgcattaaacgagaggatgtctgccgaacagtataacaatcggtcccaacccacattacctgtctgccaaacagcgaaataattgggatctaactactgggaaactattggagactagtaaccgtgcacgtgcaaggcacgtctttatttcccacattcactactcagaagtctaaacactgttatttgggaatatcaatttttaatgcaattttatataaaaaaaacttgttacacctaagaacttgaactgaatttaagcaaaataaagaggtttaatatggtaatttatgggaaaaaaataatgttcagtacttgaaacttttgtttaatttttcggaaacatttaaatgcaagcatcatcatacctcagttgcaaatgcattgccataatgcagatggtagctcaccaaaggatcaaggaaagtcgatatggtgagacaaatcaatcacaatatagggctcagaggcaccactatggaacacatgaaacaaaaataacaacgaccgtagtgattatatatgagcttgcacacataaaatgcatcatacctacaagaaacagagcttcataagatattttgcatggaactgcaagattcagaaatgcaagggtcatctatagaaaaatatcaaaaaagaattccttacaaactcaaatatgtacattcccttgcaatatcacattttcatgcgatcttcaaaaaattctcaattgactggaatagtactacctggatcaacagaagccgttgctgccgttcggtaaaggagaatcaaattgatttttcaggagagattagagggtgaggacccaactacaatctgagtcattagatcaaataatggaagcaacgttcaatattcagtgcaaccagactgaatatatcaaaaatgttactccggaatgaatatgatctgtgagaataaaagaaattatgaggtactttgaaggtttgatgattctcatcaaccttttagaggatccatcaatttataatgaaggtttaccgcccaaaacatggaatatttcatagtctagaatctaattcaacaaaatatgaactatgtataaatttaattaccgagcagtggcatcataacaggtaattgcaacaactaaacataataattccattaaaatgatgaatatggcacgtaagtgcaacaactaaacataactactattctacaaagggtctataacaatgcatgctaacctctactgattaaacaaaagaatttaaccacaagcacccccattatttgcaacagagaatactggaataagtaggtgtgcatttgtacctcagattaagagcattgctgatctgctgatcttcactaaaatgaatttgtcacaaatcatattctttaaatacctctcaattgctgtcaacaacttaacatcagaattcagaagtaggttgtcttgaatacatatctgcacatattcatgatggaacagactggagttgcaaaataaaaaaatagagttttcattagaattggctatctaatagaaacgtaagataaaaacaatcatgcaatgcttgactttatattgttcagatatatctaggatgctttatatataccacattgcattcaagaaaaatggaagaagagatggtccatgaaaatgttacacttacacatatgatgtattgttcagtaactctctgtacggagcaaatgaaatgatccctgtttgtggaattattaaaaagttgaaatcgactactacctgaagaaacaatgcactggagtaaataaactgagttactttgatcttctaataagtacacggtgggtcacattgcagaatcagggttatgaaacacttacataaacttggaaacaaccttagtacgataaacatgaagaagatatcagtataatgaaaaacatatagaaatttggcatcataattcataaagatatgttgatggacataagcagctataacaaaattatatatgcttgctctccaaatccttgctggctgaaatatatttaggttgcatataattagccatcacgatgaatgtctggcctatcaagaatatattttgtgttgcatataatgggtgttcctaccaaaatatgcacaaggattaaaataacagatggaacaaattgtttgaaggcattttcacaaacacatggtaagcatgtcctggaactgatgctcacaagtacatgttctttgacgaagctgctgatgtggagcacgatctgcattgttatccatcacataaggaaaatcaggttgcagtggaggagcatgaaaacaggcggtagagacagagtgatgggtaatgggtacggcgaggcatgactgcacgctgggcagccacgcagcagcagtgctctaatcggccctccacgctcggagcgatgcccaaatcgaaccacccgatgagacatggcaagggaggcaaccaaggccctgcaagagaagcagaactatccatcattgtccgacaacggtggctctagtggcggcggaatcgcagatcagaagagttacctcacgatcggatacagtaggtgacgcgaccagggcaccgccgcagagagggtgaatcgattcggccgctactcgtgtccattgaagtcagtcgaggcagcggggaggaggaggaggagcgagcgaggaagacggccgcggcggtggggaagaagcaggacccggtggcggccccggcgaggacatggaggagcggcggcagcggggaggagctcctgcgaggatgcggggaggaggagcgagcaagcgaggagaagcgcagtcttcgcggccacgggtggaggagtagcgaaatcttcgcgcgtggaatcctcggctgtgaaatcgtgcggtggagaaaacttgcgcgcggatggactgttcagattaatccggatgatttggcctgtagcattggagggggcaactcctcctttttatattaagtatagattaaaaggatattggcgcctgatttttggaatgaggagattgatgggataatttatagtgtagagatgcttatattcctaaacaaaatttaaatgcttcaaatacttatattgttggacggagtagataggaatcttccatgatgattatgatttagtttacaatccacttcatcttctcatccatgtttacaacagagtggtaataaccatgttaggatgtaaatgctatgggacaattttgttttttccctcactttcatgttcaatattgattttacccctatcttttaggcttttcgtttttccccactttttttagccgaaaaatcttgttgcccatgttttggatggaggagttaacggtgttaactacctgtcaaaagaacatttatactttctctcatctctatttattaattgtgtttttgcccctaatttatgcatgactttggaaatttctttttgattttaaatttgatggaattttgatgaaatttcagcaacattttgacaggaattgaacaaaattttgataaaatttcaacaaaattttacacaagggaaaattggttccatgccatcgaaagttcttaagttttgtttaataccatcgaaagtttgtactgtactttaataccatccaaaatttactacgttacttagcccatgtttgtttcagtttaagattattataatctagattattaaatcagattactctaagctgaattataataagctaacataaaataagctacgagttgtttctttctctagattattagaggcatttaagggtagtgggtctttagccactcaataatctggaaaaagctcttctagaggaaattattgaattatagtaatctggcttatagattataataaataatttagcataataatctacttgtttgtttcagcttactcctaataatccagactataataattctaagctgaatcaaaccgggccttattttaccatcaccgtgaacttgagtggatctgtcgttaaacacgacattacttgcccttgtctcgggtccccgacgcattgccgcccagctccatcacatcctcctgccaccgcacctgtcggagccgccacagccatccactgcgcgaggaagggggttggcgcgggagagcacgacgttgaccgacgctgcgattcctggagggggccgggccggctgccggtcacctgccactaaagttgggcaaaacgccgacgacgacctgacggcgctcttggaggggggctgctacagggaagagcttgagctcgatatgatgtttcatttgacaaggaggagctctaacttgagagacaaattgggccaccggcggcgagattacgcggattgatgggatgaatggtgcttgagatcgagttgaaaatggtgggaactagctcaccgtccctgtcggccgtgctgctcccccgcgcgcgctcgtaacccactcgcggtgctctggtgctcgtgcagtcctctcctcacaatgtttctccggcctgtgttgccgctgctcttgttgctcccaatccccattgatgaagcgatatgcctatgtcggccaaagaagaaaaaattgggcgagatttagatgagtaaaggaagggcaatacagtcataatctgtttgttttccagccaaatattgaaaagaaaaaacaaactaacggaaataaacagttgtggtatagaaaggtaatggagaaaactttggatggtattaaagtgcaccacaaactttcgatggtatatatatataaactttcgatgcgtggaaccaattttcccaaaaaaaagaaaatagtgaggggcctagcaaatatatagagcccttttaaatcgtaggaatgaaaaaaacggaggaataagaaaaacatagggttctgataggaatgaagtgtaaaacagaggattgaaaaacacatgaaaaatatagaaataatcgtttgattggaccacaggaaaaaacacaggaatcggataggagagatagactcaaaggacttttaccaagaggttagacctcttgctaagtttcctccaaaacctatatgcaatatgccattccataggaattttgtaggatttggaaaacttcaatcctttgaatcaaagagatacataggaaaatttcctataggatttcaattctatgaaattcatttataattcctttgattcaaagggggccctaaggctatttttgtaggctttttttttcataagacccaaatataaaagttactagttatcgtgtacgtgcaaggcacgttttgatattatatacacaaaagtagaataataaatgcgagccttttttatgtagcactccatacaaattcttcacgtaaaaattgagttccatagaccatagtgggatgataatttgaatgatctctgaaaaacttgcaccgtctattcctagagtgacaatataacatgcaatgcaccatccacctttattaatagaaattccaaaaaagctccatatgagtgcccccgaggaacaaaaggatatctacacagattttatttcattggtaaaaaaaaagaaacaactctgaagtagaatcactatgctcactgtttctgtgagattgctagcatctccagctggtaaaaaaatgccaataggtagcatctcatttctcatttgtagaattgcatattagagagtaatattatagtccatggttagcaatcccatggcggtagatctcaaacagatcaaaaataatcggggaactttaatgactcacatgaggtagtcggtggtttatctatgaagagcatttttgggaatatatcacagataatgtatataatatctattgtaatacacataatgacaccaattattagtccatttgagtcagtaattaaaaaaaaggcataccttatcaattgtagccaacaattcacttcctgctctctcaacgcccctcctcttactattgagccacagagctgttgccaccagatcctcgacaagataaaataaaaggataatcccccaattcaaattcaataaattatccatgcaaggattagataaaaaatatataccatatactgctctgtatttggtatcagttggcatgaattttacaaattacacagtggcttgagacatctgtgcattaatagatagcaaacaaagcagaatactgaaagcattaaccctatacctcttatataccagggcaccacaccatagaaaagctcacattttagatctagctaaccaaccttctattatttaagataaaaatgaacgtatacgttcacatatatattctgggtacaggcgtacagggagcatcagtatcatgctaatcctaataaggatatggactcatactaagtaactgatgagtagctcaggccaccctaagttccccaagaagtaaggcttccattcttgttaaagccactgctgcatttcataaacaacttgtggctaattcaattgcataaggagatgaactccactatctatacaatggttttcctacagccacaaggacttcatatgtgttcttctcacattgcaatcgaaataacatttatatgatcacaggaggaaaaatacctgggaatgaaacttcagagagttctcgtcgacgaacaaaagaccatgcagatcgattactttactttagatctttgaataatcacgcacctttttgcgccactggacattttatatacataaacaaccttatttatgataaaccagttcaattatgaactaaattaatttttcaactccagtagacagtgagttacctcaaaaacatatgcttgtcttgagggctattatagcagaataagtaccataagtatgaactaaattaaaattttcaactttagtagacaatgagttacctcagaatatatgcttgtcttgagggctattatagttgaataagtaccatgaactgcaaaaaatactaaaactttgttcaaaaccaacaagtgcagccattgcaccatggagcccattctccaacgaaaggagagacaacagtgaataactaacctacagtggccataaaagatcatcaagtacaacctttgccaagatgtagaaatggtatactaatttattttatggaaaaaagaaacccaacatgtcttcaacatgtcttcctaggcactctgacattttgtctaaactgtgcatgtttctccatagctagctgtgggaggtccatatcttctctcataattcatgaaagtgcatatctgaagacatttgtttctttaatgctcaagcacatgtattcataggaacaactcacaacaattgagatatcagcttcattaacaattttttttatacaacacttgcctaaattgagacacaaagaagtacctgcaatacacaacattagctcaggaggcccttgtcctgattggctccctcttaattcctgaagcccatttgtggatgtcatgctatattcaaatttccagcacccatggaacttgctagatatttcactcaagaatccgcatggccacatcaagccccaaatgcattttcagatacaaaatatatgtcagtccatagggacagaactatagaggaaaaaataatttgtaaatttgcaaagtagaacctgatgccatgaagattccatcaacaatgtaattaacctacttataggaaatcaacctccaacatggatacaggaacatgtatccagcagcatcgcctttagtccagaggcattgcgagggatggtatgatgttgccattgcaccttgctatgagatcgccttctcctgcctaaaacctgagaccactgactagtggagcaagagaggatggatctaaaaaactaaatattgtttccattagcagactaacgaacggaagcttatcttcggcgaaaggggggaaccacctcggcggcggcggcttgcggcagcggtggagtgcggcggcggctggggatgacctcggctcaagcggggcagtggcggctggtgacgaccttgactccgacgggggaagcagcggctggtgatggcctcgactccggcgggggcagcggtgtagtgcggctgcggcggggacacgcgtggaggcgtggagcgaggaggagcgagtaagtggtccacggaatcatctcgcgggacggagtaaacacgcggtggagggagtgcaggcagaaatcgcggtggagggaggggaatcggtgggcggtagcaggtagtgacggttgtgatgcgtgcgacgtggatggacggtagggattgatagatgtgatttggcctgtaggattgaagggatacaactcttcctttttatattagtatagatatagataactaatttgatgtttataagtatagtagggttgaagcataaataatcaagggctgaaatataaaagccacttgagtgttgcctgcattttggcaggaagaggctcctctgatgtacttccctctgacatcgatcgcagatatatgagcccatgagctatggggcccacctgtcatcaaattcagatgccagtaagctagaggctctatttctattgtggaggtagtattgtcatatgggtgcatttgggagtactctttctaactcctactatattgttttctgcgaatacgctttccaaactgttaaatagtactccctccgtcccccaatataaggggttttaacatttttcttgcattgtttgaccgttcgtctcactaaaatttttttcgaattattatttattttattgtgacttactttattatcaaaagtactttaagcacatcttttcgttttttatatttgcataaatttttttgaataagataagtggtcaaacagtaccagcaaaatatcaaatcccttgtattagggaacggagtgagtatattttttgcaaaaaaaaagttctatagaaaagtttctttaaaatcatgttgatctatttttatttttttaatacttaattaattttgtgctaatgaggtacctgttgatgtgaaaacacgagacctgggagatctgcctaactccagtgcaggtccaaaactcgccttcgggtatgctagcgtgccagttgatttgatcctgcaatcaacaagaacaaagacaaagaaaccgcggttaaatccataaacgatagccgatcggctaggtgctgataacatatcatttatctttgagccgatgtcatatatgcatcgatcggcaggcattaataaataaaacagaactaaatctactcgatcggctatagatattaatgatatataatccttatatcgatatatacttaatcaagtgattgcgatagatcgtcgccatgccgagacagtataaatcacttcaatcgaaatatatattaacaatgagattatttatattcgtagcatagccgatcagatagatctagcatgtatcggctaatactccgatacagctctatactaagatatcaaagcaaatagaatatatcaaacaaaagcctaatatacttaaatgcaacaagatcttaacataaagaacagattcaacatatcaacgaagcataaaggacaaaaagtagttaaatcaggtaagatcggctgaaaccccgatactaccctaatcggcaaccaagaagcaggctagagattgagattctaatcacgactcataagatcaaactcaactgatgcaactataagtatgaaaagaagagcaatatctagacaatcaagccgttggaagtttcatagagtggtggatatcgtatataatctaagccaacgttgctatctaacctaatcgactgccttctactgacagatgttagccgattataggttaaatgtcaatattgttagagattatataagatatatgataactcgacgaattatataaacaagattagagtatcataatgatggaagcactaatcccgagaacgcaagccgccataataagttttacctcttgttgaagatcgaaaccgatgcagctcaacccgaaagcaagaactcgtcgaaacaaaacgaaagcaaaaagtgtggcgatgcaccgagattgtattgaacgtgtgttagtttgattacatggggctcggggtctatttatacccaagaattacaaaacatgtccatatcggacacggacacgattcttatctctaacaaactctaagataccataagtctttgcggcagacttttgcccaaatatatctataagaaaattacataaaatattctaattaatagatacaattgtcttctcatgactctatccatgcatggcaatcatcttaaagcatatcaactcaacccgatgacgtataccgagttgtattgtcggaatcggctatatcaactcacccagtccgactcggactcagccgatcttggtcgtagccaatttggactccagccgattcttactctgtttccgaaacgatcttcgtctttgattctgctccgatctaatcttcatcttcgatactgatattaccaaatttagtcgttaacagtactttatgtacttagagattagttttcaacacaagatgccaaacacagcatatggttcatccaatgtggtatttactttttttttcttgtggacacattctctaattaggactcttttgacgtgcctcatcacagcagaaaaagaagatgacaattagatcgaacgtaacttctctaaagcaaggtcagagaaacatgtgttccttataagtgagatccactgttatgtatttaagcgtcagtgacccacgtccctctcatgtctcacccaagacatgagccaacagctatacaggtaaaatagtggattatgggagacaacagtactaactagctatgtctgctttaagtatatactttctccgtttcacaatgtaaaactttttagcattgctaatattcatttagatgttaataaatttagacatatatatgtatagattcattaatatctatatgaacgtgggtaacgctagaaaatcttacattgtgaaacggaggaagtaattttttcgatgtagttagtgcaactcgagaatatttatgtaagaatagaattatgagttgtatgctaacaccttgtttagtaccaaacttttttaaaaaacttccacttttccatcacatcaaaactttcctacatacataaactttcaacttttccatcacatcgttctaatttcaaccaaactttcaattttggtgtgaactagacacagcctaaatctaatttacttctactctttgaaacggaaaagaaaaaaaaagagctataggagtaataataaagagagaaattaaaaaaaaacagagagaaaaagagagaaaggaagataagagaagaaaaaaaaaagagaaggggcaagtcttccccaagtcacaccatccccgtcccggatccggcgaccaccgattcctcgccgccgccgacgacgatgccggcgttcaaggcgccggcgccgggcttctccgtgcgcttcagcccgttccacgagcagcgcctcctcgcggccgcctcccagcacttcggattagtcggcaacggccacctcctcgtcctcgacctctccgccgccgccgccccggggggcgcgccggcgcccccgccggtgttcgccttcccgacctccgacgcgctgttcgactgcgcgtggtcggagtcccacgagtccctctgcgccgccgcctccggggacgggtccgtgcgcctgttcgacgtcgcgctgccgcccgcgcagaaccccgtccgcctcctccgggagcacgcgcgggaggtgcacggcctcgactggaaccccgtccgccgcgacgccttcctctccgcgtcctgggacgacacgctcaagctctggtccccggaccgcccggcctccgtgcgcaccttccgcggccacgagtactgcgtctacgccgccgcgtggtcggcgcgccacccggacgtcttcgcctccgcgtccggcgaccgcaccgcccgcgtctgggacgtgcgcgagccggcgcccacgctggtcatcccggcgcacgaccacgaggtgctctcgctcgactgggacaagtacgatccgtccatcctcgccaccggctccgtcgacaagtcgatccgcgtctgggacgtccgcgcgccgcgggcgccgctggcgcagctcgccgggcacgggtacgccgtcaagcgcgtcaagttctcgccgcaccggcagggcatgctcatgtcctgctcctacgacatgacggtgtgcatgtgggattaccgcaaggaggacgcgctgctcgcgaggtatggccaccacactgaattcgttgccgggatcgacatgagcgtgctcgtggaagggttgctcgcgagcaccgggtgggacgagatgatctatgtgtggccatttggctctgatcctagagcaatgtaaacaaaatgcctttggagaacacatatttcgtacgtcgagggatatggattatttctgttgcgttttgcattggtcatagtaatacatgtggattaactcctttgagttgaagaaattgcaataaagatcctattgctatctaaatcacctagttgttaagttcttcacttagactcaaagtgcataatgtattgctagtatataatgttggttgtagggcaaattagtgggggttctacaaccccgatagtgcataggactatgtagtgtaatctagggcatagggagatatgtgaagcacattaaaatctataatgtatacaattctgtttgcagctggtataaatcctcttagacttcttattgccctgcattaatagccttgtatgccttcttgagatagtggcaaaatctagtcgtatgtcaatcttccatcttgctattacagtttaaatagtgcgtgccattgtcaacatataaatggagttcatttactccttctgtaccacagtgtttgtccattttgttgggatgtacgtttgtaacgtttaacaatgttttgtctgctaataataaaaccaacactctagctatcacaacatatccactctggaacctaatttaatgcagtacaagagattagtaattgtgctgtgtggtttaatagaatgtatggtcaacaaatatataaccctattaaataactgtagtaaaagagattgaataattgtatgggtatacagtataaaagggttgaataattctcaaaagtttgacttgagacatgtccaacacaagatgtttttgttactagagggtgtaacatgagttgaataattgaacattgtgtatgtagaactatgcctggtatttgaacaatcaatgagatggttcagttagagtagatttgtcatgattgggatgtaaccatgtaaaatgttcgggtgctttgtatatactttaagcatgcatgtggtgacatgggtgtgtgagttgttgaacataatagtacaagatttgccagcttatctcaacataaatattgttggaataaaggaaagtacatttagcatagcacacaatgtctgtagcataagttgcttgatttagcattcttggccgagccagtttgttcctgctacatgactgttaagtaatacaaacattattgcgctgaatcctcttctgcaaatttctgacctcaatagatgatctcaactgtactgagtaatggtttgaattcgaaaggttaaattttacattatgtgtgttcatttttctacattatatgattgttcagctacttgtacgtggtaaattttataaatgttggtcaaaacattgaatttccaagaggtatcatctatgtggaaaattcttaccatctactccctccatctcatattataagtcgtttggcttttttcttagacaaagttctttaggtttgacgaagtttatagaaaaaatcagcaacatctataacaccaaattagtttcattaaatctaacattgaatatattttgatacaataattgttttgcattggaaatgtcactatatttttcaaacttgatcaaacttaaaaaagtctgattaagaaaaaagtcaaacgatttataatatgaaacaaaggagtatctagtatatgttcaataatcaatactcccttcgtcccataatagaagggactatgtcatttttggtataaattaaggaagtaataaaaaatacatttcatagtacaaaagtatcgatgggaggataaaatagtaaaaaaggtgatagatgggaggataaatagtagaagagttgataggtggggaataaagcagtgctgcctccgtcccaaaatatagggactttgggtagatgtgatacatcatagtacaatgaatctggacaggaagcctatccaggttcattgtattgtgatgtgtcacatccacttatattttggaacggagggagtacaagaatagataggtgggagaataaactagtacaagagttgataaatgggaaataaagtgttgtcttaggatcacaaaaatcccttatattgtgtgacaaactatagggcctaaatctcttgtattattggacggaggaagcactaggcatgtgatgtctcaactctattgtttgttctatttctcttctgatgatctcacaagtaatgagtgacaccactattttccttgacacaatagtaaaaaactctcagttattatcggccaaacaaattactactatttacttcataagatcaaaacagtgtagcatcaattctacaattgacaaacctgttgaagtcagaatatattatcttgtttcagttgctacgttttgagcatgatgcattcaaacctttttgctgtcattatacatattgaagtatttgctatgcgatgaaaaaaaagtgagtttaatataattttaagataccaattggtacttcgtacaaactaatgtcaaccagttaaaatgtttgctatagtttgcttggtatatgcattgttcagaggaatatgctgaatttggtttggtcaaactgaaggcatgggttgcagggatatcttggtaaaacaacatgcgttgttagcaaaaacatactacagtagggtaggttcacccagatttcgtttccttttattattgatatcaagataagctatctactggctgtgtatttgcaggactgatatcaatataaggataaagtaattgacctgttctaccagattttccttctgagcctactatgcctagatcgctcacgcagcaacttacccctttttttttccagtggaaattggactggcatgatagatacacataagaccagaacaacatcactaagaaatgacagaagaaattccaaattggcactgcatctatctgtttgtgttgcaattgtgcactcctatctatcgtgttgcaattgtatactcctatactcctatctatctcctggtctgcttgcgtccattctgatgttcgatatgtagatatgtatggagtagtggattgcaccacaggatgttattgttcaggattgctgcccagttattattgtttgttgatcagttattgcacaggtatgtatgcctgattgataagaactttatcagttattgcacaggaatgtatgcctgattgatggtaaaaactctagcttacatatatgccccttcaaatgaaattcctgtacttgataaaagaatctgctgagttctggcatctggagtagtggagcgtgctgacaagagatacctctctcgttgcaaacttgcaatcacggcaagaaggttaagatcatacatgaaacacgcaatttcagaattacatgaaacacgatggtggtgataaggtttcatgggaacgttctcaggctatacagacatgtgctagcaagaattatcagcacacacaagtcttacggctatgaagataccatcgaacgttgcatgtctgctaatgtaaaatgacaagtatgatcttcgcagtgccattattttacaggtgaagaccagaacatatacatcatcattacgcattacacattacacttgttttatccatcccactattcactcatacatgctgattcatcagcacaagagaccatcagacagatccataaatcaaccacctccttggtgctctcaccagttaccacatcgtcaaaacagaccagcaaatacttccatgaatcccaataacagaaacagaaggacaagatacagctcacgacaggctgggctgcagttgtaacaagaggagaaaactgcacttgttaaagaaaacaagatgcaacctggatcagtttagaaaacaagaagcaacagccacaatattcaagaggcaaaatatatttagatgatgacattcaatataacagatatagaatgctattagcgcttgagccttcctatgtaatataaagataattatcgatttccacattgtgttgtaaagataatatacatggcaacgttccatgtatacaccaaaattccgtcgcacagtgtttcctagcaacataccatgtcagtattttagaaccattgcctcctactgccttaacccgcagagcacctaaagaactaactaaagataaggtgaccggctacatcattggatcacagaatcctcctgtcacttttggggctgaaaacagcatctaaaaaaacacacacatgtcaaataacggatgtgtcggaaaaaattcaaaaattaacaagaaaactcactcctggcctcctgggctcctggccagagactactaggcaaaaatttgacctacagttgcatcagaccatcagtgatgttcaaaagagagaaatcatggtcaagtatgatgccttcatgccttactgtgctattcaaacatttgaacaaaaaaataccagaaatatacagaaaaacagctggtgagactatcaaaacttctctaaaagataatggtacaccatataaactggtctgttgtacacaaaaagaaattacaacctccccttcataatagtctaatgcacagaacatgtttcaatttgaatggagaaaaagtacagattcgccaacaatactttcaagtcctgtaagttcaatgctaatgttcgaaacaatatgtatttgtgggattagagtatgcaagctatgtggccctgtcgaatttatgaaagcatgaacaaagcagcgcaagcatcactcaaaactcttatttttctgaataataataatatatataatacatatagctctccatacaagaaaacaaaagcatatagaataacttgggttttcatgtcatgttctgcatccgcaacactcagaaccgcaaatgaaaaagaaaagctaaatagaaatagcatggaatggtacagtaccacttaacaaaaaacttaaatatgtgcaggtgaggaaacaaaaagcatagggtaacaccataactggaatgtcaacaccttgagaaaatacaaagtaactgacaaaatttggttagcatacaacattctgttctgcaagtcctcgtctaaaacttaaggcattagaccaatgaaggtagagaaaatacataattaagccttcaactaaaagcttttcctatttcataaaatattccagcagcagcgatctaatggataaccatgctattctgtcaaaggaagaattttaacatcaggagcatcatcaacaagtcaatatacttcctctgtttcataagtaagactttctagcattgcccacatttatatagatactaatgaatctagacatatatgtgtgcctagattcattagcatatatatgaatgtgggcaatgctagaaagtctcacttcatgaaaccggaggagtaactaacaatgtcagaggtatatatacaataaaacaatcatcatcttgaccagacctttataataagctcttgaagaccttcacccatgcagtacagaaaaatctacaataacatgcaagcattcaaatagtgaacatcttgtaagatgacaagtaggcagtgaactttcaagacaagcacatttcacaacagcgaaacagcagaagctaaaacatatattttaagtaacagatggccataaagagatatgtatgtctgacattcaaatagtgcaaataacagtgtttcaccacgtttaaacataacatgagaatacagaaattaataggcagcaaccaacaaaaatattctcctttatagctgcaagttcagttgcaagcaataacctgccagtgcactgagatacaagaaagctcatttctttctcccaccacgctccctcagtgttaaattgatcaccactccagggccaatgttgtagtaagcaagagtgagattgtctttgaggaaactagtccgcacgctcaacttctgcttattagcagnnnnnnnnnnnnnnnnnnnnnnnnnctcctttagactgccaactgtgtctgagagtgattggacaccgatctccaacacttggcctcgcaggtttccttcatcaaggttgggtacagacactgagatgtgagcagggccctgcagggaagagaagaaattagcacatggaaattcttaaaattcaatatacgcatacaaaaagaacaagactaacaagaatgtttagtagaaaacaggaaagtggagaagaaatatatcaagaagtattaccgggtgctgagcaaggaactgttctgctggtataagagaagcgtcatctgttctcagccttttaggttctggttcatcaggttgaggtggctgctcctcagcaggtggttgtggaggcaaaggtggtggaggctgaggaatcccaatggggttgaccatggttgccatggttggcatgtgtggcggtggaggcatggagtatggacgcggcgggccaggcatgtagggattttggcctggtggaggcggaggtatattggttggcataggacccattgaacctggcatcctaatcacctgcggctgacctggtattggcggtggtggaggcggatgcatggtaggcatcatatgtggaactccttgcatgagatgaggttgttggtgtgggggatatggcattgcactaggttgaaagcgtggaacattaaccagtggaagtggctgaggaggtctaagcaatggcatgggagggcggggaagtggagctggaccaggaacattcgaagcatcaacctgttcctcgccgcccatagacagagcctgtgtggcagtacgacctatgctaccagaatggccatcccaaataacctgctttggctgttcatcctttttcttctcaatttctgccttgacagcattagagacctcttcctctgttgttccaaagatgtctggcctggtacgggcaagacccacaatgttcctggagatttcatcatcaggagcaagtgttgtctccttaatttttgccaacatccgctctttctgctccttatattttggatcaataagcgagatgcgcatgtgctcctccatctcactaattggaatgagctccccagttattggtgagacaacgaatttcgttgggtccctctccgcagggattctctcctcaggcctcttgtagttcttgacaatcctcataggcggctcctcatcaccagcaagcttaacttgaactcctccttcattttcctcgagccttgctgcacgcattccttcctcaacaagttgaatctcctcctcgtccatctccatctcaacatccttcgctggctcggccaattccatggctgcctcctcctctcccaggtcctcaatcctcttccgacgcttcaactcctccagcgtaagtggcacagggagtccctcgcactcatcatctgcaaactcgatcgtctcgacaacaacaaaatcatgccaatcgatcatctgcatctgcatcctctcctgttcgatttcatcctcagcctgctgcctcgcttgctcctgcgaccggtcccactccaggcggttcaggcaccgctccaacacggtggtcaggtccttcgccccgtcttgtaggtccttcagtagggcaggcatgccttcgaccgggttcagcaccctcgaataggtgtcggtgagcttcgtgaagaaggtgaacatgctgtgcgtggggcggatgaagtggaactgcgggttggtgctctcgcgctgcgccaggctcgtcaggaagctcttcccgttgcgcgccacgaactgcgcggtcagcttgatgatgtccagctcctccccggtgatcccctcgggcagatgcaccgtgtagagctccgccttgggtggcaccagcaccttggtgggcggcggcacgcggaatggggcggagtggtccgccttcgccgcctcgccatcgacggtgggcgcggcagcggagtcggccggcggcggcgcggcgccggattcgtcgggctcgggggccgcgtcggcggcggaggcggcggcggaggggggagcggcagcgagctcggagacgcggtgctggtagtaggcgtggtaggggtcggagggctggaggaagttgaacttggcgttgccggcgttgtgggagatgatgcggcgctcgaactccgggccgttcttggagacgaaggtggccgtcttctcgatgatgacgcggatgtcggggggcgggtggatgatcccgagggggcgggtgtgggtggccaccgtcggcggcggctcgggcttcgcgcctccgccgggaggagggggaggcggctgttgcggatgggagtcgccgtcgccgtccggcgccgggagcggcaggatggcggcccccatggcggcggaggcgagggggattagggtttcgtcggcgtggggtggggtgggtttaggtttagatcggggaggatttgcgcgacggaatcgtgagctgctgtgacgcacgcgtctcgtctcgtctcagcgagaggcggtgagagactgaagagagaggaggagacaggtcggttctaagggccaaacgggccgcccggcctgttaaggcacggtaggcctttgccggcacgggcccgattgggggtcgtgggcctggtggcggcccgtcggcacgacgtggcccgccaaattttgagaaggaaaaatggaaggaatgaaagggaaattagagaaaaatgttgtggagtgcggcatgactagggctggatgaaaagctcgtgcctcgttagattgctcgactcgcgccaagctcggctcggctcgttttattttcctaacgagccgagctggccttttagctagggctttcaacgagccgagctcatctgcctaggctcgagctcgatacaagctcgatacaagctcgagccgagcctataaaatgttcgagctttttgacaggctcggctcgagctcgaccaagctcgagctcgactaccgagctagatttttaagtaaaataatatatatttcaaaaataatcttttaaaaataattaaaaaataattaatttctagttcatcatattaaaagaagaggaaaaaagaataaaataaatatatgatgtcaatataaggcatacaaataacatatttgatctcctaatttattaaataacaataaaaatcatatattattatgctcgttggaagctcgagctcggctcgacaaagctcgcgagcttagggagaggctcgggctcggctcgtttggagctcgagccgagctcgaatcgagtctaggacgagccaagctcgagcagctcgcgagcctcgagcttttttgacagccctacttttagctcgttagagataacgaactagctcaagctggctcgcgagccttaacgagctgaggtagctagcccatgccgttgtggacttgtgggccatatgtgcttgaaggcccatatatgcatcaaaactctagctctattccccatccccaatcccacacgagccgccgcaagccctcaacgcccggtcgctcgcgcggctctcccccaggtcccaacgcctaacgccaccgcatacgccgccgcccacaccgctgcgtcgcgccgctcttccccatcgccggcgcggccgtggacgccgccgcccgcgccgctattcccggtcgccgacgcggccgctcttccccaacgtcgccgtaaccatggacatcaccgcccgcgccgctcttccctggcgccgaagtgaccgtggacgccgccgtccgcgccgctcttcctcggcgcctctcctctccttgttcgctgcccaaagctcacgagctaaacgagctggctcgagcttgcaaacgagccgagccgagcttggtttctagctcgttaggataatgagccgagccgagctagctcgttatcctaataagcgagaccaagccgagccgagccagcttgacatccacccttaagcatgactgcgtgagcatggaactttattgaccatggctacctaggtttgctaattcacggatatccacgcgtccccccccccccgcggcgtagccacgtggcgcgtgcgaaggaggggtggtggcaggagcacgagggagggtcatatgcgtgagttttctctatttttttttctttcagttttattttttttgggttttttttggttttttcttgatttcttccccgtttttgatatgtatatataaaaagtttgtatatgtgaatatacatatagaaagtttgtatacatacttttgtatatgtacgtatataaactttgtatacgtggtgtttcttttttgttttttcccttggttttttgggtttttaaatatgtatgtacgataaagttttatacgtgtatacaatttttttatacatcaaagtgtatgcgtataaaattatatatgtatatatatctatacgtataactttgtatcgtgtaatacaaaattatatgtatgcatatagaggatatacatatacttatactgcagaggagagaggactggagggcacggaactgaccacgcaggtgcggccctgcgcggctgattgcggatcagccagcccctcatcctcatgactacctagcttaaaccatactccctccgtcctaaaaaaaaaaataaaccatgggtttccgtgtccaactttgactgtccgtcttatatgaaatttttttataattcgtattttcattgttgttagatgataaaacataattaatattttatgcgtgacttgtctttttaatttttttcatattttttttcaaataagacggacggtcaaatgttggacacgaaaaccaggatttgtcttttttaggacggagggagtaataacgagaaagtagcagagagccagagactacatacgaaatactccttccgtttcatcatattatgagtcgttttgacttttttatgagtttgtagagaaattagcaacatctacaatacctaataaatttcattcaaactaatatttcatattttttttataatccgttgatgtgaaaaacacacactggcctgagagatttgctttaatctagtgcaggtccaaaaaaacttgccttcgggttctgagcgtgccaattagtttaatcctgcaaccaacaagaaacaaaaaagaacaaagttaaatctataaacgatagccgatcggctagattgccgttgacgtatcaatatcagaccgatatggtaaagatcatatcggcaatggaagtatgtagcacaagaatacataggcccgcctgatcggctgtagatattaataaacatataatcggcccctcagaatacatttaaactaagtgatttggatagatcggacagtacgccaagacagtataaatcacttatgtctaaaagtactctgaaatacattcataccatagccgatgaagcaaacctagggcgtatcagctagtactccgataccactctatatcaagatatcgcagtagatgaaacatattgaacgagaaccgatctaacattaggatggcctaacagattgatagcaagataaatatatttcaaacaaacgatatcttagtatagagggtagacttagcatatcaagcaaacgcgagagcgacaagataactaagccagataagattggctgaaacctcgatgctatctctattagcagctatagacgggctagatattgcaattctaaacattactcaacagatcaaactcaactaatccagtattaagtcatgaagagaagtacaagatctaaacaagtcgacagaagcttttctgagatggtagatacgctatataacctaattcaacgtcggtaactaaccttgccggctgttttcgatgatagaggatagccaatggggttggataacgatattgatctaggttatatagcatatgtgataacttggcgattgacataggcaggattaaagtgtcatgatgatgtaagcactaatcccgagaacacaaaccgccataaccagccttacctcttcgtcggagatcgaaaccgatgcagcccaactcgaaagcaagaactcgtcaaaaacaatgaaagtggaaaaagggtggcgatgcaccgaaagtattattgaactagtgttgttttttctacaaggcctcgggctatatttataccgaaatacataatatgtccttgttggacacgactctatctctattacaatttaaaacacgaacaagtcccttgggtggactcttaccaaaaatatctctaaggaaattaataaaacatcctaattaatagatacaatcgccttttctagaccctaatccttgtgtggcaatgcccatgtagtgccttgattgatcccgacaataattgtagaaccatctgttcgagattggctgcatcggcttgtctttgtctgattcagtatcagccgatacatacagcagccgatgtcgtccgtagccgatgcgcactcttctttccaaaaccaaaattcctccaaatccgcttatgctctagctttgaatccaatctatgatttcaccaaatttggttgttaacaataatatgttcgttttgtgttaccagcggcatgtgaactcaactatatgtatcaccctttttttgatggcgtgcttctttatctaagatatatatttactttcctttttggtataactaacatatggaattcccctttttaactggactagctatcaaacaaaacaaccaatcatgtacatgatgattttaaagcatcaagagagatcttgagtttaaggaaatagcttattgaggcgagatatttactttattgattgttatattagatattcaatttctcattgttattgtacttttaggttttctttcctaattcccgtgagaatttacctgtatcatatgaaatccatacattttaaactctacttggagaagttaagcacaattatgattggattcttccaactgtagtacccacttgtcgatgcttagctattggttgtgcattttgctattaaacttttgtaacatttgttcaagaactaatcttgcaatacatatataggggtatggtagataaacattctatttatatatgaatgtagtgtcatagtgttgattttgtagttgttgacattcattgtaaaatgcattggcaatggatgaatgggagtgtaatgtttaagaccatgtcaagttaaatccccacaacgttcatatacaatagtggtatcacatttcattttggctgctacttttgatattccactgaagaaatagtatgaaaaaatatatgtcggccattcggcctcatagaaagttcaaatctgcaaaagaaaaaaaagtgcaaagaaaatagtgatggacgcggtacaacatgggggttacacaacatattgaaaccgctagctccctagtacagttcctactttgcgtgctcttttgttattttattttttgagcatacgtaaaaggtttgcacatcagtctttgatagataaccttttttctcaatatctaaaatggaaatcgtctttttcccttttagcttgtgctttgcttccaagttgcatcttgattgctgctctgtactgtagtccctcgtgtccagatttgtactacaagtgtgtcacatttgtccctcatctgtttcaaaatagatcaatctagaaatagatataatattatctattcatattcattatattaaaatatatcatattcaatcgtatatttgtttttttttaattttgacagagggaacactctggtgtcaggtgctgaatctgatcccatgtgatgcctgattttctgtcagagtagtgggcttgtcatcagcactacttgtctagggtgtgtttaggcagcggtcgttttggaggacattgaggcagaaagcacctcgtttttcacaagcacgttttctaaactactaaacggtgtgttttttgcaaaaattttctataagaaaattgctttaaaaaatcatattaatctatttttaaaatttaaaataattaatactcaattaatcatgagctaatggctcacctcgtattttctcaatctcctcaatccccttcttcttaaacacacccttagtctacgccaaaattgaaagtttgattgaaattggaactatgtgatggaaaagttggaattttatgtgtgtagaaaagttttgatgtaataaaaaagttagaagtttgaagaaaaagtttagaactaaactcggccctactttagttgaacaacttataaattttggagctggcacacaaagatgttcgatctgttccttttcagcgtaacttttcatgtggttagttctatgatacctttctgaaggcctttttgcacttttacaattcttactagtttcatgctagtgctaactaatgaaggcttaggcatgatctaagagtctaattagcatgctatggcaagagaataagtagtacatggtgtggtgttagatcaaaatataatcatcttatgaacaccctttgctgtcctgccttaatggccatacactgaaactgtaaaggagccaatgagagctaaggggcacaaagatggtgggagaggaatattcttcgacaattgagcaatgagcagctttcttaggacaaattggaggggcagaagaaaatgaaatgcagaagcttacaagtagagtttcagtttgccttttattcctaactgccagttcgtttatcatgagatgcagaagaagacatgaatatgtccctttctcctaggcaaggcctggtagtgtttaccctagaaaataaggtccctttcttctcttgcattttgcacatccaaacaagatagttgaaaatgacatttgcatatcccttttcattctccagtattttacggaactaaatccaaaaactcttcttcttcccccaaaccagtcggaatatttttgcatgcagtggcagtacaccgtttaaaatagcccccatttaattcaaaggaaattcataggaattttagaggattttattcctataggattttttcctacaaagccctttgaatcaaaggaatgaaccctatggaatcctataaaattcctatggaatgcctcttctcatacaagttttggaggaattttaacaagagttagaacctcatggaagaaatcctttgaggccccctatgaatcaaagtatttatgtaggaattttataggattcaaatcctgtaggaaatttttcctatttggccctttgattcaaaggattgaagctttccaaatcctatgaaattcctatgaaatggcacattgcatgtggattttggaggaaatttagcaagagctccaacctcttggaaaatttccttgagtctatctctctcatccgattcctgcgtttttcctgcgctctaatcaaacgaccattcctgtgtttttcctatgttttgcaatcctctgttttacacttcaattcctgtcagaatcctgtatttttcctattcctccattttttctaccctgcgattcaaaggggccctgagtctttatctctcctcaaattcctatgtttttcctgtggtccaatcaaacggctattcctatgtttttcctgtgttttgcaatcctctgttttacacttacattcctgtcagaatcctatgttttttctattcctccgttttttcattcccgtgattcaaaggggccctaaaattggccaattggaaatcttccaagccgatgggactaagatttcaaaatccggtaattttgtaaaagtttgggacacgggtgtgcagcctgttattggctaacaaccagttaaattccagccaatgaaatattaaaccagggtttaatatttctattacatttattactaactactccatccattccatccatttcatattataagtcgctttaacttttttttcttagtcaaaacttatttaagtttgatcaaatttatagaaaaatttagcaacatcaacaacaccaaactagttttattaaaactaaaatttaatatattttcataatttgtttgttttgtgttgaaaatattgttattctttttttataaaatcggttaaacttaaaaaaattaaactaaaataaaaaataatcaaaatgacttataatatgaaacggagggagtatatattactgctttgaccactaaccatcagaacattatgaaattttggtaaaaacaattaaattaaaagaaaaaaataattaaaatgacttataatatgaaacggagagagtatatattactgcttttaccactaaccatcagaacattatgaaattttggtgtaaccaatgcatttttagacgattctactgatgtggagtatttttttgcgtaaccaatcaaaatattttataggccttctattccttttgcaggagggagtagcacaagataaataaaatccatctcccaatacatttttgcttggtgattgatgacaccgatgtaagtttggtcaatgttgtcatcaatgcccagtggaagaaagcaacatcgcgataatatacaaaaatggacgatgtggcactgccatgagatgtacgaataggaaataaatccgcaggaaaactagtgggggactaaaacaaaactaaattacccaaagttgcagtcctacatgtgattaccaattttcttttgaaggatcgcatgtgattttcaattaaaatcacacgcactgaggactttctttttgaggggaggtgataccttttctttgagacagtgatatgggttgtgaactcttaatttttggggtgggatacttttgtatcataattctccatccggtcacatatattttacatttaagataatatttaattaaacttttaatattgaaccatcaagtttgtattagaataagtttagacaatataatgagcttgtgttgttatgatagtaatttaagataaatatacacctaacatttattttaactaagtcgtgagaaattattaaccattaaagtttatcaaattttatccatcaaatatttatgataagaggacattcttaagtactactccgaagaaatctactgatacttattaagcaagttcaacgattaaggctgtgttctgttggaggggttgggaaccctcctcctccgcacgtaaaacgagcgataaattaatgtatgatcaattaattatctataacaaacttaaaaaatggattaatatgacttttcaaaacatttaaaaaacgtgcgctcgaataacgagggagatgagttgggaactcgttagaaaggacttctacagatatgttgtacggtaaattattgtaaggacatactagtacaaaattagggtggatcttccatatctcgcggtcgtctaaaacattttagaccgtcgaattctcatcctatacggctcaattatcgccttatatttttttagataatggaattatcaccctatataaaaatttataaacaacggacaccgcgtatagttctttttatgtgttctaatggttttcactatttgatatggctttggtgagaatatttataccttacatccaaacaatcctatcaaataatacttaattaggcgtttaggattacagtaaagccttgtcattataacaccatggtccattgggtacaccagagaggaccctgccattgatgccactctctgttttgtactactagtactactcaatttgaccagcagtttgtcacgctttgacatgtggagcgccgaggcatttcgttgagagatccaatcaagattccccctcaaatcctgtgctgcttcttcttcctccttcctccaggcaagcccattggaacgtctcgctggaagatcaacaccagccattatgcagagaggccctcgtagaccatacaaagtgtggattctttcttttattattattgtaagctttaatagtactcctaagttcatctttaattagcagaggcaaagacagaagaggtgtatggtgtgcccacaatatagctaggagcccttactaattatgtatctcagcccttaccaccaccttcacactagtgatggatctaagaatttttagaaaagaacaaaatccaccgcgctagagtcgtctgcattgcctggtaccaacaaatgaggtatttctctacatcttgagtcttgacatgcaccggcattatcagataccaataacaatgtatttctacctcttgccatatgccggtaagtttgggcaactactcgggggtagtcatggtactgtcgcgctagatctgccaatggatctcatgttgttcacgacgctagagcaagatgacatgcaattttactggcaaaagatagacaaatgtttttttttgttatatcaggtggaatttcactttcaatcatagaaatttttaacgtacagataaagtagtttatcggtgataatggcttttgagtacagaatgccaaatgaacaagtcttccctcacaaaaaaagcttgaacattttattaaagtagcttagctagtggtggttgagttggagtatgactctgaaatttgtctcaagtgcaatttagaaagtctctgtgatatcaccttcatcgtcaattggctcggcttgacaatgcatggatgtcatcttgactgtatatggtccactagaggcggagattagaggccgtgcaagagaaaattaaggggaaaagaattgatcaagccaaaccatgtaatgtgttgatgccggctccaattgaaaacataatactttcatgttttctgcaataacaatatatgccggctaaaagaaataattctgcttaattacgtcaatggggttcaagtgaaaattactcgttatatgcagcggagtagcaaactcataagaaaatttgaccaaactcatgctaactttaagaatttctcaatcacgggaatacttcatctgtcccaaaataaaataaaaagaattaaatgtgatatgacctactaaaatgaatctggatataaacaaatgtagagctagatgagacataacctaatataaatctggacatgtttctgtctagattcgttgtactatgttatatctcatctaattctgcatatttgtttgttttgggacgggggtatatatttaaagaggttttatgtaaatttaagaaaaaaactttatcatatcacatatgcaagatatgtagaaagtgaactcaaagtttgagatctgcttttgacattttcatggacgaatgaaagcaataaaaatttggattcagatgttgcttcaaaaagaaaaaaaaagtttcagatatagtacaatatactgaacagtgatagttttgtttgataactccttttcttcttcttcttcttcttcttcttcttcttcttcttcttcttcttcttcttcttcttcttcttctaaacatcatgttcgatcttcttgttagcaggatcatacctaaaaatttggggccaaggaataagaattgcaccctaaaagaaaaatccattccaaattagtggaaccagagaaaaggagagcttttttttaaaaaaaaatagagttggatatctcaaaatatgttactcccccggtttcagattataagactttatagcattgctcatattcatatagatgttaatgaatctagacacacatttattaacatatatataaatgtgggcaatgctagaaagtcttataatataaaacagagaaggtagaacacattgcctttatttgaaatatggaagtcctctaatttttgggagccttgtgccaaatatgcacgccactcccaatcgacgggcatgcttgtcatcctcattattcaggcaatttggttgagctatatttgaaatgcatgttgagatttttggatatctctacgactctacctgatgataattatttagattatctgcacgaacctaaaaagttataacctaaacaaggtaaattaccatgtttaggtttgtgatgatgttctccaagagcatttcaattctcctagttgccccaaaagacgccaaattgacgatattaatagaaacagagaagacatcgaacaaaacaatagggcaagtggactgctcagcacaaacagcacatgcaacctaatgatgtaattaggtgcgcactcaacactaattatcatgtccgtagctacacaacagagttaaagtaacactattgctccactcttgcaccagagaccgtgacaatgtccaaaacttagtataaaaggtaacttggagatgactataagagcaagtttaatagtatactggttccaaattatatatagctaatctaatagcctattcatacaatagttaactatagaaatatactacactattaatacccggtcccacttttcatacacacataacgtcttgaagtccgtgttgcagccggctacaaatctgtagtctgctttcttctctctcttatctttttttctcgatatgtgattatagctgatttatagcttgctattgtacctgctctaagaaatgaactctttcgatgatgtagatttttgggccaaattctggtggtgtacatgaaaaatgcataattagatatagtgcacaaattgaaaatactctacgcgttcacaaataacagttggttttgactttgagttatcctatttgaccgaccattattttctaataatgtaactatttaatactaccagagttgtatcattaaatctgtaatcgttatctaatgtattacattcaagtctattcgctttaacgtctcggtaaacgattgattttgccaacatatacgtagagtacatcagtaatccaccttggttgtagctctttaactaaagcctaggattatattccattatataaaataacatcggtagtgcaccttaggccatgctcttttcagctttttctctagattctcgtcacggattagttgctccacgcttctaacattacgatttctaaaaataaaattactttcaccgtattatttagatcactttgttacagattttgggaagtttatttcttattaaatattgtgctaaccaagtaaacaatccaacgaaaaagaatatgttccaaacaacccgtccaaataaagtgtttcataggtacctagccgcgaaaaaggccgctcttcacgagattcccaaacatcgtcaatttcttcaaaccgatccacccccgatgatatcgcctttcaccgtcgcatacaaatagagacgcacccccccccccccaccacctcacccacacacccacactctctacccccaaacttgccctccaatctatctccgccgccgccgccgcctccgccgcgagagggcgtcgccgagctgcgcgggaggctcgcctcccgcagcatctggccggattcgtcgtagtcgaggcagctgtaagcgagagagagggagatggccgcggccgccgggaaggcggcgatggagcggcaccagtcgatcgacgcgcagctgcggctgctcgcgccggggaaggtatccgaggacgacaagctcgtcgagtacgacgccctcctcgtcgaccgcttcctcgacatcctccaggacctgcacggccctcacctccgcgaattcgtaacttacttgcttcccagatcctgttgctcgtgcccgccacctgttcgatcgattgcccacacggttggttggctttggttttggttctcttcttgcaggtgcaggagtgctacgagctgtcggcggagtacgagaacgacagggacgaggcgcggctcgacgagctggggaggaagctcaccagcctgccgccgggggactccatcgtcgtctccagctccttctcgcacatgctcaacctcgccaacctcgccgaggaggtgcagatcgcgcaccgccgccggatcaagctcaagcgcggggacttcgccgacgaggcctccgcgcccaccgagtccgacatcgaggagacgctcaagcgcctcgtcacccagctcggcaagtcgagggaggaggtgttcgatgcgctcaagaaccagaccgttgacctcgtgttcaccgcgcatccaacgcagtccgtcaggaggtccctgctccagaagcacgggaggtgcgtcgatgagctgtccccttctccgatgctctcggtgcgtcgggaaatgctaaatctaatgctcttgatgttgactcgctgtgcaggatccggaattgcctgaggcagttatatgcgaaagacatcactgctgatgacaagcaggagcttgatgaggccctgcagagggaggtaagttgatttttttttttgtcaatttgtggttacaatattataaagtcaatcatagcaaaagtgtccaccgcaccattttgattattttactgcttatcagctcaatggcttctttttcttgatgacttaaattatgggtctctgggcttaatgagatttgtatactctcaggcagtagcttaatttagaattaggtccatcctaaaagcttaatttagtcgaagtggcaaatcatgtttgtgcctcttttatctatgtggtgcctgtcctgctccatgatcttgccaaataatttagaaatcttatctctattgtctgtacaccattcttttatattagtttatttggacaaggatttttttttttacattagtttagttggagacaaggaaaaacattgaacactaggtgattatttccagatcctcaaaaggtgtttacctatcacgttcataaattaattgctctgtacttttggactctgtcttgacagttctgaagtccatctccaatagttttcttttgatacacttgaaatgagagctctttttgctagttctgatttctgagtgaaattcatcttcaatcagagaagtgctatgtgcatattgcaaagtttatgcagaaatgtcgtgttggtttctactactctgttctcatcatgcctttctgattgtgtggtttaacacgcttcacagattcaagcagctttcagaactgatgaaatccgcaggactcctcccactcctcaggatgaaatgcgcgccgggatgagttattttcatgaaactatatggaagggtgtaccaaagttcttgcgccgcattgatactgctctgaaaaatattgggattaatgagcgtcttccttacaatgctcctctcatccagttctcatcctggatgggtggtgaccgtgatggtatcttctcctatcctaacttatacatccatttttgtttagaaaggaaaacagaacttggttgagatctgtcacatgctcacatgtgctattgacagaaaattggcttgtttgtcctcttagtgacatcatggtattagttctagcaattggttatttattccccttccacacttttaagtcaacaaagattccatttttttcaaataattgtattattcacttgtctaaatatattttttgagataactgcagccttttctgctccctgtaatcctgtctgttagaagaagttgaactctaaaactgacttgttttctaggaaacccaagagttacaccagaggttacaagagatgtatgcttgttggcaagaatgatggctgctaacctgtacttctctcagatagaagatctgatgtttgaggtacagcagaattgcttattttcattgttcttaaaaaagtactgcaatactgatttctaagttttaacaatgcaatatgttttcctagctctctatgtggcgctgcagtgatgaacttcgaattcgtgcagatgatttgcattgctcctccagaaaagctgcaaagcactatataggtaacaataccataactgtggtgataatgaattttgggtcggcctgcgcatttgttgatttgtgtatcattttatagtctgaaggaaaagctgtacttttggtctgcttgcccttctctttttagcatatgaagtaaccattttcaagttttcagatagagttctaatatgatgttcatgcatttttttaatgaccaatatatcattttcttagcctctttttctatcatagccacctcatatgcttgtctataagatctgccatctttcctttaatttttatcagagttcacctgtactgtaaaatcttcaggtgattttacacttgaaaattgtgcttgccaattgccaattgtaatgtgtatattgtggataccagtgttgaattattagtcaggttaatttgaaaaatgcatctgctagttcagaatccactagaactttaatataaagaaattatttgtttagccaaatataattaggctgacattgttcttccagaggctgtgaaatccctactcaaaacatttatcaagttgactacagtgatggactaaaatggactggacgtttttatgtctaatatggatgcatcaactcccggcataactacattgattaactacatttcatttttcctcggtttgttactcatttagctgatcaacctgggtgaaagtcatgcatgattttataattgactgatttgtactattttttagcaaatgcctactaaatttgcctcttactgagaaaatgttaatggtgcagaattctggaagcaaattcctccaaatgagccttatcgtgtcatacttggtggtgtcagggataaattgtactatacgcgtgaacgtactcgccatctattgacaactggagtttctgaaattccagaggaggcaacgtttactaatgttgaagaggtaatcctatttatcttatatgtatcattgtgaatgtcattgttgtacttatagtactcaattatcaccctcctatcttgcagtttctggagccgcttgagctgtgctacagatcattatgtgcttgtggtgacaaacctatagctgatggaagccttcttgatttcttgcgtcaagtatcaacttttgggctggctcttgtaaaacttgacataaggcaggagtctgatcgacacactgatgtccttgatgccataactacatatcttgggattggatcttacgctgaatggtctgaggagaaacgccaggattggcttttgtccgaactaaggggcaaacgtcctttgtttggtcctgatcttcctcagactgaagaaattgctgatgttttaggaacatttcacgtccttgctgagctcccggcagattgttttggtgcttacatcatctcaatggcaactgcaccatctgatgtgcttgctgtggagcttctacagcgggagtgccatataaaacagcctctgcgagttgttcccctatttgagaaacttgcagatcttgaagcagctccagcagcggtggcacgactattttcaatagactggtacatgaataggattaatggcaagcaggaggtcatgattggatactcagactctggcaaggatgctggtcgtctttctgcagcatggcaaatgtacaaagcacaagaggagcttgtcaaggtggcaaagcattatggtgtaaagttgacaatgttccatggaagaggtggaacagttggcagaggaggtggtcccagtcatcttgccatattatctcaaccaccagacacgatacatggatcacttcgtgtaacagtacagggcgaggttattgaacactcgtttggagaggaacacttgtgctttagaactctgcagcgctttactgcagctactcttgagcatggaatgcatcctccaatttcccccaaaccagaatggcgtgctctaatggatgagatggctgttgtggcaacaaaggaatatcgatcaatcgtcttcaaggagccacggtttgttgaatacttccgatcggtaagttcacctctattctgaattctttcccataaaatctgctgcagttccgataggcgtaaatttatgcttaatttcaaggcttcttgacaagaccattctctaagctaattagatatactcatgagttctttgcagtttgcatagagcgtgtggtctgatgcgaagttgcatgacaaatgtgtgtaggccatgataatttttctaagcttcatgtccacagttttttgcaattttacttaactatgacaagggatcaaatactaatgtagagatatgctccttctccatcaataggtgcaccttcatgctccttctccatcaataggtgcaccttcacattctcttgcctgtgttaatcgactaagaactaccatatagaagggattgcatacatattttggttctctgttgtcagtcacttcgtgctttatgttatctcttatctgagctagatgttggtggtgaacatgaaattctgacatgtgtgtgtccatctgctgttccaggcaacacctgagacagaatatggcaggatgaacattggtagccgaccatcaaagagaaagcctagtggtggcattgaatcgctccgtgcaattccttggatttttgcttggacacaaactaggtttcatcttcctgtatggcttggatttggtggagcgttcaaacatataatgcagaaggatatcaggaacatccatacactgaaagaaatgtacaatgagtggccattcttcagggtcaccttggacttgcttgagatggttttcgccaagggagatccaggaattgctgctttatatgacaaattgcttgtggcaggtgatctgcaatcctttggagagcagctgagaaacaactttgaagagacaaaacagctactccttcaggtaaactactctagaataagaatgggctatacttagatattaagtttgcttgcatttaagctgcacctttctttttatcaccagatattggctttaacccacaccagtggttcttttagagtttttccttgagatatatatgatcctgtttgatgtggatgatatgatcctgaagaaatcatcaaaagatttatgtttgaaaattatactgaagacaaatctggaactacacctaggcattctgaatcataaaaacaaactccatgttttaaataagagtgcacatcatatcatcactgaatcttttcgcagtctaagttgcgacaactgagatctgagaagttagtgcccttgacacattgaaatcatctgcaggttgccggtcacaaggatattctggaaggggatccttacctgaagcagcgtctgcggctgcgtgagtcgtacatcactaccttgaacgtttgccaagcctacaccctgaagcggataagggaccctagcttcgaggtgatgtcgcagccggccttgtcgaaggagttcgtcgacagcaaccagcctgccgagctggtccaactgaacgctgcgagcgagtacgcacctggcctggaggacaccctcatcctgacgatgaagggcattgctgccggcatgcagaacacaggctagattgtccacaagaatgcttccagcaggtgcaatcaatcaatcatcaataactccttccatgatgagatggtgaatatgtttaactagtacgttcgccgatgctagtgaattctggagacttttttttgctcgcacgttttcttttggttgtgtacttgatgtaaatgtcaaggggggacttatttggcttttgcagcccgatccaaaataaaatatggaccaatcattctacgaagcttgattctgaacgcttcgaatttgcatcagtggtgacagcggctgtgtttgcatctttaaacgacagactaaaagcattgtgcaccgcaagatgcagacttgacatgtgcttatagcagaagtattacatggagcacatctcaggtgagggaaaccggaacacacctcttctttcaatgtgcttatagcagatttattacatggagcacatctctgtctttctatcaaatgatagtccttgcgtattaagaaagggctttctagagattctactggtcctgttggcacatatgaaagcagcgaaatgccttacctttcagcaaagattgcccactgttaaaatgaaggttctcttgcatactttaggatgagcagaaacaaatggttttagggtgtattcatttctcccctttcttaaattttcctctttcgttttctacgcatacgtttactaaactgctaaatagtatgtttttttttgaaaaaaattaaagtttttttaactaataattaattagtcacacattaatgacttgctccattttacgtgcgctaaggagaagatcccaaccattccaaataaacacaatatagactatagagtttctccatatgtaaatatcttttgatcttttcatttataaaaaaaatattaactactgggtttgactagtagtgttgctccttaaaaaattgttaagtccttttttaagtcactgaatgcacttccagtaattcagattacgaaactgaagagtatccatgacacttctaatatcattctagatggtcaaaagaaatgcttctcgtaacatttgtttctttttttaaaatctcatttgagtgcataactttatacttccgctgttacattaaaaaaccaatctaaaatcggagattgatttttttacgggacagatggagtatgtgctatttgtagatattttacttcgtcatctatgaactgaactacccatttcttgatgtgtcttctgctcggcctgccatccatactttagatccattcttcgggcttgatggacatttgggcccatttccatccgtcctggacaggacagaaatactttgagcccattaacttcctcgctgggaagcccataattctagccattcagaaatgctgtacactttctttggtttatagaaaaaaaaacatatgaattttataggatactaactttcctttaaaattcctatgaaatgataaaccatttggattcttccatttacatcttacaaccctatgttattctactagtaatatatgcctctgcattggaatagtcccatataccactataattagactggttatgtatctaacctaaagattgcaacgggcctataacactgtgaataggttgactgtactccctccgtaaacaggaggagccctaggttagattttttttggacggagaaaatatttcttaactaactactttttatttggagttttcttttttatgcgagagtacgtgatgcatgcctaagcagtgagggaacctgtttgggggagcttaagaccctatttagatgggactaaaacttttaagtccctatcacatcggatatttagacactaattataaatattaaacgaagactattaataaaacccatccataattttggactaattcgcgagacgaatctattgagcctaattaatccatgattagcctatgtgatgctacaataaacattctctaattatagattaattaggtttaaaaaattatctcacaaattagctttcatttatgcaattagtattgtaagtagtctatatttaatactctaaattagtgtctaaatacagagactaaagttaagttcctggatccaaacaccaccgaagattctgagaagcagctgctgagaagctagctgatgagaatctgaagaagctagaaaacccagcttctggcttctagtttattttccagattctacaactgcagattctcagaatctggataaaaagctggactgtttgggggagcttctagcaactggagattttacgagaagttgcagctgttaaaagctcctctaaacaggcccgagttttactttctgtgtgagtgcagtggggagggaaaaccaggagttctttttttttttttttgagcgcgttgtgcgcaagcagggaagaggaggatggctccccttttaagatagtagagatgtcgtacccggacattgaaacatattgttttgttattttcccttagttttgagttttaggtgttccaaatggtgtggcctagtttgaaacatactatcatttactggattattgtcgtagattttatctacttaaaagtataggggtaagttaaataattgaagaaataaaattaagaagtaagagatctacattatgcagtagaagtatattttttaggaaaaaaaaatattttttagtggcgtagagtgaataatccgtggtaatattctggtaaagtagctgaaagcctgaaaagaacatgctattaatatatggtgggctgattttgtttgtctctaagcccattattcgcccattcgtcaatataataataggcacattatctttacggaactagctatgtctttgtcgacaaatccttgggtcaaaatcacccagattttttcctaccgttagattaagatccagaggacacaaaaaatgctacatatttttttctctgactaatcagatcacaaaactacatgggctcgaattctagcccatagaacaatacaaaaaattatacaggccataactgcaaatacatcatggcccataatgatcaacttcacatccaataaaggttagaaaaaaacaaaataacacagggagaccacaccagttcgcacaaatcccctagatcgagcaaaacaaatcgagcacgccatagacagtgaggagaacgagaaaaagaagaagaagcaaattcttaccaagaacattgaggtcaagaagttgaaatcaacaagacataatcttccaggtaacaaattacctagcacaaaatccacctttacctttccccattgacttcaccatattctgccagtcatcttttaaatcaaacaaaaaacaactcagttctgtaaaaatattggagaaaagcacttggaatagtgaatttcttttggagaaaagtgcttggaataggaaatttctttagatcaagtagttaaaagtatgtaactttttcagaaaaactcgtaacaaaaactatcaatccatagtcagttacagttacaaataacaaaagttacatatataactacagtacatctaaactgtaactgggctgtaaatggaatcattcttaaatttcttaaaaaattcagtacttatactgcgacattaaaacatttccccaattataacaagctctaaattatgttacaaatatataaagaactatctatctatagtcagttacagtgagaaataacaaaagttacagatgtaactacagtacatttgacgaggttaaacttggagttataactggaatcatcctttgatttttttttaaaaaaattcagtactcatgcactaactttttttttgcctatgacaaaatgttctaaattatattacaaataacctaatcatgtagggtcaggtatattgcaatctcaaaaatcaggagatacacaatcagatggatatgaaatgagaagcaaaattgtgtctgaagaaatgagaagcaagaagacagttaaaggtgagaatcattctcacctagcattatggaccattttttatcttgtcagaaaatgtcatctagcaaaaatttatatacaacaaattagagatagtagcatgataaatttttaaagaactatatatctatatccagttacagtgagaaataacagaaattacatatgtaactacagtacatattgactgtaactgggctttaactgcaatcatgcttgaatttcttcaaaaaattcagtactcatgcaacagcattaacatttttttactattatgacttgttctaaattgtactacaaatgattgaaacatgcaacgcctgatagattagaagctcaagcaacagtgaatacagagtcaaatagatgtcaaagtgacaaaattttctcagaaaaattaataagcaagaagacacttgaaggtcagaacaatggacagatagcattatgcaccaaatttgatcttgtcagtcataaaatctagcacaattttgtatacatgaaagcatgatttttttttttgaaaaactatctatctccagttacagtgagaagtaacagaagttacatatgtaactacagtacatattgactgtaactgggatgtaactacaatcatgcttgaatttcttcaaaaaaattttgtctaatatacattatctaaattatattacaaataacctatctatgcaggttctgttacaattcgatctcaagtaacagtggatacataatcagagagatctgaaagagataacattaatttcgtctgatgaaaaaagaagcaagaagacaactaaaggtcataatcatgataacctagcattatggtccatatttgaccttgacagacaatttaatctagcacatatattagagatggcggctttgaaaaatctaaagacctatctatctatagtcagttacagtgagaaataagaaaagttacatatgtaactacattacatctgaactgtaactaggctataacagctttcatgcttgaatttcttcaaaaaaaattcagtactcatgcagcagcattaaatattttcccctattataacaagttctaaattatgttacaaataatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagacaatataatctagcataaaattatatacaacaaattagagattgtagcgttgataaattttcaaggactatatatctatagttagttacagtgagaaataacaaaagttacatatgtaactacaatacatatagactgtaactgggctaaaactgcaagcatgcttgaatttcttcaaaaaataaagaatttcttcagaaaaggagtcactttgtcacaatggactgaagattttcctcaagtgaaaatcatcttcagacagtggtgtttaacaaagcacaacaattagattagagcctaggataaaaaaaacagagcattgtggtccaaacggtcatatctccagttgtgtacaaatttgcccatatattaaattttgtacataatttgcacatatctcaaacttctgtgcacatatattaaaatcactcgacaacaagatgtgacaagttagctgatgcagaagggaatggaccagaagggaatggaccagccagggtgttgttgttgagcctcccgattaaatttcacagcaaatgagttaactgactaacaagctccacacataattaacatgggaacaatattgggatgggacgatgggtcattcagaataaagaagaaaaaaaatcatacagatatttcaggcatgtgaatacctccaggcacccaagtgaccttggttttgctaccattgaaatgcattagatcaacattagactgaaaccctccaaattatttttcagtttgctgaagtatgagattttaaaaagctcatgtcgactgaaagctcatgcctgctccaagattcaaaaaatactgacaattcaaatagatttacgagcgtgctatcccctgttcccaattcagaaatagtgccaattatgttcccaagttcagaaatagcgccaattcaaacagatttacgatttacgagcgattgacaatgaacaaaagttcagaagagaagaaagagcagatgcaaccaatagcccataatttctcaaagcaacagggaccaagttcaggtattggcttgctgctaactcatttagatcagcactgaaaagttcagaacatgtacaggaattttataaaccaaatagtactgtagaatacaatctgaagaaagcagaacgcatgtaggggtttgggtttaatttaaccaagcaactcagcatactgggaaatcaaaccgtacatctctgaaacgaaatgattcatatgctgcagaaggtaacacaaaacatacttggggttcagttagcatgcatatgtaaaacaaaattcttcagatgcataagaattcagatatatgcagggagttgacagataaatcatctctgaaacgaaatgcttcacatgcagaaaaattcagactcatgcaaggagtttaacagatcagtcaactaatcactgaaagtgaaatgcaacattcagataaagttgcaatgatgcttccctactatattcaaatcacacataaatcaaagcaaaaataatcaactcatgaatctgaccccctccctgaagaaaattcatgcagggatccaaaaaatgatcaactatctgggtgattagaaaaaacccctaaatccacctcgaattaaacctttaactccatcaaatacccctgaatccaacccccaacatgaacacccctaaagaaaaatcaaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattctgaatcagatccatatgttgggagcaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccctagcgagcgcgcgcgctctctctctcccgctggggagctgctcgtgctctctctcgccggcgagctctctctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcccaggccatctgctcacaggccacacggtctcatccacacagggaaatgcacgaatcatggcgcaaatcctacggatagaaaaacgacaaatattgggggtgaaaatctgttgagaaagatctagcaaaatcgtatctttactgttcaaaacactgtttacctattgagtcatttcgttttcagatttgaaaaagaaaacttttagcccctgtttaaatctcaccttaaaattttttacactgtcacattaaactaatcgcatgaagtattaaatataagttaaaaaataactaatcgcattgcgactaatttgcgagacgaatattttaagcctaattactccatgttttgacaatgcgatgctacagtaaacatttgctgatgataaattaattaggcttaataaattcatcttacagtttacaaacggattatgtaatttattttgttattagactatatttaatacttcgaatatacgtccatatccccttaaaagatctgtcgcatgtcgacgtcgatctgtgcacgcgcgtcaggaacaaaaaccagaaacatttttgtcatctggagaacttggcacgtggacccgactagtagcggtcaccatgtcccgttttcgacgatgacgaccgatcaagcgtacaaatcacgcacgatactcgcacgcgtagcaatgacagcatcatatttccgattttttttctttttggtgaacttacaagttttatacaggtaggtggctcgtaaaagcaaaattgtgctccacatatcatatccattttgacataagcagctaggtcagcaagaacacgtcaagcacaaaacgagaacttgaagacaaaaataacgatcaagggcacgtttggaacgcaagatttgaacaatacgaaaaacacaggattagaatatcaaacatgcgcaaacccagctagagttcaaaacacaagaattttggggcattgcgtttgggtagtttataggaatataaccatagaaatttgatggaattaagagagagaaagagattaaaagacgcattggattcctcaaacgaaaaataaaatggagcttgaggtcacggtaaaattctcgatgcataggatagggaatttgacttgctaaaattctttgttccaaacatcgcatttaagaaaaaaaatcaagggttatcatccttaaaattcccttgaatttctttcgatccaaaggaaagggcccataaattttttgaggaattttcacattaatcatttcaatttcactagtaatgaaaaataaaaccctaagttcaccgtcagatatggaatttcaactatcacatattcacatgaacagtgtgaatgagacagaaaatacgtagatattattgtcggaattgcctgcaaaggctgttataggatactgaacatagcatactgaacaaaagaaacgaaaatgtagcctctcccaacctacagatgggtctctgaacagacgaacatcagcaggtcggccttctacttggacctaagagatgatgagatgatactctcagaaacggcagttaccgattccgcg

SEQ ID NO: 5589 - DNA, 585 bp, Oryza sativa
ttctttccgaactatgttacacccaatcctataccatgccagattaagaaagccactagtagccaattctttccaagacatgatctcttaatgatttttactactaattgaagggaccgtctgttggtcgccagaaaaaaattgaatccgtcagtcaatttgtgtgagcattcgatctgcatccaacgggcgtgtgacaaagaaacaaagggagttagtgggcccgtagcactccttttgcggtcccattttggggtctgattttttattctccgtattgggcttttgtctttttctaggcaatgtgcaatgggcctgtatgatgttttattagtggaaaaaaaaatcaactttaactcccttaaagtaggctgaatctaactcgtatcccttaaccagaaaaccgggtagaacgaccctgagaaactggtataatttgactccttcgatggttttggagggcggtttcgctgacgtggcgctttaacccgatcaactggttgactctgtatgtgggacccacatgtcagtgtcacattttcttctcccttttttttttctctttttctcctctttctagcccgg

SEQ ID NO: 5590 - DNA, 850 bp, Oryza sativa
  unsure (1)..(850): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattatagcagcatgtagatcaaacttcttcttagtaagtgcatcaacagtagggacacctttccaaagctctagcagctcctcaataagtggctccaagaaaacatcaatgtcctttcctgggcattctcgaccagggataagcaggcccatgataaagtttgattgctctacacattcccatggaggaaaattgtacgggataagaaacactggccacatgctatacgaggagctcattttaccaaatggattgaaaccatcaatagcaaggccaagtctgatgttccttgcatcttctgcaaaccacccatactttctgtcaaagtttttccatgactcgccatcagctggatgcctgagctcattctccactggcttcctcttcaacttatgccattgcacctcctctgccgttcttttggaagaaaaaattctcttcagcctaggaatcaatggaaaatgtcgcaaaaccttctcaggaatcttcttccttccaccattgtctttccatcttgatgcaccacaaaccggacaaacatcatttttttctaaattcttcctaaatagaacacaattatttgggcacacatggattgaattatatccaagccccaatgcacagataagtcgctttgcttcctcgtttgatgcaggaatagagcaatttgggaatgatgatgacaacaacttcagcaacactgtgaatgcaacattagaaaattcgtaaaatgacttgatatg

SEQ ID NO: 5591 - DNA, 10915 bp, Oryza sativa
  unsure (1)..(10915): unsure at all n locations
cccgtcctttaaattggggaacccgattcaaacactgacggcatggacacaacatctcttcatcgtcgccgaataatttgtgacacacaaataggtcttatgacatactaaatattgtcactggatgacattagactagctatatgacatttattgtgacacacaactttttattgtcattaagttgaaatgcctgaaataaaatatcataaattatatgatatagtgacattatggcatgtgtcttattaaatacgtcaaaaagccacacatatcttgtagtgtctctatctcaaaggccatgttgatgggaagccggtctctaggatgctagtggatggaggtgccgccatgaacttgatgccgtactcattattcaagaagttggggcgtgaggatgatgagttgaagaagaccaacatgattctcaatggcttcaatggtgaaccaacggaggcgaagggtatcttttcggcggagctcaccgtgggaaacaagacgctaccaaccgctttcttcatcgtcgatgtgcaaggtaactacaatgttattttgtgtcgttgttggatccatgccaattgttccgtgccttctaccttgcatcaatgtttaattcaatgggacggagatgatgttgaaattgttcaagcggatacatcagccgaggttgcaatggccgatgctacttttgagtggtgtcatgggaatatccaatacttatcggggagggatctttctagctatgattttattagtatctccgatggcaaatttgtacctatctctgtaaagccggctagtgtagcacggctaagccatataaatttgtataatgagtaaagaggctaatttagagtggttacaaaagagggtgcaagaatatcggtctacaaagaacgatattggagaaactgttgaagattttgatgaagtggagaagcttggaaaagggtttacattggccgatcctttggaagaagtagatataggtgatgaaactaaaccaaggccgactttcgtaaacaaaaacatgagagccgattataaggttaagataatcgagctacttaaagagtatgttgatggttttgcatgggagtaccacgagatgccgggtcttagccgtgagctcgttgagcatcggcttccaattaaaccgggttttaggccttataagcaaccacctcgtcgttttaatcctttgctatatgaccgagtcaaagaggagattgatcggttgttgaaggcggggtttattaggccgtgtcgttatgcagagtgggtctctagcatagtcccggtggagaagaaggggagtggtaagattagagtttgcatagattttagagatctaaataaagttaatcccaaagatgaatatcctatgcctatagccgacatgatgattaatgatgcctcgggtcataaggtgattagctttttggatggtaatgctggctacagtcaaatctttatggcggaagaggatatgtacaagacggctttttggtgcccgggatttgttggtttatttgagtgggtggtcatgacttttgggttgaagaacgccggtgcaacatatcaaagggcgatgaatttaatctttcatgatttgctaggtattatcttagaggtctacattgatgatattgttgtcaaatcggatggtatggaatgacacatagccgatatgaggttagcttttgagaggatgcgccggtatggtttgaagatgaacccacttaaatgtgcttttggtgtgtcggcggggaagttcttaggattcatggtgcatgagagaggagttgagattgatcctaagaagatagaaaagattcgtgatttcaaagcgccgacatgtaagaaggaggttaaaaagttgctaggtaacatgaattatttgaggaggtttatttctaacctagcgggtaaaatcgatgcttttgttcctatactttgtttgaaaaaagaagccgattttacttggggggcaaaacaacaagaggcgtttgaagagttgaagagatatttgtctactccacccgttgtgcgagcacctaaagccggaaagccttttcggttatatattgcctccgaagacaaagttattggtgccgttttggcgcaagaggaagatggcaaggaatatatcattacatatttgagccgccctcttttggatgccgaaacgaggtatgtttttatagagagactttgtctatgtttatactatgcttgtagcaaattgaggcattatttgttatctagtacatgcatagttacttgtcaagccgatgttattaaacacatgttgcaaaggccaattctaagtgggagaattggcaagtgggcatatgctttgatagaatatgatttgccttatgaaccattgaaatctatgaaatgccaaattgtatgtgattttatagtagaccatcatatagatattgctatgagggagaggtttgcttagttaaagttataccttggaagatttattttgatcgttcttcttgcaaagaaggtcagggcataggggtagttttgttttcacctaatggcatgtgtgatgaagcatcggttcatttggagtattattgtacaaataatcaagctgaatacaatgctatattattcggcttacaagttatggagatggttggagctaaatacgtggaggcttttggtgattcggaattggtggtgcaacaagtcgctggagtctacaaatgcttggacggatcactaaataggtacctcgattcatgtttagatattattgccaattttgataattttgctattagacatattgctaggcatgataattctagagcaaatgacttgtcacaacaagcatctggctataatgtgaagaagggattatttctgatattagaagagccggtgcttgattttaaatctttgtgcgaaattggcaaaactggagaccaggggcggtctgaccggcattgcacggccggtctgaccggtgagcaggggcggtctgaccggccgcatgccgccggtctgaccggcgaccccgagcggtctgaccggccctgcgtggccagtctgaccggttctgggcagagcgctggggggcacgcttcaatcaatttagaggccgaattaagtgtgaattcggacatttgtgccaagggaacagaagaggattggagaattcctttgattcgatatttgaaagatcctacacttaaggttgatcggaaaattcggcggcaagcattcaaatatacattgcttgatggagatttgtatcgccgaaatatagatggtgtcttgttgaagtgcttagatgaagatcaatctaaagtggctatgggagaggtacatgaaggaatttgtggaactcatcaatcggcccacaagatgaattggttgcttaggagagtagggttctattggccgaagatgattgatgattgcttcaaatattatagaggatgcgaggcttgtcaacggttcggcaatgttcaattggcgcccgccgccttgttgaatcccataatcaaaccatggccgttccgaggatgggctttggatttcattggtcaaatttatccttcgtcatcaaaggggcatatgttcgtgctagttgctacggattacttcaccaagtgggccgaagccatgcctttgaagaatatgactcatacggaggtaattgactttattttgaagcatattatccatagattcggtattacacaaacattaactacggatcaaggtgcttcttttatgtctaaggaagtgaagagttttaccgaatcttatggtattaaattgttgagttcttctccttattacgctcaagctaatggacaagtcgaatcgagtaataagacattgttgaaatcagtgaagaagaagattgaggaacacccaaagaggtggcatgaggtgctttccgaagcattgtgggcgcataggatttctaaacatgatgccactaaagtcgcccttttgagttggtttatggtcaagaagccgttttaccggtggaagtaaatcttgattctcttcgttatatcaagcaagatggtttgtcaagtgaagattacaagacgttgatggaagacaatcttgatgaagtcatcgacaagcgcttgaaggcattggaagaaatagagaaagagaagaagagggtggctaaggcgtacaacaaaagggtgaaagcaaagttgtttctagttggagacttagtttggaagacaattttgcctttgggtactcgatccaaggagttcggtatgtggtctcttagttgggagggtccttatcgagtatgcggcattgttcgagggaacgcatattttttagagacacttcaaggggagcgtttttagcgagcaatcaacgggaaatacttgaagaaatacttcccgagcgtttggcaagacgcttaggaggtactatggccggtaattggattatcgtccttagaccaaaacatgttctatgcttttagattcacgttgttcataaaaaaggcagggggcatgtgtttacacccaaatttggcacctaggattaaaataggaaagattgccaaaatttggaaatctaccggtttcctccgagtgggccggtctgaccgccgtgtgttggccggtcagactgccagttgagggccggtcagaccggcggtgtgtggcgggtctgaccggcaggtccgagtccgactgtgtttcgtcgggtcttgaggtttccttgctcgggaaggcatgtttcgggtttcctttggtttctacccggagttggacttggaggagagcctgtagagggcaagaccaacccctatataatggacatggccggttcattgtaaaaaaccaatctacaatcaatcaatcgaatcgttttttcatattgcttttagttttctcttagtttgtccatctttgtcagtttgcgccgtaaaccgtccgccgccgctgcgagagtgcgacatctctttgtaggtttgtcctgaaaaccttccgttttgcccacgagacgggtagttatctagaaatcggctccgctagccggtttagttatcaaaacacatctaggtttagctctttgctagatcgaggtggttggcgactctaggatcaccgcaaagcttaaggtgctgcgatcgtgcttgtcaacttgtcaaaaaaagttgccaacaatattttcttaaattctcatatcatggaagcattttttttctagtgctgtaaaatttccatccgctatatataggtccgagtcatatacacctaggttttacctttccggaatcctcgggagagtgggtgcaaaaaattcgaatgctgcaatcgcttctccgccgatctaattgtcatctccggccatgtgccgccgcaagccaccatccacgcgctgtgttgttggctgctctggccggcgcaggcggtgtgctcctttcaccacggagatacttcacggattgcgatgattacagttacaccgacgacgatgacgattatgatgacttcgtcgtctccacacccacacccacgacgacgacgacctcaacaacgtcgtcggtgaacaacggtgaggggtcctcgcgtcgcagctggtggccgccgcaaaggcagcacctgtacgttgtgctcgacgactggagcaggggattcagcgtgcacaagatggaccttgacggcaacgaggccgacgcagacgatcagctcgtcaccgtcgccgccacggactatctgccggcacggacctacaggcgtcttccggcgccggctgtccgattcgagtacgtgcactcccggttgaagatgatgggcagcagcgcgcagttcgccgcgctgggcagcaacatcgtggccaagggctacccgttcagcgacaaagatggcctcgctgtcgtgtacgacaccaagacggcggcgcaggccttcgtgcaccgcctcccggaggcgctggagcggtgggacgccgccgggaacaagctgtacgcgttcacgccgtccgaccggtcagtggactgggaccctcgcatcgacgcagggatgcaccgcctcgaagaggatccgttggcgacggagcggtggtcttggagccacgacccgtcgccggtcccgttcgacaacgaccacgcgcaccggcggatcacatcgcacgccgtgcgccccggaggcagcgccatcttcgtctccatagagaattggagcgtgccccgccccgggcacggtgatgaccacgtcgccgcgcaggcggcggaggcggaggcgaagaagatggcggggaccttctcctacgacaccgagcgcggcgagtggacgcgccacggcgactggctgctgccgttccgtggcgaggcgcactatgacggcgagctcgacgcgtgggtcggcctccattgcgactctcaccgccacggcaaactctgctcctgcgacatcgtcgccgccgggagccacgaggaggagcccaactggaagctgtgcgagatggtggtgatgacctcgacagtcgaggacgacgcgacgctcgtccctatgggcggcggcggcaagttctgcctcgtcgagggcaggtcgtgagagcggccccgatactggcggtgctggggcgacggcgacaagtgcgagctgcacatgaccacgttccgcctcaggtacggcaagaacggcgagctcgccatcacggatcgccgcccgagccgctcctatattctctccagatatgtcagattttcgtgtgcatgcattctggatgtattttttttttgggaaattttgctacaggacatcgcgattatgtgtatttagctcagggacaccgcgaaagtgaagctttggggaaagacatcccataatcgtggttatttgttgatgaacaccgcgccgtctagcgtagacttgccgtgctgacgtggctgacgggaggctgttttttgacacggtcagacgtaaatacccttgcgccttatctcctcttatccactcgcaagcagtacgggtggtagaaccctagctctaccgattccatccaaacagtgcccattcccaccgattccgtcaccctcgatactggctgtgcccaggcattgtcgctggtgggatgcaagtttgaccggcggtgatggcttcaccgtcgtaggaggcggtggaatctgcgctggcggcagcgccgccaatgccgaaatggattccgaaagggtaagtttggattcctcttctctttgattcgtttttcctctctttgattcgattgggatgcattaggatgcatggtttggtggatctgatttgggatcccctttttctcttcatttgccgttgcattgtaggatggatccgaactctgcatgcagagttgtggttagggttgttgcttatgttgagtatatggataatggtagccaagattatcatgtatcatctccacataagtgggttgtagataaagacacaataagcttgatagatttgatgaaggacttggatgatgaaatcatccgtggtagtgcgcaggagcttagagtgactttctgggacaagagagtgggtagggatgtagaaatttgttctgatgctgtgttattagaggcatttaaccaatactgggatgttaggaagcttccattgcaagtgacagtgagtgagccttgttcccaaattgtgtcttgtgtggatgaagctaaaacagtggttccactgagtatggttttacccacacaagcaagtcaggctgacaatgttcctaccagagatgctaccacaaaaaaggttcccaccaaaaaaaaatagcaagtccagggacaaagctactgatcaatcaatgccaaatccagatccatggggtgagtttgatgaggttgagtatgtaggagttagtgatgagagggagaattacaatgagctggtgtcagatgatgaggctaatgatccaaattacactcctgaggaatctgatggtgatgaagagaatgatgatccagtagatgatttagaagtcaatgataataggggttgtgagcctctaatccatataactgatgtaggcaatccaaggatagaagttggtgttactttttaggatgtaatttgttttaagaggtgtatgagacaatatgctgtcctgaaagaggttgagcttgcagtgccctactctgaggccacaagatacagagcttattgcaaggcaaagaagtgcaaatggaggatccatgcttctaggttgccagatggtagaacttggcaggtatgtagctcttttgttttacttctttgtcatttaatgttttgcaactgaataatggtttggatgtttactgtccctttttggttgcagataaagaacatgccatatgagcataggtgtgctagcacaggcaaattggagaataattgcatggccagcaattcttgggttaaagacagggttatcaacaagcttagagaagatccaaccataggggctgctgctctaaagaagactttggaggagaagtatttaatcaccctgtcatactatgtagtatgggatggtaggcagatggctttagatgagatacttggtggctgggagcaaagttttgaggtagtgtatagttttaaagctgagattgagaagagatctcctggtagtatagtggagatagagtatgatgtgattaatgagaagcataggtttagtaggatgtttattgctttgaagccttgtataaatggatttttgaatgggtgcaggccatatttaggcattgattcaactgtgttaacaggcaagtggagagggcagttggcttcagctattggtatagatggccacaattggatgttcccagtgccctatgctgtctttggatctgaaacaaagaaaaactgggaatggttcatggtttgtttgaataaggcaattggatctccagaagtcctagtactgtctactgatgcaggcaagggcatagatgctgcagtgacaagggtgttcaacaatggagtagagcatagagagtgcatgaggcatttgtacaagaattttcagaaaaggttccatggagaagtatttgaaagaaatttgtggcctgcctcaagagcatataggaaagatgtttttgacaggcattttaatatcatgaaagaggcttcaccaagagcaatgcaatggattgaagagaatcaccagcatttgtgggcaaggtctagcttctccacttcatgataaacaacattgcatagacatttaatagttggattaggctagagaagtcactacctatagttgagttgcttgacaagattaggcagatgatcatggagaggatgtgtacaaggcacaaattatctcttaagctgcaaggcaatatcctaggaaatgtaatgaagcaactccatgacaaaagtaggaatctcaactacaatcaccacaagagtctgccatttgtaggtgaagtcagtggtgcaaaaaagggacttgacaacatggagacacactgtggacttgaccaaacaagaatgtagttgcaatgaatggcagctaacaggcctcccatgtaggcatgccatctcttttattggatccctgagagaagtggagctagaagactatgtcagcccctactattcagtggccatgttcagggttgcctattccacagttgtgcctccaatgccagacaagagcctatgggagaaagtggacacaggattcaagatgtggccaccaatactgaagagatcagctggaagacctagaacaaggaggttcattggtgttgaagaaggtggttcaggaaagaaaagaaggagatgcaaggggtgccatggctttggccacctacaaaagacatgcaatgaacctgtatatgacccagatgcccctcccccagctccacccaagcctaagagagttagaaagaagaaatccaagcctaaacaagtgcctactggtggtaacaacactatgtaagtgtgtcatgttttgatcaagttttcagttgccattttgtttttaaaatatttgttcaatatctctttcacaggcctcctcctgctgctgctgatagtgctgatcaagccacatctactgctgcccctgctgctgatcaagcccatgctgatgttgctgatcaaggccctgctggtgttggtgctgctgctgatcaagctcatgctgctgctgctgatcaagcccctgttggtggtgctgcttgtggtgatcaagcccctactggtgctggtgatcaagcccctgcacaagttgctatgcaggtggatgacatccctggactagttacaaggagcaagagtgttgcatccccagaacatgcaagtccatttaaagccaacaaaaggaaggctgtggttaccaggactgcaaagaagctgtaatccaatgctattagagtaggttattttgttgaaatttctagctgaagtagtagcaagacttgtcttttgtgtatatgtgannnnnnnnnnnnnnnnnnnnnnnnnnnnnnattttgcaagccatgactttagctacctatgtatatgttgcaagacatgacttcacctatctatgaaagtcctatggctgaaatggaggaaaatggttgttattcatatagttgctacttcatatgccttatgattctgaaatgtcaacaacaaatatttcttgcattacatctcaattttgggcaaacacaaatatttcctgcaatactgcattacatggttctacttcattacattaagtgcacaaattttgattcatcacaattgaactcattacttcattacatggtcctacttcattacattcatggcaacaaacataacaaaagcagtcacaaatgcaatcccaaacatacaaattctactcattgcctccttcatctcacatcttatcttctcaattccatcatgtagtcctttcaatgaagcct

SEQ ID NO: 5592 - DNA, 1483 bp, Oryza sativa
gtgctggtgatcaagcccctgcacaagttgctatgcaggtggatgacatccctggactagttacaaggagcaagagtgttgcatccccagaacatgcaagtccatttaaagccaacaaaaggaaggctgtggttaccaggactgcaaagaagctgtaatccaatgctattagagtaggttattttgttgaaatttctagctgaagtagtagcaagacttgtcttttgtgtatatgtgaaattgccagctgaaagacatcccttattttgcaagccatgactttagctacctatgtatatgttgcaagacatgacttcacctatctatgaaagtcctattgctgaaatggaggaaaatggttgttattcatatagttgctacttcatatgccttatgattctgaaatgtcaacaacaaatatttcttgcattacatctcaattttgggcaaacacaaatatttcctgcaatactgcattacatggttctacttcattacattaagtgcacaaattttgattcatcacaattgaactcattacttcattacatggtcctacttcattacattcatggcaacaaacataacaaaagcagtcacaaatgcaatcccaaacatacaaattctactcattgcctccttcatctcacatcttatcttctcaattccatcatgtagtcctttcaatgaagccttcactgattctgggacatcatcttctatcctgtgagcattgcaatctgtccatccatgaaggaaaccttccttcaccaaccaaacagcataatccccttgccacatgaaaaacttacattgtgcacttgtctaaaaataacaacaatgagcacacagcttatcaaatgacaaactcgatttcaactcaaaccctagaaaaattggggattgcaaagaacaacttacatattgtccggtgaggcatcgataaaacttgcggttgaaattctcttccttcttgcatgtccgctccactaccgttgaatcgcccttgcagaatggacatttcacaagaggcaactcactgacctgtgaatcacgccgaacccgagaggaagaagcacgtgagaaagaagaagcggaagacatcgtcgctgccaacgagctccctcccctctacgtctaccaaagggaccacgccgacttcaagcggtcgccgcctttgacgaagacgatcctcgccgccgccgtccagctacaatgccagattcactggtactgcttgcgaatggagccaaactgagtggataagaggagataaggcgcaggggtatttacgtccgaccgcgtcaaaaaacagcctcccgtcagccacgtcagcatggcaagtctacgctagacggcgcagtgtccatcagcaaataaccacgattatgggatgtctttccccaaagcttcactttcgcggtgtccctgatctaaatacacataatcgcgatgtcctgtagcaaaatttgccttttttttg

SEQ ID NO: 5593 - DNA, 2598 bp, Oryza sativa
actgcttgcgaatggagccaaactgagtggataagaggagataaggcgcaggggtatttacgtccgaccgcgtcaaaaaacagcctcccgtcagccacgtcagcatggcaagtctacgctagacggcgcagtgtccatcagcaaataaccacgattatgggatgtctttccccaaagcttcactttcgcggtgtccctgatctaaatacacataatcgcgatgtcctgtagcaaaatttgccttttttttgttcggtttgatatttattactccctccatcctaaaatataaacatttttagagccaaaagttgttatattttaggacagaggatcactacaccctgtgactttagaataatttagttcagtttgtttttatatttcctagaataacttagatttgtaccaatgctaggatttgtaggcaatcctataaaaggcaaaatttgtcgtagtacattcggcgaagaaacatcaagtttgaggaaaaggtctacatgcataagagaaaataatttgaagtttatttcgcaacatagtaatgttcagatggtgcgaaacgccacgacaaccgtgttccttcaacattttcatttatttttgaaaatgtcccacggctaaattcaccttgcgacttaactgaaaaatctcagcacttggcataccccgtagtcaatatcataaacacaccgtaggaacatcatgaaaataatgattctaaagtcaaacgcaaaggttaaattggctcgagaaccaccatttgaatatttgatagacaaaaatctggtgcttgttgatcatctcctacagaattgcgcataaagtgaacagaaaggctacatttgacaaaatttcatgtgaagtttacacatggtttctgaaactgacaagatcatgtcatcagggtcaatattcaagagatggcctgcttatttcacccaatagataaagtgctcagctagattatagatcaaaactatgaatgctgaggtttcacagatctgagttacggattactacttcatgcttttggtgctgatgactgtccagaagaaagtctctccgacctcgccttgttagctttttccatgtaatcttggtgagattgatgctttgtccctgcaggatatgcattgcataatcaattaatcaactggtattcatgtaccaaaaatagtattcagaaacttcggtaatttaagggctacttcaacaaaaatcaacatgcattctgaaacaaaaatcagcactaatcatatctgatttttaatgagaaacactttgatcactctgacaatgcagaaatgtgtgttacaaatagctaacagtttagtggcataacaccacttcgaaaaagggacaaaatcaattcgatgtccttatcattaaaaaaacacttcaaaaaggaacaaaggccccacaaattttcaattggtcattagaatttagcagtaaacaaaagtaaaaccagaaagacgataagaagtggagattccaatgatacactaataacaacaccatcatatgcacacattgtcatgggaccagctccagctatatgggtcaaagtagattgtgcaagggaaggctgaaaaagcagtagcatatcaataaatctggattcagtttagtttaaacagcttctttaatttagtcaagtctgatgagattcttatcatcaatatcttttcaattgtttgttatggccatgtctcttaagatcctcgcaagcagtaactgccaacagagtgttttttttctcttggggttgcatgattgtcaacgaaagcaagccaatttggcttgctgcattggtcaagctttatgaacagttaaaacaagcaaacttgcgcacagagttattttagataccaagtagctctctttgctaagttaggttagtatctctcttgcccacgatccaaacacaccctatgacctatgcgtatagcttactgataaagctatacattgtgtcctataagttaacagaagccataactaaatgctgaatggtttgagactttgagtagaacacctgtaaccatatattaagttggggtatcaatttcaatagaaggatatagaaagtgtataacaaattgaaatccaatactacatggtttggaattaatgtgtgctctgtttggttcataagaatatcaaggtaatgacacaacaaatgctaaactgcaaaatgttgctaattcagggttgcaagaagccttaagctataattctcctcacccagtgcacatgcatatgcttctttcattctaaagctgtcaaatgaagctgtcaagcaaaagaaatttacaaaattcagagcatcatatagtgttatgtgtatcaatcaacaggggagcatacgtctcttataattcattatccactaatagcaacttttcatgttcgatttacttccaacttttgttatctcatcttatacttcttactgaccatggcaatcttagaacattgcaaccacaatggtaaagaagatctgaacacgatgtagtaacgaaggcctgtaatagtctactactattatgatttttgtgaagttaatacgttccacataaaatgcttgcattt

SEQ ID NO: 5594 - DNA, 692 bp, Oryza sativa
tttagaaaaaaaaattcaaaggtataggggttgttttgttctcccaaacttgctaaaggttgtcaccccttatgtttaacaagttcaattaataagttagtctattgattcatagtcacgcttgtgataaaattccatttaatttttctggtttcatatgtcaccaactcaaaataatatgttacaatttagataagcaattcaaaaaaagtatgataaatgttggtatccaagcaacctattagtatagcaacctacttgtcgacgggtgatacccgtagaccggatatagagggtattggggtacgttggtacaaggatctacgtagtacaacatcaagcaaacaaaagacaagaattatactggttcaggccctttgataggtaataaccctaatccagttgatgtgggattatatggtagaaaatacaggttacaaagggaacaagggaacttgtcggatccggcgagattgtagtcgagttgtttcgactagctcccgatgacttggctcctcgtaggctccggcttcgtaggctgtgttggttgtgttggccctgagattcaatgccctaaaccttccccggggggtcccttttatattacagatctggaggtcttcacgtagaactcggaggtatcagaccctatacgatacgccaacgacccagttctgcccgagtatgattct

SEQ ID NO: 5595 - DNA, 602 bp, Oryza sativa
atatttgaccgcaacacgcccggatattatgttattatgtttcggcaagtttattatcaagatatatgtttagcccaagtcagttaatttttactactgcaaaaagagttttgcggtatatcaaagggaccccaggttatgttatatggtacaagccagttaagaattaaaattaattggctacacggatagtgattgggctggatgtcttaatgatataaaaagcacatccggatatgccttctcacttagctcaggtatatgctcctggtcaacaaagaaccaaaatattgttgctttatcttcagccgaagcagaatatgtagcaacatcaaaagccgtgtcacaagctgtttggttaagaagaattatggaagacatagacgagaggcttacacaaatttattgtgacggtcaatttgcaattgttatcggtgaaaatccagtcaatcatgacaggacaaaacacattgtatccgggaaacagttgatcgctaggaagttaaattgctatcggtgaaaatccagtcagtcatgagcagttggcagatatatttgccaattctttatccaaagaaaaattcatccacgattgagaaatg

SEQ ID NO: 5596 - DNA, 530 bp, Oryza sativa
gtgataaaaacccttgctccaaaaggataaggaatatgatatgttacattggccatcggcgtttccttgctagggaccatccatggaggagaagcaaggtgtttgatggtaatgttgaaaaccgtgagaagccagagaaatttaccacggatgagctgatggagcaactggagagggtcaaggatgttagaccaggaaagcatcctgaaagcaaaaaaagaaagtgggacgaagagggccaatgttggaagcgaaggtcatgtttgtgggatttgccgtattggtcgagtttgaagctgcggcataatcttgatgtgatgcacattgagaaaaatatatgtgagtacatccttggtacatttctaggcatggctgggaagtcaaagtacagtacaaattctaggcttgatttggaagatatgggtattaggaagcatttacacttgatccgtgatggagattcatatagttctcctcatgccccttacacaatgactaaaacacagaaggctgattttatgattttttga

SEQ ID NO: 5597 - DNA, 6645 bp, Oryza sativa
gcatatgttgctgctgagtgtttgactatttgctcgaagtactttggtgatgatgttgagacacgacacaatcgggagggcagaaatagagagcgtgttgctattgtgaaaaaagacctatctgttttccagcatggagttgatcttcttggagcaccaagtcttacatatcttgaacatgattgtgaaaaaatggtttggttcgtgctaaacaattgtctggaggttgagccatatattgagtatgtcatcgcatctactattttcattgtttcttggatcttacttattagccctaatgtttgaattaactatcatttttaggatatataagaaagagttggagaatgaaggatgtcctaatgttcaaaaaacccttgagaagcaattttctcgctggtttaagaagcacgtgagtttgatctctattactttatttcatcattttcttcctggtttaagaagcaaactttttatgtcaattatttttttgtgcagattacaaaacttcgttacgtggatagacaagacataaatgatgagctatttgcgctgtcatgtgagcctgatctgcgagttcgaatttaatcagcttgacttgtcaacggtgttcgattccacactgtagaccgtgagaaaaatagaagaacacaaaatagcggaattatggttgagggtacacatgataaccaggaaattgacttctatggttccttgaaagaaataattgagcttagatacaatgcagattcaagtggcgataggacggtggttctatttcgatgtgattggtttgacactcatggaaagaagttccgaatgaaggaagatgggttcttcaaaagcataaaccatggcagcttgtggtacaaagatgatccatttattctagcaacacaagcaacaaaggtattttatttgttagacaccaagtatcatgagaaatggcgagttgttcaaaaattttcacatagacacttgtggagtgtggctgaaaatgacaatgaggatatacccaatgctgtggtattgtcctaccaagacgatgattgtgaaggtgtgcatgttcaacttactgaaggatgtctagaaaatgaccagccagttagtgaaggtggttttcgtgttgatgctagtgtagttgatgacctccgtatacaaagagaagcggaagggcaacaagatgagtcgggcgacagtgaagatgaaactggatggcaatatgtgagtgataatgaaggtccaacattccctctagaagatgacgatgatagcaattatgagtagatttagttgtggtttcaatttagttgtcgatgaatgatgacttggactatgtggattattttgtttaaatagcctgtactgcaattgatgctgatgttgtgtgatgctgctgtgttgctggtactactgttttgctgctgtgttgctgcagctgcagctgctgtgttgctcctgctgctgtgttgccgtgctgctgtgctgcagctgctgtgttgctgatgctgttttgctgctgaaattgctggtttgctgcgaatgctgctgaaattgctgctggtactgctgagatgctgttgaaattgttgctgctactgaaaacttgcagatacagctattttgctgcagctgctgctgttttgtggctgttgctattttgctgctacagatgcagctgatgctgtatgatgctctaataatatagaactaattaaaaagtatatatgaatctcaaattattacaatcccaataataagagttttctgaaatttaataaaaataacattgttgactaacaaataatataggtatccacccactaatattggtctccatgacgttgccacaaatgttcgatgagatcctcttgcaaccggttgcgaattgtcttgtcattaatttttggatgaggaaatcagccacctgagtagtttttctctcttcttaatcttcaacatcttcgatcacgccggccacaacttcattgccgccgtggagctcgcccactccatgtgccatggacaagctcgaccatgccttcaccgttgaggggatcacctgaggtacgtggggccgacaggatctagtgacggcggcctccctcgatgccagatctggtgatggcggcctccataggtgcacgggagggggctcctagtgctcctagagggacgagagggaggtcggcctgacgctagatcaatctgagctgttcattttgatcagcagctctttttcccttccccaccacgaactgcctctccccctccgccgctccgtctccgtcctccctgttccctcaccggcggtgcctctccccctccgcccctccctctccctcgccatgaggttgcaggaggactcgacggtggtgggcggcggcaagcggcggatgacgtacttaaaacccaactcaaatacggatctggatttccaaaagcaaacgaacataaaaactgggcacatacacggatgacgtaccaaagtaccagcaaaaacatcttcaatttttataatagtagagatagagattttcccatcggagaaggattgaagcgggatcgatcgcacgcgcgttggatgattttttttggtgacggacgaaaattctcacccggaagccttacatatttttttaagtaggtatagatgtgtaacaatgaataggaaaaaacggggcgtgcgccatatttctattatccttgtaaccttacatattttaatccaccaagaatgttctgtacaacttgaaaataaaaatatgtactgcattgtgaccttgcagatagaattattttagagaccttggttcaatatagtgctgcataatctagagttgacacttgtttatgctgcttgttgctcgctgttgctgcacactcccagggtatcatttgaatgctatttaatgatatgttcatgctcttgtccagagtcaattcacaatcaacacagatgctgatccagtgatagctgcattttctgatttgctcaaaaatggacagcggcagatgagatacaggctaaagaagaaatatttcaatggtataccagcaaatgaagttagaacaacttcaccgctaagctctatgactgacaatgagtggaaacaactcgtggacatgtggtctaccccaaagcataaggtatatctttccttaatatctatcataaatgttgccttacaaaatatgaattgtctgtccagtaatgtttgtctttctataggaaaaatgtataaaaaacaaagatagccgtgagttagttcaataccaccagatgacaggatctcggagctatgttgcacaatgctatgtcatggtaagataaaccgttgcatctctacaaacttttgtgatttttagttgatataggagcttgtatatgtccagaatgtccactagcagcttgtatgtgtcttgagtgggttgaatattcagaactattgtctaatttacagaattgtgctttggtggcgtctcggctaaaatcacccatattcaggatatgggtgattttatcccagccaacaaggtcctgcatgtgggtgattttagacaatatttcagaaaagtagacaacagtttggtgttctatgttttccttgttttggtcataagtggctgctattgttcagcttggcgacaatagtgcagccagcttttgtcgcctgcagctgttgccctccataaatgatgtgttcattgtcaataatggtttgctcgttcatctctagactaagggcattaaattggatttttgagctgctactattcatttaacttttcacgtgcttttagttaacttctttaaaaaaaatatgcttttagttatttatttttctatttgtatgtaatttcaaaagcaaaccaaatttaaggatgtgccaccaactgcgattgatattttcaaggacacccactgcagtagcaagtcaggttttaatgagaacgcaaaggatgccattgtgagtacctttccctatctggttactatgaacaacacaatagattactacatatctccatatggacatcagataatacctatatatattctggacactatcatagaaggttttattccaatcatttcatttcttccactaggttgcatttctatatggacatcattacacatatattgttctgggtacacatacataactagcatagaaaatctgattttttttttggttttattgttgctaggctcaaatggaggcctatgttgctcaaccaacagaagaaggcaaagatccaaagactcctgttgaagctgtagctcatgttctgccaaaatcaacttttcttcgcaatgttggcatgcagtccacagagatgaagaaaaatgccaaagctgctgcaatgaatgatcatgtacgtgagctagagagtgaattgcatgctgagaagatgggatcagccagaatgcaattgcagatagctgatctacataagcaattagaggaccagaaagaggtagcaaggaagaatgaagaagaaactgagaagctgaggcatcaaggaagtgaaatccaaagcttccttcgctccttgtttggcagcaagtttgcatcatcagatgctcagcagtaagctctcatactcaattaggttctagatgatattttggtaacactgaacttgcaaccattgtgattgtgggatgttattttggtgctgttgtgcttctggccgttgtgctgttgctgctgtgcttttggccattgtgctgctgctgctgctgtgaagctattgcaaatatgctgttgttgctctcaatgtagcaggaagatgaaatttgatactttggatatgtattgaattagtggatagatgtactgatattgaattttaagacttgtggaatgtgaaatgcatgtgacattgcaatcatttgtggaatgttaattcatttgaatctgattttgtatgtgctgaaatattgtatctgggctgaattgtatgggctaaaaaaaattagttgagttatgtgggctaaaaaaattatatgggctggaaaaatatatgggctaaattgtaggggctggaaaaatcatatgggctgaattgtgcgggctagaaaaatcatatgggccgaattggtgtgggctgaaaatttgtacaggctgcactcattaaaaagaagcaaataatatgctgggccaactagaaacaaccccagaaaaaaaaatatttgtggcccatgagctacatgggctttagcaggccgaatcttattttgtgacgttttttttcaaccatgtcaactgccaagtcagctgccacgtggcaagccctaggattttgtgacaataaagcaatgtcatatgcttgtgacaatagatgtacaaacgtcacatactaaatttataacggtggctttttgacgtttgaaattacgtcaaccgtttgtcacaaattgtaatttttgacataaatttcacatattatgacataataaaatgtcaaaaagccacacacctcttgtagtgagaggcttcatgtgacggtttgactcatcgggcttctcaaaaaccgcgtctttatgacctaatgagaattgagcaacctcggcttcatccatagcacaaaactccataggcaacatacataccatgttgatatccatgtcttcttctggagatgattcacctttatcaaccgattgctcctccttctcctctacaacaaccggcttttccttctctatggatttatgcctccataccgtggtggtcgtaactcattaaaccttttatctctttgttcttcggcttttttctctcttatctcttgagcccgaagacgttgcaaccttctcttttgagtagccgtcaaatccttaggcatccacctaggattcggctctgttccaggaggtaaataatgtcctctattgattttgcttagagacgatgaagccctcacatcaccctttgcaatcctcctatcaaaccggcgctggagcccggtcagaccggacgtagaccaccggtcagaccggccagatgcgcctgtcagaccgacatttggtgcgggtcagaccggcctgaagcgtcggtcagaccggtgtcggttgggcggtcggaccggcctgatggcccggtcagaccaaccacatggctgcggtcagaccggccagaggacccggtcagaccggccgactgcgatgagctggtatcggcttcggattttttgtttggggacactccaactccatctccagaaggtattggcacatcatgagaccccactttgatagtaatcacctccgaagtcctcacctccaccttgacgcgctttccttcccttttttcttcattagcccgattcttaccataaaaccggctattgttttgtgaagacaaacgctcatgaattggcctcctcggtcctccccacccttgattgaattgcattggaggcatatgattgaacattggtggcgtcgccccccatggcatgaagtaaggataagggtaacccagcggtgggattggataagaaccccatgacatgtcttgtggatgatgatatgaaggggaatgtgaccgtcttggtgaatgaccaaatcgctccctaggaggtgatcttggtcttttccctttgttgcgagccctctcaccaccttgctta

SEQ ID NO: 5598 - DNA, 18278 bp, Oryza sativa
  unsure (1)..(18278): unsure at all n locations
nnnnnnnnnnnnnnnnnnnnnnnnnnnnnnnnnnnnnnagccctctcaccaccttgcttagctccactcttattctctcttccaaacgtcaacctccggcttttttggcactatcatattaggccttgcttcgccaatgaccactcctttttccttagcacatttggcttgctccggccgaatcaactccttatcattgaaattaattgtgttcaccggaaaaggatcatgatcaagcttcatcttggagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatgccctttaggtaatctaatttgtttttcttgtaaaagataatcaaaaatcttatcgcacttggccacatcaaaactatatttaacctcactttgccaatctttgcgaggagtcggcattaggttggagcaaacaaaaggcttgtttttgttagtccatgaccattcagcaacatatatatcatgatcaccctcctcctcactatcgctagcctcagggtaatcaatcacattaacattaggctttttgtcatatgttctaacaagttttttattatccttgacccggctttcttgagccaaagccatttgcataagttgactaacatcaagaaattgttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatgttaaatcacataacctaagctcagtttctccagtatagaaataatcatgaaatttttcttctaattgagcccaagtatgaatagaatttgccggtaaagaagtaaaccatgtaaaagcattaccggacaaagataaagaaaacaagcgcaatttaaaagtatcactattagcctcaccacattgcgccaaaaattgacctacatgctcccatgtggtcttaccatcctcaccactaaacttggtaaattcggaaactctataattacggggaaacggcacattatcataataatcaggatacggctttttgtaaatcctagcacgattcctagtttcaatcccgaatctattcctaataatctcactaattatatcctccatattattaggcccatgttgatttggcggtggatttggtggcctaataggttgtgtttgtggcgcaatatgattatgttggccttgtctaggatcgggaggataccccctagcaacatcattataagcattaggaacatgtgggggaacttggggactacttgtagcagtagatataggcggatcaaatgttctaagatgatacaaataactagcattagtcattggatctattccctgtatcggaataattgtgccggtctgaccggcccagggcctggtctgaccggcatccagaggcgcggtcggaccggcctgagtaccggtctgaccgccggggtaatacccggtcggaccggccgtttggccggtcggaccgacggctaagtcgcggtatgaccggccgtcaggcccggtcagaccggccgtgtgtgccgctccatcggtttttctacccgtttgatctataggaggttggttagcagtggtaaaggctttatcctttgacatgtaatcggccataagagggccgaatttaacccttaaaaactcatcaaacttaccctcaaaagttgcatctaacttatctttaaaagaaatcatagatgaatctattgtagatgctacttgttgttggatagattgtgttacctcatcattacttaccaaatcgggggcgagcttaggacgtggcccgggcttgatgatcacgccttgacgagtcctagtgcttgccctcatcaacgcctcccgtgtgagttcgttgatgtactcctccatagctttgtggtcctctccttcgaaatcctccaatgtgaccagtatcacattggatggctctacctccgtcttggatggcggcttcgtcatggcgaagtcgaagttgagttgacgatgaacggatctcctccctagcggagtcgccaaaaatcgtgttggcaactttttttaacaagttgacaagcatgatcgcagcaccttaagccttgcgatgatcctagagtcgccaaccacctcgatctagcaaagagctaaacctagatgggttttgataactaaaccagctagcggagctgatttctagataactacccgtctcgtgggcaaaacgaaaggttttcaggacaaacctacaaagagatgtcacactctcgcagcggcgccggacggtttacggcgcaaaccgacaaagatggacaaactaagagaaaactaaaagcaatatgaaaaaatgattcgattgattgattgtagattggttttttacaatgaaccagccatgtcccttttataggggttggtcttgccctctacaggccctcctccacgtccaactcagggtagaaaccaaaggaaacccgaaacatgccttcccgagcaaggaaacctcgagacctgacgaaacacagtcggactctgacctgccggtcagaccggcggtgtgtggccggtctgaccggccctcaaccggctgtctgaccggccaacacacggcggtcagactggcccactcggaggaaaccggtagatttctaaattttggcaatctttcctatttttatcccaggtgccaaatttgggtgtaaacaaatatattcctaaaaaattaagaaagtttaaaaaaggaataaaaaaaggccactttgtaccccgccggcctgctagggcatttgcgcatgcagcccatgtaaaccacaggacccaatggtgctgcggcccaagaatggaggcccacccgacgggggatcgatccgagtcgttcattttgatggacggcacggattgatgctgaatccatcaaaacaatcgatgacaagaaccctaaccctaattcacattttcccctcccctccgccttccccactacccccatcaatgctctccctcccaccaccgttggcccctttcctccttgtcgggtgctgctgcctccccgctcctcgccatatatggccttaggaggcggtggcagtgcagctcgaccgagccaccgccggcagccactccgcgcccccttctcgttgaatctggccataggaggcagtggtggcagcttgaaagcgacagcgagggctgaagctcgacggtggcaagctcatactgctcatgtctctggtgaggtttggtgactggattttttgttcgatttgtgtttttttttcccattcaccattcttcaatttttgtattttcaaactgaattttaaagttgattttaagatattttcaatgtagtttctattttagtattaaattttaagtcgctagcaatacatatataaatgttttagctataaattaatttttatctccaaataagttgtttttttgacttattagagaatactgacaaccaatgaggaccttaatctgtgttcgacggtgtgagaaagtgaaaataaatcttgttttctgcatgcatgttacccgaattgataaatgacgtgttttttcaaaagaaaaatctgtagattttttacttaaaaatcatattaattcatttttcaggtttaaaatagttaatactcattaatcatattgtaatgacttagttttttgtatcttatcattgttatcttttctcatttactcaaacactctaaggttgtgttcggcacttagggatgggaattaatccctcgcacacgcaaaacggagtaactcattaacacatgattaattaagtattaatcctattttttgaaaaaatgattaatatgatttttttaaagcaactttcatatagatttagcagtttgaaaaaacacataatttagcagtttaaaaagcgtgcacacgaaaaaaagagagaggtgagatgggaaaacttggaaactaactcagcctaagtggtggtaattttgggataaattttaaacccaaaatagcagcttttttttttggaagggatggagtaaattagcgacctcatattttcgcttatgcttatgcttatcaaccaaaatttgaattttcaacctcaaatttgaagttaattttgaggttttttcatcgaagtttattttagatcgctaagaacacgtatataaaagttttatttgcatatcacttttcgtttgcaaatatgccgtttcacttattcaacgtgaataagcaaaacgatggggctgtagaatgcaaagtgggcccacagggtgtctatgtaattgtttttctcatatatggttcatacgataaaaaaatgttaaaccgtgtgttttttgcaaatgaaaagaagagtaaatcactttgggccattttttattggcgttgtttcgctttgcatcaccctttaaccatttttttacacttttgaccgggttattttacctttatagcactttgtaccaccgtcagttgttttatccatccacatctaaattgtcatatatcaaataaacggtttacatacagctaacggagtttattgacgaataagggcaggagtactcgaggtcattcatatgcatgagaaaagattaacagaggcaagattacccggtctaaagtaaaaacattggtttaagggtgatcaaaagcgaaacatcagtaataaagatggtccaaaataaaatttactctaaaagaaattttatagaaaaaaatatcttaaaaaacatattaatccattttttaggtttaaaataattagtacttattaatcatatgctaataacttgtctcattttacgtatcttaccattcttctcttcgctcaaatacaccctaagggttagttaatttgggacaaattttaaaccgaaataagcagttatttggagatggagggagtaaattagatcgtgaagtgggcccatagctgtacgtaattacttttcgagagaatcccttatatgccactacaaattggccagtccccttatgtgccactcaaaattagcttctcccttttatgccactggttcaagtttttcgccgctcccaacactatagcgttagttgactgttagtcaaatgttagttttttaaatgaccaatatgccctctcaactaaaaaaatgtgtaaatttcaaaaaaatcataactaatttattttaaatcttttttgagtgaacaaaattttgtcagaaccagtgaaaaatgctctttgtataagtattgttggaaaactatatgttttgtgcttatattgaaaatttatttgtgatggtgatggctaaaattgcatgtgatgaaaaaaaaatcaattttcatatgttgtatccagtagctatattagtactaaaatacctaccattggttgtataccaactctcaagggcaaatgcgtctttttactatgaagttagcggtcaactggcggtggagtgacggcaatggcataaaagggaggacaaacttgaaccggtggcatagaagggagaagccaatttgaagtggcatataagggaaccagttaatttggagtggcatataaggaattctatagttcataaggtaaaaaatcgaggaatattaattaataaaataagaggacttaaatagaagaggtagagagctgacatacaaaatctaccatcggtacattaagattatcgtgtgtcctgaaacatatgtgcttccattgtgaatatctcaaaagtacacgatcttcacaagaattcaatgaaaaattgagctaattcctataaactctaccaaaatattagcattaattacccttagcaattatacaagccatacaaagagcacgccaaccagcacgtttatttttccgaagagctggctcttgccttctccaaaaactgttcattacccttattatattgaagacttgctaaatagtacggcatgtgaaacatttacataattgaccgaataaaacattctgcattttagcacattaatatgtttttacttgttggcccattatgcggcaaagccacgtctcttttcatatgttattttgagctcagatttttttttgcaagttttcatttatctaagttatcacaaatgctaccgatcattgtcacttagttaatttatactccatctcatatatatctaagaaatcaaactaattccaaataattatttatgtattctaacgaaaaatataaatattcacaggatatttttagttggtgcgccaaaggcgcaccctttttctagtctactaatctaaagccagcacttttgccgacattccattggtccacgtgacattccattgcacatatatgtagtaattgcttattttatgatatatggagcatcaagatgcagacgttgttgctatctaaaggattgtggtatattgttgagaatggctacaaggagtattctggtagagacactcttacggcggaacagaagaagtctttggtagagtatcggataacggacgccaaggccttgttcttagatcccacaaggagttgcggaaagtctatttccgcgtattatcggggccaagaactccaaggcagcatatgacaagtttgtggtgtgacatttgtcaaaaatctagtcatactgcagatatgtgctggaagaaaatgacctgcaacaaatgcaaacgaaagggtcatattgcaaaatattgcaggtcttgagaaattaatcgggctaatttttcacaagaaaaggaaaaaaaatctgaagaaatggttttctcttgccatactgctcaataagaaaataatgatgtttgggttattaatagtggttgtacaaaccacatggctgctgatccaaatttatttcgagaaatggattcatctgatccaaatttatttcaagaaatggatttatcatatcatgcaaagattcacatgggtaatggctctatagtgcaaagtgaaggctaatgtacggttgttgttcaaacaacagatggtccaaaatttataacggatgttttgctggtacccgatctaaggcaaaatttgctaagtattgggcaacttctagaacacgggtactctgtttattttgaggatttttcttgcaaaatattggaccgtaaaaataatcatttggttgccaaaataaatatggagaagaataggaattttctattaaggatgaaccatccaactcaaatggctctcaaaagtgaagtcgatatttctaatctatggcacaagagaatgggtcatctcaattacaaagcactaaagctactcagggcaaaaggcatggttcaaggccttccatttattactctaaaatccaacccatgtgaaggttgtgtgtttggaaaacaaatacaagcttctttcccacgcagtggagcttggagagcaagtgcaccgttggaactagtgcgcacttatatagttggtaaagtgccaacaatctcagaaggaggaaattggtactttatcacatttattgatgattatacagaatgatctgggtatattttctaaaagaaaaatcagcagccctggatattcaaaaaattcaaggctatggtggaaaattagagtaatcgaaaaattaaagtattacgcaacgatcaaggaggagaatatatctcaaaagaatttgagaaatattgtgaaaatgttggcattcgaagataattaacgacaggctatagtgctcaacaaaatggagttgctaaaaggaaaaatcgaacaattaatggcatggcaaactctatgctccaagacaaagctatgcctaaatctttctgggctgaagcagttaacactgcagtttatattttaaatagtagtcctacaaaggcagtaccaaaccgttcatcttttgaagcttagtatggtaaaaagcctatcattggacatatgagagtatttggttgcatttgctatgctcaagtgctagcacaaaagaaagtaaaatctgataataaaagtgattggtccatatttgttggctatgctgatggtatcaaacgctatagactttataatttggagaaaaagaacattatcatcagcagagatgtgatttttgatgaaagtgctatttggaactggaagtctccagaagcctccggtactccattattgccaaccactacaatcacactaggccaaccacatatgtatggcaatcatgaagtggaagatcaaactccaagtcaagatgcatcaagtccaaggtcaaggtcaagcttcagttcggattcaagcccgagtagtgaagagcaaatttctacaccggaattagctccaagatgtgtaagaagtatggttaaattattataatctacttctcaacaaagagggacaaaacaatatgaattttccaattattctgttgttgagtcactgttttcaagaagcaaaaaaaacataaaaattgggttaaagccatggaagatgagattcgtatgattgagaagaataatacctaggagttggttgatcgatctaaagatggagaagttattggagttgaaatgggtttataagacagctaaatccagatggctcaattcagaaatataaagcaagacttgtggcaaaaggctttatgcaaaagcctgatattgactactatgagaaatatgctcctgttgcaaggctagagacaattcgtacaataattactctagcagctcaaaacaagtggaagatatatcaacttgttgtgaaatcggctttcttaaatggctatcttgatgaagaaatttatgttaaacaacttgaagggtttttagttcaagggggagaaaacaaagtattctgacttaagaagacattatacagattaaagcaaacacctagagcatggtacagtcaaattgataagtactttattcaaaaaggatttgccaagagcataagtgaggctactctatatgtcaagaggctagatatggacattttaattgtctcacactctcactatatgttgatgacgatatataccagtaatagtgagaagatgatgcaatattttaaaaaggacatgatgaatacatatgagatgagtgatatgggcttgttgcactatttcctaggaatggaagtgcatcatagtactgaagggatatttatatcacaaagaaaatatgcagaaaatattctgaagaaaattaagatggataactgcaagtcagttacaaccccttgttgccaaatgaaaagcaaaaggcaagagatggtgctgataaagcagatccaacaatttacagaagcttggttggaagtttattatatttgaccgcaacacgaccggatattatgttattatgtttgcggcaagtttattatcaagatatatgtttagcccaagtcagttaaattttactactgcgaagagagttttgcggtatatcaaagggaccacaggttatgttatatggtacaagccagttaagaattaaaattaattggctacacggatagtgattgggctggatgtcttgatgatatgaagagcacatccggatatgccttctcacttagctcaggtatatgctcctggtcaacaaagaaacaaaatattgttgctttatcttcagccgaagcagaatatgtagcaacatcaaaagccgtgtcacaagctgtttggttaagaagaattatggaagacatagacgagaggcttacacaaatttattgtgacggtcaatttgcaattgttatcggtgaaaatccagtcaatcatgacaggacaaaacacattgtatccgggaaacagttgatcgctaggaagttaaattgctatcggtgaaaatccagtcagtcatgagcagttggcagatatatttgccaattctttatccaaagaaaaattcatccacgattgagaaatgattggagtatgcatgaagtgaattaacggggagtttgatagagttaattcacttctataaactagtaatatgcccgtactaaacgctacggtgcaatttcatttctctttaataatttttagaatttcatgttagcaaaaaaatatttttatatgatctatgcatttgaactttaattcaattcatatcgtacataaaatatatttcatgtaaagtgcagaactatgatattgcgtgggcacaataaaactttacaaggtgaggcccacatgtaagtgataagagaaaaactaaaaagcgtagggcccacttgttagccctattctccctctctatcctttcccccaaaaaaacagcagagcaagcggagacggcggcgatggcagtggtgcgggtgatggcagtggtgcggtggatggcgatggcggtggtgcgggctgtctgcggtgcattatccatttaagttgtatggataaccatataaaaaaataatccagaacaattttgtaagcatatatatatatatatatatatatatatatataatacagaccataattacaatctcaaatgacagcctagtgcaaactgacgcatctagtgcgagatagtatgtagaagataatcacacgacattccatataaaaggtgatggcgtgctgtacaaaacaagaggacgatggtgagtaacattccgatgagcaatttactatattctgcaatatttttttgaattaatttagatcatgcgaacctacctttgctcaccagtcaagaacatctttatacacgatatttctagtgctcttccctgttgaatcaacttctttctttggctttgccaaaatccttgttgttagccttgacacaccccttgacaatgcgacatataggtgaccatgtgaaaacacgggctctggaagatagatcccaacatttgggatggtttgtccttgtgatttgttaatggtcattacgaaactaaaacgtattgggaattgcttcctcttgaatttgaaaggtagagatatatcgtcggagggagacaaagggatccgtgggataaacacccttttgctggcatgttgtccaccaacaatctcagcatcaattgcattatcttgaaaagctctaaccattagtctagtcccgttgcacaatccattatttggattaaggttgcgaagaagaatcacgggacaattgatttttattattagctcgtgtggtgggagaccatttagagtaatagagttaaggtagtctagaggatagctattgtgagggtcatcatcaacagagtcaaagctgtgattaaccttggcctgccctggaaatctgtcaatcatattaacattcagcttgtccacataatcattttttgtggatacaatggcacgtgtgctcatataagatgcagagcttgcattctttttatcatcaaacgagggaaacacatgattaatcaattcgtgtactaaatcctcgctatccccataagcaatcacaatttcatcaggcaaacgaacattatcatttctgatagtgttttcagtgccatttccaattctaaggagatattccgaaaatcatgtatcagattgagccctatgttcaattattgatccaattctaaggagatattccatcaattattgatttgtttcatgatattgaagtatattattcaaagggattgtgactgtttggataacagggagaggcggtgatattttgtcacatcaaattgagattttaaatagcatccatgcattcaaattacagaaaaaacttgcataccatgacttataagcagctccttaatatgtggatatgcacatatacacgtaatagatatgtgacactatagttcacaatcacatccactatttaccagcaaatctacatttgtacttgaatagtattaccttctctgtcgtgcagtggagagggttccggagatcactttgtggtgtcgcagtagagaagggggcacaggggcaaggagtcctggtagttggcatcggcgatctggaggcgaaaatcggcgccaacatatgtttagtctatattggtgtaagcttgaatgaaaagggaaatgcaaataaaaaacatatgagcctataacatttcatcccaaaatataccactgattattgtctagtaatttgttttctcatccttctccaattcaatacatattagagcccaaccataattccataatctgaatctacactaaataacttgaggtatttattccaacacccagcaattcaaggtagctgcccatccagcttcttttacttagcattctactgataaaagaaaaactatcgtggatctctaaaagaaattagagctagcatgactaaaaatccgatatgttttattatttcagaattaattcttggcatgtaatactcaattgtagcagaaaatagcaacagatactgatcattcacgcaataacaatcacaattgaactgtatggtaaattgatatggatcatgtccaagaacccgctgtcaactggaatagaaaatatgaatgaaatgctaatacagggaaagtgctcagttcagagtgaggtaaaaacatgaccaggcagcatttttgggcagaacctcacaaaaagcaccggttgtcctactattcataataagaatatataatgtattgtaattctaaaacactaaccatgattctattaaagcggttgtcaacgtccatggccgccagtctccatccagactacaacacgcacaacagtaacagccaaaatccgtcaaaacaaacataacaaagaagtcagtctctgtatatggctcaaataaggggataaaatcaatattctcaaagatatatggctgtccttagagagtaatagaaaccctgaaaaaaaattgtcctatcaataaaacaggtaaaataatactcctacctgagaagctaatagaaaagagcattcaataatatacacggtcggcgtggaggggcgccggcggcgtcacgcgcgaaggcggggtgtcggaatcgacagatcgacggcggcgcgcggcggcggcgggagagggaaagagtggagcggcgacggttagggttaggcggcgaccggcgttgcgcggggtaggggtgaggagatgcgacgacggcggagaggcagaggggcggcgcgggagaggagagaaatcgaggagcggcggacgcgggatcgacggcgaactggcgttgggatgaactcaagtggggaggggcggcgctgcgtggggcgtcgggcatcgacggggaagcgcgtgattcgggcggagatgggggagcgcgattctggacggtgtttgcgtggacgatttcagccgttagattagatgattctggatcgttggatttgataattcaacaactcattttactcatactcatccatcattggacaaatccgatggcttacattcatctgcgttgattcaacggcaaagatcggtccttgtccacccgcacttttcctttccttcctcactctttcccctaatcactcccggatttccctttcctttccaaccgcgcacaccgacacaccagtacacgaccaaccagcccaacactgtcatgcttgtggcactccacgccggcgagacgccgccgccgtgtcacctgctttgacggctccgcttctttacgatggcctctatcgacgacgcagcttctccgcacgccgctgacatccacggcgagagtccgtcgccgacaccaagtctcctttgtcggatcgtctccccataaccgcgagtccgtctcctgcagccgcacctgccgtcgactgtgtggggatcgattttggagatgaacagtgggcatggcggtggccgtcgttcgtgcttggggggataccaattgcgagcagtgagcctggccttcctatcccatgggccatggcgccgctgattcccggaacagatacccggcggcgcccatgccgcccatctcctgacgtttgcttccacgagtccccacgcgccccagcccatggcgccctcctgtgtgttaaaaatttggttataattcgacatattttaatccaaaatattaagacaataaacatgacatacataattagaagcgatcttgtgataaggctaaacataaacatgagcatgcttaagataaaataagcatagccatcgttgacattcacataagattgaaatcctatggataacattgtgaacatgtaaataacaagaagaaaatcaaataaagttagaatcttatatccagagaatggtgcagaagatattgaggcattcgtattgcttccgttgatgttgtctcctccgttctctcaagtagaagccatggtgaaccagaagtagtggaagatgaaacgttgtcgtcgaagaacgaagaacaggagcagtcgcgcttcaagcgctacccaaaaacttgatcgcccacctacccgtgcaagttctcaagcggacggagtttcggaggcacctgctcgtcccgtacacctgtgcgcgcaggtgaacagaaccggggaaggattctgcagctcaggaacagaggaggaggaactcgaagtgcaagagttgggaagaacttctccacgtccttcacgtcgctgcagagtatatacatatatatatatatatatatacccatatgggactccatggtgcccgggctccaaggtataaaacacacaaaatctcttgaaatttttttaaaaaaataaattgtgagtatatacttaggtatatgaatttgattcataccaatacctaacaacaaaataactcaaactcaactttatttcacaattcattattacatacctagcgaattatatgctttgatgttatataactagaaccaaaatctaacaaaaagaaaagttcaaactcagttcaaacttgtttgaacttgttagtaaagaagttaaagttcatacctaaatatttaaaaaaaattcatactcattcaaattgggtatatactcaattttaatcttcgagcccatactccatgtagcaccagttaaattacctatatatatatatatatatatatatatatgtgtgtgtgtgtgtgtgtgtgtgtatgcgagcgcgagagtaacgttcggagtcatcaaccgccgtgtttaatttcgtaaccgacgcgctcgttagttcgaaatcaattcacggcgtttaattccgtaaccgacgcgctcattaatacgaaatcaattctccatgtttattaccgtccgttacaaagtgagagagagaaaacagctgtagctgcctgcctcgcctcgtcccaccccacctggctgtccgcacaccatctcaaccggtcaacagagacttttcactagttccgtatttaagttgagacctcttcacatagatttccaaggtggtattattacccatagcacttaatgtgggccaatggaatttattaggatttaattgggcctaacccattaatctaacaatccccaccaaatttcatggctcacaagaaatgctctcgattctgatcctgtttgttataccagtgtttcggtggagacttttaagttggacatccacctaggaaaagagctacaccagatcacaactgaacagtggactatgccttgaattatcagtcttgtgcgattcaggtttcactcaaacccttaaatggtactggactatcgtttgcatcccctctgtttggagcatataagtcatactcctggccttttcatgagtatctagagatcaccaagatctcatagactgtgactagcagtcggactcatataggtatgttccttctaagatgttctgtaggccaacatctctgctttatgaaaagccactcggatcacattaaagtgtataccatcctaccatacagattagaagagaagtgcatcatgaagataggctcattttagggtctcttctctcagctacactatagtttgttttgccatccaaattcacgggatctccgatcacaatggacaggtttccactattgtccaactctaagtgggtctcaagcccatctccctcgatgcacagtctatcacattacgtggtagccccttggtaaactgatctgccagattttttgccgtctagacatagtcgaatgctatcactccggagtttttctgctttctgacagacttcagtcttcttttaacatgcctggatgacttcatgttgtccttcgaactgttcactttaataatcactgtttgattatcacagttcatcaggattgctggtactggtttttcaaccactggcaagtccatcaggagctcacgaagccattcggcctcaactgtggcagtatctaaagctgtgagttctgcttccattgttgacctcgttaagattgtctgcttgcaagacttccaggaaacagcgccccctacaagtgtgaacacatacccacttgtggcctttatctcatcagcatcagatatccagtttgaatcactatagccctccagcacttttgggtacccggcgtagtgaatttcatagctcattgtcccttttagatagcgcattactctttcaagagcatgccaatgatcatctcccggatttaaaacaaaccggctcaacttgctcacagcaaatgagatgtcagacctcgttgcactagctaagtacatcaatgaaccaatgatctgagagtatctcaattgatcccttgctattcttcggtttttccttaatagcacactgggatcataaggagtaggagctgccttgcagtcactataaccaaagcgactcaagaccttgtccacatagtgagattgcacaagtgtaatcccaccctcatctcctctcagtagtttaatgttaagaataacatgtgccactcccaaatccttcatttcaaagcttttggacagaaagtccttgacctactcaatcacattgaggctggtcccaaagatcaatatgtcatcgacatataaacacaagatcactccctctaccccaccatagcgatagtacacaatttgtcagcttcgttcacaacaaagccagcagatgtaagtgtattgtcaaactctcatgccattgcttaagcgcttgtttgagaccatacaaggacttcaacagcttacacaccattcccttctgaccttctagtacatacccatctggttgatccatatagatctcctcctccaactctccattgaggaaagctgtcttaacatccatctgatggccgagtagaccatgagaggctgccagagcgagtagtactcgaatcatggtcaagcgagcaaccggtgaataagtgtcgaaaaagtcctcgccttctttttgggtacaacccttggccacaagccttgccttgtacttttcaattgtatcatcaggcctaagctttttcttgaaaaaccattcgcattctacaggcttgcacccatatggacgctcgacaactttccaagtaccattagacataattgagtccatctcattgcttaccgcttccttccaatagtcagcgtcaggagatgaatatgcctcttcaatggttcttgcagtatcatccacaagatatacaatgtagtcatctccaaaagactttgcagtcctttgtctcttactctttcgagttgctacaatgttatcctcctcaggattttcctcaagcgtttgatcaatatgttcttcggcacaaagtgctcaggggataaaataggttcttgactagaagtgctaggtgcatttttcataggaaattcattctaaaaaaatgtggcatctctggactcagtaattgtaccaacacgcatgtcgggtaatccagaatttactattaagaacctatatcccacactgtggatagcataaccaaggaacacacaatctacggtctttggtccaagtttacgctttttggctataggtacatttagcttggccaaacagccccatgtgcgctggtgagagagatttaatttcttcctttcccattcctcgaatggtgttacttccttatgcttagaaggaattctatttaggacatgacacgcagtcaatattgcctcaccccaccattccttggaaagtcctgtagtgtctaacatggcattcaccatctcagttagagtgcggttctttctttcggctacccgtttgactgggtgaatagggaggcgtcttatcatgaataattcatactcttcgcagaaagaaataaattcatttgaaaa

SEQ ID NO: 5599 - DNA, 7701 bp, Oryza sativa
gtccaagtttacgctttttggctataggtacatttagcttggccaaacagccccatgtgcgctggtgagagagatttaatttcttcctttcccattcctcgaatggtgttacttccttatgcttagaaggaattctatttaggacatgacacgcagtcaatattgcctcaccccaccattccttggaaagtcctgtagtgtctaacatggcattcaccatctcagttagagtgcggttctttctttcggctaccccgtttgactggggtgaatagggaggcgtcttatcatgaataattccatactcttcgcagaaagaaataaattcattggaaaaatactctccacccctatcagacctcaaccgtttgattttcctttccagttggttttctacctcagccttatagatcttgaagtaatgtaatgcttcatcctttgatttcaataggtacacatagcagaatctagtgcaatcatctatcagtgtcatgaaatatttctttccccctttagtcaacacgtcgttcatttcgtacagatcggaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagcgtgtcatacaaccaaaattcacatgacagagtcgtgaatgccacacattagactcatcatcatcattgcttacatggttcacaactttattacacatatcatccaaggaaaagcggaacaagcctccgctgtcataaccttttccaataaacgttccatatttagatatgacacatttattggattcaaacacaagtctaaaaccatctctacacaatagagagccgctaactagattcttctttattgaagggacatgctgcatgttcttcagctgcacgatctttcccgaagtaaactctagatcgaccgtaccaacaccatgaatagccgcaagcgatccgtttcccatcaacaaggagaaacctctcccgacctgataagaagaaaacatggaaatgtcggcacacacatgaatattagcaccagtatcaacccaccaatcaggtgagtgacagacagagagaactgtaggtaaaaatttaccatacctcgatgttcctccgccctcactaataaccatgtttgcagacttcttgtccttgcgctcaggacaatccttagcccaatgcccagacttgccacacacaaagcaacctccttttgcctttctcttgcctttcttcttaaaattggttgtagcctgggtttgacgtcaggtttgacttttttgttgttgttgtgggatgcgtgagggtcttcttctacaccaaattggcgctagaacctctctcgatctttttgccccggttgtcctttaccctcgcattctcctcaacacccaaagagccaataagatcagtaacactgaactcttgcatcttgtgttttagagaagtagcaaagtccgtccaagaaggtggcaatttgacaataatgccacctgtcacaaacttgtccggcaactcacagttgttgttctcaagttcctttgccaacatctgaatctcatgagcatgttccactacagaacgatcatcgaccatcttgtagtcatagaactgctccatgacatacagctcgctgccggcatcggaaaccccgaacttggcctcaagagcatcccacatgtccttccctgaaggcatgtgcatatacacgtccacaatattgtcggcgagcacactgatcaatgctccacagaacaagcaatccgcagccttgaacttagcctcctcctcaggtgagagaggcggttcactcggtttgccccgtgagacaaacaaacaatgcatcgccgtcaaccacaaaagtgcacgtgctttccatcttttataatttgaaccatcgaaagcatatggttttagtgatgcaacaaagtcaactaccgaaaaagacctatcaagtttttggattgttggaaatttggtcataattcggcatattttaatccaaaatattaagacaataaacatgacatttgaaatttgagtagatctagcgacagtgctagatgtgtaatagtgaaacgttgtaccccgagaatggccctccgttggagtttgaggcagtattgcctccgttggtgttgacgagaggctccttctccttgtctccagtgttgttgttgtcaccggttgtcgacatgttggtgaagatgatgtagagcagtcgcgcttgaagcgctacctaaaaacttgatcacccgcctacccgtgcaggttctcaagcggacggagtttcggaggtacctgctcgttccgatcacccgtgcacgcgggatgaacagaaccggggaaacaaagagacagcgcaggaacagaaggagagtatcgccaaggaacaatagtaggaggaagacacacactttgacagcctttgccttgcgttatatgtagagagagagatctccattaccacacaaataaatctcatttgttgtgaaggttaccacaaaattaatctcatttgttgtgaaggttaccacataatgaatcttccatttgttatgaaggttacaacaaataaatctctcatttgttgtggatgttacaacacaatgaatctctcatttgttgtggaggttacaacacaatgaatctctcatttgttgtggaggttacaacacaatgaatttcatttgttaatggtgactttattctcatctgttacaaaacgaaagagcagcaggcaggctcggctcggtcggccgcctcgcctcgctacgcccacggccgaggccgactcggcatgcgcgcatgcgtgtggcagtccaaccatcacctcaaccggtcaacagggaatctctaatatcaccctatttaagttgaggttcttccacctaaattttcaagccagtattattctctctaacattacttgtgggctcttgagattttagttgaattaaattgggacatatgagacaagaaagttcgcttcatttgatggcttttaacatgatttcacactttttcctatggttcgtccagatgagtacaggcctagcagtgacttccatgcatactcttttcatgtcatcctaccataccctctgatttggtcccgttagtggatacaagcctaggcgagattctcgctctcaggttcggtcctctacgagcggatacaaatcacggatacaaacataaattttgcataattcaccataaattaaacaagcacttgcttcggtcatgcttcatggcttcgagccatgctagtagtgatacaggcatagtgataaacaaaattaattgagcatactaattaattagcacgcacatttgctagttttgacatatgttcagccatatttctctaacaagaattaaaataaaatggcgtttattttctttccgtggtcagagataggaaatagatgtgcgcatgcatatattttctccttccatctattcatctacaaaatgttggataaatcacgaactacgccgagtcatgacggccggccataaaattaaccaacactcgcttcggttacacttcacggcttcgagccatgctagtagtaatacaagtggagtgaaaattataatctcaaaatcatctgcatacatatatttgcttaaaacagtgtatatatactcactgcaccatatataaagtgtagtataaaaaataatctgatatacgcacatgcatgcatccatatactctggccgtgcattttccttccaattgcaaattaaccatgtacgcacaacaagtggcgacatcgtgatagtcgaccataaatcaaacaaatacccacttcggttacgcttcatggtacagggccatgctagtagtaatacaggtgtggtgaaaatcaaaataggcaatgcaatgtgccgcaccaaaatccagtgacatgttgataataatggcgctaaaataaatactcgtttggctacgccccgcgagtgctcaggaaaaatttatatatgcgtgctacatataggaaaaaataaagtcacaatgccaaacaaggaagctatgtataaatttgctaccatacacgcagtgatattaaaaaccaacaaattagtgggcatctaaaatacttggacgcccaaaataaaataaacatataaatggaaatctacagaagattctacggctgcgacatctggagctttaggatagattttcctttttagccttttagcggtcatgtaattttattttctttcatgttggaattcctaatcaggggttttctctacggagatgtaattaacagaatttctatgtaaatgtatgaattctggaagtaatggactcgcaatttctgatttttatttatttattgcatttaaatcaaattgtctgtaatgatttgtagatagcagacctactattacgactgtcccggttttcccgtcgtcagattctggcacgcccggtgggacatacttctcccctcatctctgagttccaacatgtagaccgcaaatatgcaaaaaaaaaaggagataaatgcacatatccttagtagaaaaattcacgtactcatgtgcttcatccaaagcgctttatgaaattattatatgcatgctatggttttacagaaccagatcggttactcaaggagagggacctaaaccggtcaaatgtagtcattcacggcttcaaccaagcaggccaagaagccttgagcactatatcgttggtcctaaaactggaaccattgtccacctatgtgaccttccgtataattgatgccactacttcatataacgcgttacttgggcgcccatggctgcacgagaaccaagtagtgccatctactctacataagtgcatcaaatataaggataaatcaggagaaactgtgagaattttcgccgatgaaaggccattcacggtggctgaatccttttacacggatgctaaattctacattgagcccatcgaaaagatacagaaaccaaaagcaaagtcgctaacagaacatttcgtcacaagtggaagttatggtgaatcgtcttcaaaccggaaaatataccaatatataccaagcaaccggagaaaggagggtgagccaatatttcgtataatgaataggccatccgctagcaaagcaaatgggatatgacacccttaccggaccatctctatgtgatggccgagggcagctcgcgccgttcgagaaaatattgtctcaagcacagctcgaagcgttgcagcaagataagaaattaaaagagaagaaatatggacttggttatcaggtttgcaggacctcagccaagctcgtggacgcaacgatggcatctccacaaatggaggatgggaatcaacccaccatcgatgaattggaagaaatagatattgggacacctgatatcatcgcccaatttttattagcaagcacctatccgaagaaaataagaaaaaaataccataactttctttcagctaacaaggacgtgtttgcttggtcttatgaagaaatgcctggtttaagccctacggttgctgtccaccagctagctgtgcaggaggatatccccccggtcaagcagccgcagagaaggttccgaccagagctcctcccaaaaattgaggccgaggttgacaagctcatagctgtcgggtttattagagaagtcaaataccctacatgggtctcaaatattgtacctgtaaggaagaaaaataaccagatccgcgtatgtgttgattttatagatttaaataaagcatgtccaaaggacgacttccccattcccatttccgaaattctgaatgatgccactatgggatatgaaatattctcctttatggatggtttttcaggatacaaccaaataaaattagcaccggaggacgaggagttaaccgcgttccgaacgcctaagggcatatattgttatgaagtcatgcccttcggattaaaaaacaccggcactacttaccagcgcgccatgacagtcgtcttggacgggttattatatgaaattgtcgaatgctatatagatgacatcgtcatgaaatcaaaacgcgaagaagatcatctgcaacatttagccatagtgttcgagaccctcagaaagcacgaacccaaaaggaaccctatgaaatgtgcatttggtgtattgtccggaaaatttctcggatttatagtcatgaaacaaggaattcggatcaacccgacaaaaatacaagcaatagtgaaaatgccaccacccgtgaacctacataagctgaaaagtcttcagggtcacttagcatatattaggcgttttatctcaaatttatcagggagatgcaaacctttttcccgcctgatgaaaaaaggagttccatttcagtgggatcaagcgtgtcaaaatgcattccaagatattaaaagatacttaattaatcctccagttttaagtgctccagttaaagggcggcctctcatactatacacggctgcgatgcctacctccctaggtgcactgttggcacaaaataatgatgatggaaaaaagacagcattatattatctcagccgcacattagtgggggcagaatgcaattatttagacgtggaaaaaatatatctagcgcttgtcttcgcagcacaaaaacttcggcactatatgctagaacacaccatacacctcgtgtcgggggcggacccattctgatatatattgagtaaaatggtcctctcaggaagattagctatatgggcgatgtttttgtcgcagtttgacattatatttgtcccacaaaaatcaataaaaggacaagccttagcaaacttcctcgctgcacatccaattccggatgagtttcccattgatgacgacttacctgacgaggaagtatttgcgacctcaatttttaacccatcatggaaaatgtattttgacggcgcgcgtcgccggtcgggggcaggcgcgggtgtggtttttgtcacacccaacgaaagcataattccatattcgttcactttaacgacggcagtgtctaataatgctgctgaatatgaggcactgattgtaacacccaaaaaaaaaggtttggttgttggttttgagttgctttacagaagtaaataagttcgatagaaattaatggtagaaaaaaaaatacctatagaagtggaccaacctgggaaggcccataaacccagcccattgtttcttctctaataccctagaggaggaggggccggattcccccttctttccccccaaacgacgccaacactgctgccccctccctcctttgtacggtcttgggtgttctctcctctccacgacatttccacttttatagatctgttgcgtcgtatgatgaatcaagaaactagttgtaaaaacggaatgagaaagaggagaggaacaagaggagtggtgaattggggtttcccgccatccttattcttgttctccataaaaccttaggtgagatttccccactggtttaatgttgttttggggtgttttagagtggcaattcggggtaattagggttaagataagaaggttttgttgctatgattcgaattggtaattctactctcgggaagatttaggaatgtaccacccaaaaaaagggttcgggtgttggttt

SEQ ID NO: 5600 - DNA, 11138 bp, Oryza sativa
tacctatagaagtggacaacctggagggcccataaacccagcccattgtttttctctaataccctaaagaagagggggccggattcccccttctttccccccaaacgacgccaacactgctgccccctccctcctttgtacggtcttgggtgttctctcctctccacgacatttccactttcatagatctgttgcgtcgtatgatgaatcaagaaactagttgtaaaaacggaatgagaaggaggagaggaacaagaggagtggtgaattggtgtttcccgtcatctttattcttgttctccataaaaccttaggtgagacttccccactgttttaatgttgtttttgggtgtttttagagttgcaattcgtgggtaattagggtttagataaggaggttttgttgctatgattcggattggtaattctactctcgggaagatttacgaatgtaacacccaaaaaaaaggtttggttgttggttttgagttgctttacagaagtaaataagttcgatagaaattaatggtagaaaaaaatacctatagaagtgggccaacctgggaaggcccataaacccagcccattgtttcttctctaataccctagaggaggaggggccggattcccccttctttccccccaaacgacgccaacactgccgccccctccctcctttgtacggtcttgggtgttctctcctctccacgacatttccactttcatagatctgttgtgtcgtatgatgaatcaagaaactagttgcaaaaacggaatgagaaggaggagaggaacaagaggagtggtgaattggcgttcccgtcatctttattcttgttctcataaaaccctaggttgtggtgctccggatcatgcttggtatcgtctctttattgttcgagtcttttcatgtatttgctgtgacatgtttgcatgaaaggatgggattagctacacagtcgcacaacatgatctcacttagtcatgagtattgtaatatgctgataagattacttgtgtttagaaataatgggctaattaattactagagttgttgaccattggttaactacttttttcaagcctatccctacatgtcagtcaattgttgtatcataaacttaatctatatgttgatgcttctgcgatgtttttttttctaaggtagttgttaccgaaatttgcttgttttggcacttatgtgtggttgtttagtggcatctagacttatgtggttttctggggtgttacactgataatcggccttgagatagccttgaatatgcggctagacacactctatatatgatgattcacaactgataatcaaccagcttgctggaaaatacgcagtaaaaaaggaaggtttaatggcttactccctccatccaaaaatgtttgacaccgttgacttttttaaatatgtttgactgttcgtcttattcaaaaaatttaagtaattattaattctttttctatcatttgatttattgttaaatatccttttatgtatacatatagttttacttattttacaaaagtttttgaataagacgaacggtcaaacatgtttaaaaaaatcaacagcgtcgatttaggaaaggagggagtatttcacgagagcaaaacaactcatggccatgttcgcaaatctaaatatcgaacatgttgttagaagtcaaaatgagagagttgacgctctaaccagcttggctgctagcatgtcagtcaattcttattaaataatggacattcaagttgagcagcgtagagtattaccggtactcattgaaaaggaggaagaaattccatcggcagctatgataaccgatgttcacgaaatagaggcaggagattggagaactcccctcctggaatatttattgcacggatatttacctttagaagcatccgaaagatctagaattagaaaaagggtgactcgttatacgtgcattaatgacacgttgtactgacgtgcatacgacggaatgctactgcgttgcatcgcgggtgatgaggtcgtagacgctttaaataaagtgcatgctggagtttgcggtgcacatcagtctggatctaaattgtactatcaattaaaacacttaggttattattggccgactatgtttgaggattctatgaaattctcgaagaaatgtcatgagtatcaaatacacgctgactttatccatcaaccacatgagctgctgcatcctactaacatggcatggccattcgaaatgtgggggaatggatgtagtcggacaaattcaaccgccatcatctaaaggacataaattcatcctcgccgctaccgactatttctccaaatgggcggaagtcgtgccattgaaagaggttaaagctgaaaatgttgaaaattttattaggacacatctcatataccgttttggcatcccttctcggattatgtccgataatggttctccattcaaaaatgcactgatcgaaaagttgtgcgcgaagtttaaaattaagcataatttctccacagcatataacactgcggccaatggacaagcggaggcgttcaataaaactctctgtaaacttttgaagaaagtggttacaaagaataagcgagactggcatgataagctgctcgaggccctgtgggcatatagaacaacaacacgcacgccgaccggaatgactccttactctttagtgtttggaggggaagcgatcttacctatagaagttcaaatcccgtcactgagggttgctattcatgaaaatatagcagaagtcgaagcggcaaaacaacgcggaaactctaatgcgcgatcgatcgctaccgcgatcgggtagcgatcaccacctctcccccctccctccctccatgtttcattttttggcaccgcattactttcctattttagtaaatttatgtacctaaagtttatacacctaaagtttatagacccaaagtttataaatcaaaagtttatatatccgattcaaatttaaatttgaattcaaatatttttatagtatttttatacatctaaagtttatagacctaaagtttacaagtcaaaagtttcaaatttgaatttgaattatatccgattcaaatttgaatttgaattcaaatattttctatatatagtatttctatacatctaaagtttatacacctaaagtttatagatacaaagtttataagtcaaaagtttacataccgattcaaatttgaatttgaattcaaatattttctatatatagtatttctatacatctaaagtttatacacctaaactcaaagtttataagtcaaaagtttacatacccaattcaagtttgaatttgaattcaaatttttatatatagtatttctatacataaatttttctaactttttgtttttttaaattttttttgtggtttactgtagtagaaggggaggaggaagaggggagagagagggggagtagggggacggaagggtgatcgctggagcgatcacccgcccattaggcgtgcccaaaacaacgcttagatgaattagagaaattggaaggtaaaaggctgcaggcgttacaaaatttggaagcctatcaggctagagcatcgcgagccttcgataaacggctcaaaagaaggtcattcaaacaaggagacttagtgcttgctcttatccgccctatgaatattacacatcgaatgtagggaaaatttgagccaaaatgggagggtccctatgtcatgaggaagtagcgcgtacaggatcatctcgccggacggtgaatattatccggcacctataaatggaaaattcttgaaacgctattatgcataaaaaggataaaataaaaataataacaaataataatgaaaatactgcaccaagatctcaagtgcctaaactgtgcaatatataagaaataggggtgtgtgtgtatataagctaaaaatgaatcatacacactccatcactaaaataataataataataataataataataaaacaaacgctccatcgccgcacgagcttaaactgtaggcgacgaaaaaaaatcactcgcgctccatcgcagctcgagtttaaactgtaggcaacaaataaaaaataatcacacacgctctttagctttacaggcctacactataagcgtaaaaaaaacaaacaaatcacaaacactccatcactacaagtaaaaaataataataataataaaacaaatgctccatcgctacacgagcttaaactgtacgcgatataaaaaaaaatcatgcatgctccaccgctgcactgcacgagcgtaaactgtaggcgacaaaaaaaaaagcccacggctccatgagctcaacctctgggtgatatgtttatacatgtatatgtgggcttaaagactagtaaatgatgatagttaataaagttaaaacaattaaacactccaaagcctcaggtattcggagtgtggcgtacatgtgcaaatactgacaaaattaataaaattccccaaagtccgcaagtgctgaccaaaacaaattgcagcacagagtattgaccttcagagtcaagcaaatgtgctccttaattttctcaacaacgtttcttacaacgggcacaggaatagttgtgactataaacctcacgtgcaacaagtccctacgaatccgaaattatatgtcgagctccggatgcaaaaacaaaattttgacacccgcagctcgagggaggatctgttgacaccaatttcggctcgtgtcttaaacaaggtatattcgatataaattaatgtataatctcaaatataatgtaaaaatataataaaaaataaagaaataaaagtggaaataaacagtcaaaacagtcaaatgaataaatagagtaaaatggcgaccaaaaataaatgtccacaatataaaatctctcatttgttgtagaggttacaatacaatgaatctctcatttattgtggatgttacaacacaatgaatctctcatttgttgtggaggttacaacacaatgaatttcatttgttaatggtgactttattctcatctgttataaaacgatgttacgaagagcagcaggcaggctcggctcggtcggccgcctcgcctcgctacgcccacggccgaggccgactcggcatgcgcgcatgcgtgtggcagtccaaccatcacctcaaccggtcaacatggaatctctaatatcaccctatttaagttgaggttcttccacctaaattttcaaggcagtattattctctctaacattatttgtgggctcttgagattttagttgaattaaattgggacatatgagacaagaaagttcgcttcatttgatggcttttaacatgatttcacactttttcctatggtctggccagatgagtacgggcctagcagtgacttccatgcatactcttttcatgtcatcataccataccctctgatttggtcccgttagtggatacaagcctaggcgagattctcgctctcaggttcggtcctctacgagcggatacaaatcacggatacaaattgcataattcaccataaattaaacaagcacttgcttcggtcatgcttcatggcttcgagccgtgctagtagtgatacaggcatagtgataaacaaaattaattgagcatactaattagcatgcacatatgctagttttgacatatgttcagccatatttctctaacaagaattaaaataaaatggtgtttattttctttccatggttagagataggaaatagatgtacgcatgcatatattttctcattccatctgtttatctacaaaatgttggataaatcacgaactacgccgagtcatgacggccggccataaaattaaccaacactcgcttcggttacgcttcacggcttcgagccatgctagtagtaatacaagtggagtgaaaattataatctcaaaatcatctgcatacatatatttgcttaaaatagtgtatatatacttgttgcaccatatataaagtgcagtataaaaaataatctgatatacgcacatgcatgcatccatatactctggccgtgcattttccttccaattgcaaattaaccatgtacgcacgacaagtggcgacatcgtgatagtcgaccataaatcaaacaaatacccacttcggttacgcttgatggtataaggccatgctagtagtaatacaggtgtgccgcaccaaaatcccgtggcatgttgataataatggcgctaaaataaatactcgtttggttacgccccgcgagtgctcaggaaaattcatcaatttatatatgcgtgctacatataggaaaaaataaagtcacaatgccaaaaaaggaagctatgtataaatttgctaccatacacgcagtgatattaaaaaccaacaaattagtgggcatctaaaatacttggacgcccaaaatgaaataaacatataaatggaaatctacagaagattctacagctgcgacatctggagctttaggatagattttcctttttatccttttagcgctcatgtaattttattttctttcatgttggaattcctaatcaggggttttctctacggagatgtaattaacagaatttctatctaaatgtatgaattctggaagtaatggactcgcaatttctgatttttatttatttattgcatttaaattaaattgtctctaacgatttgcggataacggacctactataacgaccgtcccagttttcccatcgtcaattttctatatggatcatctatgtgatcctaatccatgcaagatttgggactaactatttgattgctcctgaactgatcttcagaaaatactctactgttaggtgttagattcagaaatgctgtcttttccggtttgttgaaattagttccaatttgaagaaatcatgtttgacttttagtgattgaattaatttagtggcagagaaattagaacaatagcctagttaactactttttctcaggaagtatttaggcccttcatcagtgtatttgcagaccttgctgaaacattcaggccatacctcctggaaggagaaaatgttgctgcgcagccttgctgccctcagatgttctttatacactgatgaagaacaaaaaaacatagagagcaaaaaaaaaagataaaattttgatagaattataacgttaaaactgttagatttttttcgacggataaaatataatgaatttgaggttaagattttacacgtaagtataatactattgaaagtacatgcattattttttctagattttttggtgatatttattagttggtatgtacggtgtatacaagtgagaacttgtgtggataggatatgtttccaacttgtttatgcccacatgttaatggaatagctcttcatcaatctatttatgtggacatatgttgtcttaaaatatgtattaaagtgactatatataatggtgaatgttcttaattattttttctagacaatataatatttttgcattttgtcttaaatatatttttttatatgatcgcttaattggatcgattctaagaaaatcaattttactgtcatcaaatttaatgatttattaactaaaatattatgtcatcgtagcgtagcacgggcatattactagtaggagtgtagttggtgaattatagggtaggtttgtagatgtctctctaagactgtgtttagatccaggagtgaaaagttttagcgtgtcacatcggatatacggacactaatttgaagtattaaatgtagactaataacaacacaaattatagattccacctataaactgcgacacgaatttattaagcatcattaatccattattagcaaatgtttactcagggccgtgccatcaaatttgtaggccctgtacaaggctctaagtgaggcctaaatcaagtaccaaatatagctaaaataatgtatatactgcagagcaaatgcgatatatcaacaacagtacatttttgaactcttgttttataatcagaaactgtcaaactgaaaatggagaatgttcgttgctgttgctagcttgctgcctagtgccttgcttgttggttgcttgctaagttgctatatgctagatgaatgaaaatatgaaattagatgagccggctagcggcctggcgctcagaagagacgagacgtcgagactcgagacgaactgaataagtcacagatacgaaaaagaaatacaatacaaaaagccgtgaggcctcggggctcggagtcgagaatacgaagcgccacgcatgtgaagtcgccacgcggagatatgcgcgtactcgaacggggttctggcgctctggcctcacacgaatacatgggccttctctggttgggctgattttttgaggccctggaaatttggagaccctgtacggtcacacaggtcgcacgcccttctgcatggccctgtgtttatgtgtttattgtagcacaacattgtcaaattatggactaattaggtttaaaaaattcgtctcgcaatttatacgcaaactgtgtaattaattatttgtttatctatatttaatactctatgcatatattcaaacgtttgatgtggtaggataaaaaaatttaccagggaactaaacaggccctaactctccctaccatacttgatactagtaccaaaagtcaatgtgcagtacaaccattatctgtaaaaatctagagaaagtgtagactctccctacatgtatgcagtgtagtagtactaggagagtactagctaggatgggtagatttcttcggcttctaccatagggtgtgttcgctattcatggatcccaatcggatccttccacacggaaaacggagtagttcattagcgcgtgattaattttgtattagctttttttaaaaatagattaatttgattttttaagcaacttttgtatcgaaactttttgaaaaaaaacacgccgtttagcagtttaaaaagtatgcacgcgaaaaacgagagagaggttaggaaaaggggcatccgaacactccaatagagtgtcttcgatactcacgtttgggaacggtactctctaccacggaaaacggattagtttattagcacgggattaattaagtattagctattttattaaaaaaggaacaatatgatttttaaacaacttttatatagaaatatttttaaaaaagcaccgtttagcagtttgaaaaacgtgcgtgcgaaaaacgagaaggaggggttgggaacccggaaaaaccaatgcatgtgtaagtgcctgatgatgtatccattcatcaaacaagcaagctactagtagggcctctcacagtgcaagctatgtcgcccgtacccctagcccaaaaggttggtccaaaaacacccacctcatagtgcaagcacccatatatgtatggtttaattggatgaaggcactagtaaaggtaccaagcccacagtgggtgtgaccctagacgtgttaccacacatttatttctctcaattaccctcgcctgctactcacgcgagtattcttctcctctcctcggcgcgaccgcctcctcctctctcccgcatcgccgcgcctcctcctctcctgccacgccaccgtgcctcctcgccttcccacgccacggcgcggtccacggcgccgcctcgtcgcaagaaaccacgcgcgcaccggcgagtctttcccctccctctctgtcccacgctctgcttctcctccctcacacgcgccgaggaggaagcgggcacgggagaagggcggaagcaggcggcgtccccggtgacggcggtccggagtagggcggacttcgccggcggtggtgttaacgaccaaatttgataagatatgaaccaggttcgacattggaatcgaagcagattcggcaaagagatggattcgaagaacagagtgtgcatcggttgtgaagacatcggttggggtatgcatcggctgagatggatcggttagaggatggctgatgcaaccaatagagctgatatagctgatttccgatggagatagcttcgaggctgtttctggaatcaatcgatgtgcttaacaaggattgccacaatggagataaagctctcagataggcaattgtatctattaattaggatatcttatgtaatttctttagagatatgtttgggcaaaagtctgccgcaaagacttatagtgtcttagagtttgttagagatagtagtcgtgtccggcaatgacatattttgtatctcgggtataaatatgacccgaacccatgtaatcaaacaacacatgttcaataacactttcggcgcatcgccacccttttactttcgttctattttgacgagttcttgctttcgggttgagctgcatcgattcaatcttcaactagaggtaaacttgtcatgacggtttgcgttctcaggattagtgcttccatctttataacactctaatcttgtttatgtaattttttgagttatcatatatactttataatctctattagtttcgctatataacttgtcatcggctagtttttactgttagagagtagccgatagagttagatctcattattaatctagattataccgtatatctaccatctcttataggttttcatcatcttgtttagatcttacagttatctttatgcttaatgctgcatcggttgagtttgatctattaagtttatctataattgtgatatctagcctgttttatgatcatcaatagagatagtatcagagtttcagccgatcttacctgatttagttattcttatctcatatgcttgtttgttatgctaaatctgccctttatattaagatcttgttgcattgaagttatattaggtttattatttaatatatcttgcttgtctcaaatcttgatatagagtggtatcggagtattagccgatacatggtagatctatctgatcggctatgctataaacttctatataatctttgcttaatatatatttcgacttaagtaatttatactgtcttggcatgatgaccgatctatcccaatcacttagttcaagtatataccgaagtaaagattatatgttgttaatatctacagccgattgagtagatttagttttatcatttttattcattattgccgatcgagtcaaacatgacat

SEQ ID NO: 5601 - DNA, 15167 bp, Oryza sativa
  unsure (1)..(15167): unsure at all n locations
ttataacactctaatctggttgatgtaattttttgagttatcatatatactttataatctctataagtttcgctatataccttgtcatcggctagtttttactgttagagagtagccgatagagttagatctcattattaatctagattataccgtatatctaccatctcttataggttttcatcatcttgtttagatcttacagttatctttatgcttaatgctgcatcggttgagtttgatctattaagtttatctataattgtgatatctagcctgttttatgatcatcaatagagatagtatcagagtttcagccgatcttacctgatttagttattcttatctcatatgcttgtttgttatgctaaatctgccctttatattaagatcttgttgcattgaagttatattaggtttattatttaatatatcttgcttgtctcaaatcttgatatagagtggtatcggagtattagccgatacatggtagatctatctgatcggctatgctataaacttctatataatctttgctttaatatatatttcgacttaagtaatttatactgtcttggcatgatgaccgatctatcccaatcacttagttcaagtatataccgaagtaaagattatatgttgttaatatctacagccgattgagtagatttagttttatcatttttattcattattgccgatcgagtcaaacatgacatcggctcgaagataaatgatatgtcattggcaactagccgatcggctatcatttatggatttaaccacggtttttcttattcttgttgattgcatgatcaaatcaactggcacgctcatgaacctaaaggcgagattttggacctgcaaaggagttaagcagatcttccaggccagtgtgtgtttttcacatcaacagacgactggcgcactggcgcggcggcgggaggcgtccccggtggcggcggctggcgcggtgtggcggcgagcagccggagcgtggggctgcagttccggcgccgccacaaccggatccagcggttcagcgttcgatctggccggggtcggcaagagtggacggctcaacgccgacgggcggctggcagcaggagcggacggcttctccacctcgccgatttcccccttccttttctctaccaaattactcaagaaatattgttggtttggtccgcatctgtggtggtttccttccttttctctaccaaattactcgagaaattttgttggtttggtccgcacctgtggtggtttgggagggaatttgttgtgcgtttggggggatttcagttcgtcgatgattccgttggagggtgatttggggttttctgtaggtggattcggcgcgagggcataaggcagtgaagaaacgctgcccacagcgcgcgtgcctcgcttttccctgtccgctcgcgccctcgccgcaacaaagtttcgcatagctcaggtaggggacgagaaacctagctaagggacgggccccgtcgccacgtcgacctgaatccgagctggcgcgacgaggtcccggtccagctcaccgcactgtgagaggcctaaagagctgtctactcttgagctgtccactcttgcatcacacttgctcctcctccagtacatcctctgcttcagaacgtgctcaacaaatatttaagcaccaacatcctctagtttggaagctgtgttcggaagccttggttgagaacccaacttctatgcatggaaaacggagcattccattagcacatgattaattaagtactattagctaatttttttaaaaaaaaaatggaacaatatgatttttttaagcaactttcgtatagaaacttttttaaaaaacacaccgtttagcggtttgaaaaacctgcataccgaaaacgagagagattaatgaaccctgagttcctctcaacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggatggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaagctggatccgttggaaagaaggacttcgagagctttccatcaagtactcacgggcccaaaacggagcacgtatgtagatttgcgggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtaataggtggccgaatcggattccagcacttggaggacttgatcttgatatcttcttgttgattcatgatgtgagcaatggtcgtatccatagtagccatggtcacatcatcctccccttcttcacagaaaaccgtcctcggtttttccatatggtgctcttcgcgcagtccactgaaaacaacctgtttcttgcaatcaaaacaagacaaactcgagacaatatgattagcagtaacatgtctctctagcttgcatattttatccggaactacaagatgttctaaatctgaacaaatgtaaactctatacaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaaggaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaaatgacatctcaaacatatcgttcttctcattttggagacttttctgaacttcctgcaaaacatcagtgataggaggcacaagcatatcttgttgctccattggattctccaaaattttgcgctcaacaatacaagcaagcatgaacaattggcctatatgattatatgtcacattaacaagcccagcctgaatattgaaattaagccctctgaaaatctagtcattgtgttttcattagattcttgtaacccactataagtgatacaaattttaaaaatatgaaagtactccctaacagttntgtcaccgtgtataagatgttcccatttctcaaggagagcacgtctatagtatgaaaacacaaatctttttctcattagtatttcgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatctcacacacacactcaagcttttaaccaagctcttacaagatcttaccaatgcaagtggaatggtgatgtacaccgactcaaccaagcaccccaatagaggttggatatatcgatgcctcggcaaacacttgccgtacggttgcaatcaaatctgtggagctctgggtaggcttaaatatgtagcaaaggaatagcaaatgctcaaatcagagaacgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttctttttttttccttttcttttctgattttttttggtgcggctttttttttcttttttttttcacctttcttgccttttttttctcactttttttcttattttttttaacaaaaactgactcaaggaccttaatgtaagattacagggactcaaacataaatataaaatttatagggactcaaatgtaaaagtctaaacccaaaattaaaattatacaaaaaatggaatgctgaatttatgccggttccgtttttccaaacagatctcaaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgatagaaacttctgaaaactacaaaaatagaaccgtggcagcgagccgattccgttttcgtaggtcccgacaacaacagagacacggtggcagcgacgactgtggtacaaaacgtgaccagaactcgagactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcaacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtagtaggtggccgaatcggattccagcacttggaggacttgatcttgatatcttcttgttgattcatgatgtgagcaatggtcgtatccatagtagctatggtcacatcagacatgagttgggaaacttcggtgtacttttttttccaaaagaaattagggaaggcccaaaaagtaagatggaattgaacgggatcagatcgtccgcgtgcgagccgtttcgatccccctacctcctcctcgtacgataagtacgcaccccgagcgctcacgcgcttcgcatcccgcaaaaccccggtagaacccgcacccgcacccgcacccgcaccgccatggagttccggtaccgcgacggcgacgaccgcagccggtcctcccctcccccgccgccgccgcccacggcgagctctggatccgcccgtgtgctcccggccaacgaaggttacttaattaattattctcgatcgatcgatcgatctcgctatctgcgtctttttttttggtatcgtttcctttcttgatcagacgatgggcatcgtggcgcagacggcgggggcacgggagactacaacgggggtgattcggccgtgtcgctggggcagtcgtcttcaccgtcggcggctggtcgcgacgagctgcggcaggcgaagaagcagaagataatggagcggatcctgcgggaggaggcggaggaatgggagctcgagtcggaggtccgccgggagatcatggagcacatcttcccgttgctgaggagatctgggaatgcacggccgccgacgccggcggcggcggcggcgctcctgcaggttcgatcatcatgtcttttttcgtctacctcgattttgggttgttttaattttgatcgatattgaatatttgtttctagattctagcttaccttctcctactgctccgactagccgcttggactaatagcgtaccactaaatgttccgttaaattaatatagaccgtgtaatgaagaccatacccttagacattttacaaaagctatagagatcaaataataatattgtatactccctccattccaaattgattattttataggtgcaccaaaacaaaaaaaaataataactctctcatactatatttactcgagcaacaaactcaatgtatgcaccatccccactatttcctagtcaataacaaatcaagatattgcatgtgggttatatatacttagggggtggcccctctctcccaaacacccccttatgtgcatggatgcatgcatcaatgtccatttactccaatgcacaaataacgaatagacttaatgaataaacataaatatatatagatcatttaggaataaccttaaaaaaacctatatgtagatcaatttggaatggagggagtaacgtgtatctcgatcgttcatgtttttccattacatgtcttatttgatgacaatataacttttttatgaataatatactaataggattgataatccatatatggattcattactatagtcatatttcatcttcacaatgacctaagaataagtaattctatttattatccatttaaatattctactagttattccttgtaaacacgcgattcattaatatttacgtttctcaatgcccatgtagccaatcatgtgtagaagaatagacaatcatgtgtagaagaatagagagtcacgcattaaatccgagaaagtcaataagaggataggtggttggattgaaatatgtctatcaaaactaaatttttcagatttggaaatatgtctatcaaaagtagattgagggagtataatatagtacatttttatgtaaattgctttgggatttgcgatgacatgccgatgaagaagcacaataggaagattaatactattgtttaaaagcaatgaatttcaagtcgtgtcgtttatggatagaaattaatgcaatcaccgaaatgaggtgtgctatgaaacctcaaggatatatgctctcctctttagaaaactcttggtcaaaaaaaagttagaaaactggaaaagaaaacacttagaaattgtgtcaaccacctattgttttagaaacatacactgtcaaaatactaaagttgtggatggtatttcacattattaattatatggtcgtactcacaacatgagtccagttgtggatgatatttagaaggaaaaagtacgaattacctcccccgaactatcacagtcgtctgaattacccccctgaatcacaaaaccggacattcttcacccccaactatgcaaaccggacgaattaccctctcgacccaatccacggtggttttggtctacgtggcgtacgcgtggcagctgagtcagcattctattcattaaaaaaataacgggacctacatgtcatactcttcctctctctcactcttcctctctcttctcttctctctctctcactattcctctctcacgggcgggaggcggacacggagctgcggcggcggtggccggcgggtgacgctgaggcggcggcggtgggggatgagggtgacacggagccggcggcggtagcgcggcctcgccggagtcggacgtcgctacggcggaagaggagaggtcacgcaatgtggaggcgaggcgggtcgtgtcgcggcggcggagcacggcgtgggcctcggcgaggagctgcttcagtgcttgagcaccaggggcagcggagggggaccgaggacggcgacggccgggggcagactagtggggggcgacggtgccccgcgcgcacggggaggcacacggcggcgtcgctttcttcccgcgctccagggccgcgctcgcacgagggggcaccggcggcggcgacagcgcacgagggagaaggctgggccggcgagcatgttcgtgcgggaccggcggcggacgggggcggaggccctgcggatctggaaagacgatgcgggaccccgacggcccccgtgcaccgccgtccgccgcctgcccccacgcgccgccgttgtccacggcgtcgggccgccgagcgcacttgtgccgcccttactcgccgccgtccgccgcgcgcccccacgcgccgccattgtccgcggctccgcgccgctgtgcgcacttgcgccacccccacttgctgccgtcgtccgcagctctgcgccaccgtgcgcacttgcgccgcccctactagccgtcatccgccgcgcgcccccacgcaccgtcgtcgtccgcggctccgcgccgctgtgcgcacttgcgccgcccccactcgccgctgtcgtcccctccgcacttgcgcggttgttgcgcccgcgtgcaccagtgagagagaacggagagagaaattaggaagaggtgaagtggaggcatgacaggtggaccccaccaatttttttaaaaaaaatggtgactggactgccacgtgtatgccacggggtcaaggggggtaattcttctggtattgaaagttcgaggtaaagaatgtccggttttgtggttcagggggtaattcggacgaccacgatagttcgggggggtaattcgtactttttcctatttagaaacaaatctatttggttttctcaacattggtgaccagtctacaccaatccatgagttgtaactgtatgaacaatgacatgaactatctaataccatctaaataatcccaacggtcgattttgaaggtcggtttcataggccataattatgcttgcaagtgcgatataattcagttgtttgtatggcttgccacatcctcgtggatctatttttagagagttcatgggtaactaagatggtcacagttcctgatttgttgtatattggcccccgatgttcatgtatctgaataaactagtttctattaatctacaacatgcacttctattatcgagatatgatcaaactgttaaaaaactaagaaaacactttgaaattgcagcaaccatctattgttgaagaaacatgcaatgtttgtggatgatattttgcattattaaccgtgttcatactcacaacatatgagtcaagttgtggataatatttagaaacaaatctatttggttttctcaatgttggtggccagtctacaccaattcatgagttgtaactatatgaacaacaccatgaactatctaataccgtctaaataatcccaacagtagattttgaaggttggtttcatagtccacgattacgcttgtaagtgcaatataattcatttgactgtatggcttgcaacatcctcgtggatctatttttaggctcagttcggtagtacaggtacccaactcctcgttttccgcgcgcacgctttttaaactgctaaactgtcagggttatgataccacatacctaatagtagttgactaaatctcggcaggatccaccacataccatgtcctatacagaagcaaccttcggatataggaggagttctggataatgaaagacaaccagagttctacatgaaaatgacaaggactactcggattgtatccatattggtttccctagttctacttggacaaggggacaactatgggtataaatacaagcccccctaggaggacagggggacaaccatcatgagacgatcaacacccaatacaatcgacatagaagccacaatatagaagcctacatatgccaagacacgccgccggatatcgacttcagggataagcacgactagtaccctacggtgtctccagatactgtcaggagagacgaaagcgttatctctgatctcgccgggcgcggattcgaggaggaagactaccctgttgttgactacgagtcagatcgtcagaccgccatgtcgataacagttagataggctaccccaaacattgtactggtgtgattatcatgaataaaagcaataccggctttggccaacaggatgtagggttattacctaacaattcaggggcccgaacctgtataaaaatccctgtctccatctcttttgcctcagtctcgcgtatatcctagcaccaacgatccccatactgtccaaatacggtagtcgtgacatcaaacgtcgacataaacggtgtgttttttgcaaaaagtttctatacgaaagttgcttaaaaaaatcatattaatctatttttgaaaaaaaagctaaaacttaattaatcacgcactaaaacgttgcttcgttttgtgtgccggggagtgatggttcccaaccctcactcccaaacagagccttagagagttcttgggtaaatgagatatgatatatagtcatagttcctgatttgttgtatatcccccccccccccaatgttcatgtatctaaatagactaggtgctattaatctaccacatgcctttctattactaggatatgatcaaaactgttataaaactaaaaaaaaactttgaattgcagcgaccatctattgttgaagaaacatgcaatgtttgtggatgatattcccattattaactatatatttatactcacaacatatgagacgagttgtggttgatatttagaaagaaaatctatttaaccttctcaactttgtggtcagtctactccagttcataagttgtacctatataaataataacatcctgaactatctagtactatctaaataatcccaacagtgtgtttgaagtcctattttataggccatgcttatgtgcgcaagtgcaatataattcagttaccctgtaaggcttgccacccacatcttcatggatctagagatcaagcgtaattgagatagtcattgttctgggttgtactatatggcttccaatgttcacatgtctaaaaagggaaactctattcatcactcgaagggatatcctctcgattttcatgctacttaaaaggtcataaaaatattaaataaattaataagataaataaatatatgatatatcacttcacgaacatgtatattcaaattcaacttatataagtagaaacaaaaataacaaatttgattcggaatagaactttcaatttgcagtcaaatttgttatttttctttctataattgtttaattccaatttgaacttggcaactttgtgcaatgacatctatcttgccaagtttttaaatattttttgatgactttttaaataaaatgcacaaaacaagagaatattctctggatggataaaattccatctctgtctaaatatattactagttcttactatttctacaacattcggttctgtttttaaggatggctctaatattaatttatgtatgtgttgttgcaccttaatttctatctccatctttggttcaaaatataagtattaaaatataagtattaagtacgaaggttagttaagttgaaaaggtggtactgtgcactagaatttcttttattttgtatacttgattttggatttaaaattttttatgtcttactatatcgatgttgtcaatattcactattccctctgtcctaaatgatgaggtttatatttttttctacacgatctttaataatatactttaaccattaatttattacgtgttatgtttccgacgaatatgaaattagcttaatataaaaatatttaaaatataaatctagtaatataatatgtatatatatggttagtataattattaatcaaaaacttaattaggacgccgtataggacggagggaatacttccttccgggttgttcttatatacgtgttctaaaagttgacgagcgtgttcatttcacgcagggcgccgtcacgaatgcaaacgcatcatcatcggcggcccccttgccggccaagaggaagaagaaccccgccgcagcagcgtccgccgtctccgccgcgacgagtagcaagaagcccaaggccggcgacctgacctgcgccgtctgcggcatcacgtcgaccggcgagaaggctatgcaggaccatctcaacgggaagagccacaagaagaaggcggccgcgctcgcgctgtctgcaccgccgccgccgccgccggcggaacccgagcccgagcccgagcaggacgaggaggatgcggcgtcgatgatcccgccggcttcggacggcggcggcggcggtggcggcggcttcagtccgacgaagctgagcatgctgacgagcgccggagtcgtgtacgaggtgatgcagatggacggctacctcctctgcgagggctgcaatgtcaggacggccgaccgcgtcaccatgatgtgccacctcgacggcggcaagcacgtctccaaggccacgaagctgaagcagcagcaagccgggaagccgccggcgccagcgacggcgactgcctctcctatgaatggcgtgaaagcagcgggggcgccgccaacaacagctgctgccgccgacggcgagcatggaacggtggtggtggaggtcgacggcgagccacacgccatgcggaggctggacgaggtcttcattatctgcgatgtctgcaacgtgaaggcgccgtcggtgactgtcatgcggtcgcacctcgccgggaggaagcacaagtccatggccgcggcgacggcgaaggcgaagggtgccgaagctgccgccttcaccaccatggccgctgctggcaaagttggcgggaaccttgaggcgggagccatggcagtagcagaaggtgtcgccaccaacaacgtcgccgacaacacttgttcggagaagggaaccgtcgacatcgtcgtcggcggcgagcaccacgccgtcaagcagatcggcgagttcctcgggtgcgcgtcctgcaacgtgatggcgacgtcggagagcggcatgaggctacacctagccggaaagaagcacaggaacaaatcgatggctgaaaaggcggccatggacgacatggagattgtgaaggccaggtcgaaggaaacggcggccgccgccgccgcctcctcgccatcgtctgcgccgcgagctgtcgtcgctgcacaaacgggcgatggctctgtggcgcccatggaagtcgaccaaactgcagaggccagagatggcggcgcgccggtggccgccgacgccgcggcggcggcggctgccaccggcgggcagcagcaggtgaaggtccaggtggaggggaggatgttgccggtgctgcgtgaggcgaacggcgcgctgctgtgcgagccctgcggcgtgcgctgctccggcaagaccgacatggtgctgcacctctacaccaaggagcactcggacaagtgcggcgcgcatccaccggcttgagtcacttcacgcgaacgtggagtggatttttaaacttttggacgtcctcacattatttacatattatctaaatgaatttcttttaaaaaatttcctcttatagataggacgaacaaagaacaaagttttttgatcacttacttcgctcgccctttttgatcggggaagataaattaatatgtg

SEQ ID NO: 5602 - DNA, 31715 bp, Oryza sativa
  unsure (1)..(31715): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttaatgaattaatttccctaaccaaatatagcaacaatccgactattggcgacttgataattcccatcggccgattctaggactctaaaaacgatactgactctaagccgatgatgacttcggggcttatcaaatttcaccgttaacaagatgatcaccgatgattaaaattgatgacgcagagcgacgaagatggtaaatctaatggttttattttatttgatcgaggtgttggacgatcaaattttgtctagacttatttatagttttgacatactatcaagaggggttatgacctaaacaaagagtttattaaaatgccatattagatcatttgcattgtctgaccgctagacccaagccggtctgatcggcatgtgttggctggtatgaccgggccccctctgagccagttggatgcccttggcttaacgatccaaagccgccagagtcgaggccggtctgattgagcccctggaggtctaaccaagcctcaggcggtctaacaggccgacctatggcagtcagaccgtgctagttgtgcctgcgcattaaatgcacagtagtggctaactttctagctattacactgatgggcggtttgaccagcaggcaacagaggttggggatttcgaccccaatggctagtttttgtagatgggggtataaatactcccccatcagcagcaaggggattcttttggcacttgctttatttacatacatcccttgcatctactctcacactatcttgagcttgtgtttatccatttggtgtgtttgagagttgattgaggtaagacaagttcattacttcattgtagagttaatgtgacaccggatcatctccgagccgggatgttacttgttactcttggaggtagtcgccccctagacggcttgtggatatgttgcccggtgatctctccaaggagattgtggagaaatcccggtgccggtttgtgagtggtttggagttcatcaccttcggagtgaaggaagaactaccctagtgatcaaggcttgggtagtccacttcgtggaccggctcctaccttgcctaacccttacgaagggggcttactttcttatccaaaatcctcctttaataaacatgagagggcatggctacatttttttttcatctcatgctcaatatttttgagagagcatatgtttatcattttcataaccatgcctttccctcccttttttattttttttcaaaaaatattttcttttctaggagaagaaagcacatataagcatggagaatttattttgatgatcctcgggtggatataagtggagtgagtggatgctagcttccagtgtagaagtatagcatgtgcatatatgtgggtgtatgatcttgatcatagagcatgaaaagtatctagacaagtcacatggatttgataaagttcaatggaattacaagtaaccaacaatgtatatgacttaatcaatatgagtatttttgcctctggtaggaatttatatcaaatgaggaactttcaaatttatcattttggaaaataaaatatctggaattcaagtcaaacttagaacaggatcatagcaactcttatcactatctcatatctcgtaacaacctaaactcggattagcaaagtgcagcttacttccatcaggttcccgaataattgttggatactcttattcaatttttgagagagtacttaaccatgaacccatatatgagagatataaaacaaaacaactattcatcatttcaacaagagaactaagttgtcttacctagcataataaaatatatcctatatttttggtattttctattttgcaaatttttatgttgttttcaatctataagatgcaatgcggaaattcaaacatgcaattgtaaagggaaatatgcaatgtgatacaaattacttcaatggagggaaagacgtctcccccaagcttgcctttcgctcagggtccttggtaaggattgaacccctggaagcagaagtacgcttggagaacagcgtgttgttgctgcatcagattgttgatgttggtgaactgagcatcagcattttgctgccattcttgcatctgggctatgtgttcctcgaggttgtgatggatctctctcgtccgtatgtcaagggtatccaacctcctcgtgatttcacccaggtcccgagaggaaattgagcgccactagttggagaatggaggcataccacttgagctggaggaacgggcgttcatattcccccattgtatgtacgtgatgaggcacctgtcaccggttctcactggcactctgcgaggttgaacctccgatgctgtggcgtggggcttgggtccatccgggtgcatccccagttggttccaagcccgcacgagtgtcgagaactgaagattctatgaagattctattctaaattgaacttgtgacactaaactaaacttgagagagtatgagaacttcttgcttgagtgtgtgatggaggggaggatgagagggctttacatagcctcccaatgacggttgtggtggttggaatggtcggaaatgccctccaaccatcattggggagtgatccaagccatccagaagaaacctcgcatccaatggcgcccgggagggttcggcccaacccatggttcggccgaaccatgggctgggccttcctagcccattttcagcaggtggcctcctcgcttgctcctttctgtagacttgtaaattttggggctgttttggtcgtgtcaatttagtgttcttggcccatccatccataagtctacttctcgacagcgtctgattaaccaatcgtctattttgctgtcggttcttctccattagaatcctagtactagtggaatatttctcattctaacataatatgcattgcaagcataactagttttcctttattttagtaatattgacgggcgaaactaatcgttaacaaccgtcaggcaaggtgatccactatctcctttgctttttgtgcttggtgcagaattgcttcaggttattattaacaaggcctatactcttggcttgttgtcaaaacctatccctaatgagaatgatctagattttccaattgtgcaatatgctgataatactcttttgtatgtcaaagccagtggaaaggaattattcactttgaaatcttttgtatgtcaaagccagtggaaaggaattattcactttgaaagctttactgtaattttttgcacagaggacagttctcaaagtgaattatcataaatcatgcctcataccaattaatatagatgaggaaaaagcacaaatattggcaggagtttttgttgtcaaggtggctcacttcctttcacatatcttggtttgcctctgttagaattgatagaaaactatctgctaattcaacctttttatcttatggagataggcttaccttgctgaattcagtattttcttcactgcctacctacttcctccgtttcacaatgtaagtcattctagcatttcccacattcatattgatgttcataaatctagacaaattcatgaacatcaatatgaatgtgggaaatgctagaatggcttacattgtgaaacggagggagtactacatgtgcactttgcagctgcccaagatagtaatagataatttaccctatagttcaccaacacagtgttacagacttcattactcattcctcattggtcaggatcttctccctaagatccaacgcctcatgtcgctccccctcccccctctctctctctctctctctggctctctcccccgtagcgcaagccccacccaatcatggatcacgatgggatctcttctccatccccttgcacgatctcctcctccgtgactttgggtctgtttggttggtgtcctgagcaccatgcctgagattttttcatgcctaagatttttttcatgcctgaaaggcatccgatgagttcagatttttgcctagtcaggcagctggatgcttcgcttgtttggtttgcaactgctgcctgagaagtaaaaatatgattaggctgtacatgattattgctaagttaagtgataatcggaataagatacaaaatattggcaagactgcatcgcccaccaaaaatctatctgctagctatctagctttctattacaaatgacaaatctatcacacaccttgatgagaacacaactagctcggatataaccatggctactttatgtattaatcaaccaaaggtgcatatgttctatattagatttacttgttatatatttgaacaaacgttgctacacaatgagttttgtgtgttttcgtttgcagaggtacttgcttgggcgaaagaaaagagatcgagcgtaaggaatgcatggatgattgaagaagttgattggagaccaaaccaagaccttctccaagtcttctttcatctcaccacgtcacttttggcccatagaagacaagagatcaagttgtacacgttttggatttagattcgggcctcctgatagcatcaactttcaacggactagccgctgatctagaaggaattttgggacccatgagtacttgttggaaagcttatggagtctactttcagatggttttggtcccacatcaaaattcctaccgagctgccaggaatctgcaaaacaagccacgtatctcatccagtccgaatctgactcgggttttgggccttgtaattgtgtcgtgggcttagcccaacggggtgtgtgccctagggcaaccctaggacgtccctaatcatattaattcagtagccatcatcgtttagatttgggttttgcttagattattttgtcaagaacagtttcgccgatagatcggtttgtggaaccccaaatttgtgtgcttaatcatacatatgcaaattagttgcaatctatcttgttcttgcttgtgttcttcgattcgcatgcaggtattagccttctcggcgaggtcaactgggtttcggcacggttgataaccagaggagatgtggtgctgcgattgcggggctcggtagcgtgttcgttcagaagccggatcgagttgtgtcgcgactccacgcaaatcgattgtttgtcaatacctatcggaagatcgggacctaacatccctcatcagttggtatcaaagcacggttgccattaggtaatttatcttcccataactagaaaattgccacacaaaaatatttattctttacctagacaaatttgagccgttgcattgttctattagattttgctttgttgaattctagattgcatcgtcgtgtcgagtgctggtttagtttttagatttaatttttagttttgagtattgcatctgttcatcacttaggtctagggttcatcactcaagtcggtgtgagttgtacgtcagttttggttccagtttttcatctcgtcggttgttgctgggacctcgaaaaatcgaatctaatcatcatctggtttccgtttttatgatgtggagaaatttttatcgagcggttagagagttactttcttgctagggttcttgtcgtgtgttcccgagcttatgtgtgccgtgagaaagaaataaaaaaaaagcacgagattggttgctgtgggttagttctgttagagataaaaagaaatagtggggccactcttatcctgtggaggctgaggctgaaccccccaccccacatccgcaacttccacctccccctcacggttgacaaccacctccacctcacggcaagtttcttccatgccgcttcctcgattatcagattgttaggtattttggtggttgtagatttgagatatttttataaaaacggaacctacgtgatgtgagcattccatttttggggtgatctaattttaattttgcactttgtgtttgagtccatgtaatattcatatttacatttgagtccctgttcgaggtcagtggtcagttcttgttaaaaaaaatatagtaagaaaaactaaagaaagaaagaaaaggcagaaaggtgcaaagaaaaaaaagaaagaaaacgccgcacctaaaaaaaagaaaaaaaaggcagaaaggtgcttaaaaaaagctgcagcaaaaaaaaagaagagaaaatttagtgattcttttgagctgtatctagagtgcagagttgtggtttgagctgcttctagtccttagtgtggtcgggtgcttgcttgagctagagttgagtctagactaggccagcacattgactagtactttgaactattattcaactttgcattttcttattagcataattgcgttccttttctactatatattgtgcctcccaagctccacatatattcttctagtcagcactgctttgatccttgcaatcgccacatcatgtccttcaaggtgtcacgaaccagccaccggttgtaccgtccttagcattgctggtaaggcacttgtaagagcttggtaagacgcttccatttgctagtctccactacaatccatgttctatagttaataggaacaatattgttatgttgttctctcttttctactaacaatggtaggttacatctcttatggacatgagataaagttggatgggagacaaaccgtagctgctacatcaccttccacagatgcacgtgatgacagtactttggtgcaacaagtgctaagttctcaaatggagaaagcagagcaatggcagtaccacgaattatttgaaacaaagtttgtggttaaggatagagcatgtcgcactataatcgatagtgagagttgcaataacttgatgagttcagatttggttgagaaacttgagttgcctacacaaccgcatcctcatccatattacatcaaatggttcaactcttgtggtaagttcaaggtaaatagaattgtgagaataaacttttcgattggaaattaccatgatactgccaattttgatcttgtccctatgcaagcatgttctttgttgtttggtcaaccatgggtatacgctaataatggatcgcataattttgttgctaatacatacacatttagacataatggtcggaaaatgaaattggtacccatgagttttactgaaattttcgaagataatcttgaaagaatgaagattggaatcgaggaaattttcaaagatagtattgaaaggaagaaaaatagaatcaatgagattttcagagataccaggaaagatactattgtgatgccttcaactaagtctgagttattacaaaacgaacgtaatgttgtgcctattgctttggatactaatattttgcaggatctaagaacaacgaaggtaatgaggaagagaagaaagacgaagagggaaaaaaacctatacatagctccacgcatgcttgaggaatgtttaattgaccaagtgcctacaatttctgaagatgagaaaaaaagtaatggtgctacaactgctcaaggtatgcatagttatgatgtgccaactatgtccactacttctgctaagttagagcaactcatagtggaaacaattgttgaaatacctttgtcacaaaacaaattgcttgatgtctcttgtgataaagaagagttgtgcgatgcttcacttatatccatgccacaactagtgaatgaacatgttagttctatagtagagccacctagtgttgagtttaaacatgttattcacattgcttgggagaatgaagagcttaaattgctatgttctttaaatacttggggatatattcattttgatgatttttgtccactcaactatttagagaagaaattatttgctagatttgaattgccatgtacttctgatgtgatttttcatgtcattggcaattatgatagtaaaggagaatataatgtgcatcgagtatatatttgttcgaatttgactatacctccttttcatgatgaaatgtattgtctagaggaccgcatgcgcacatgtaattatctatctagttcctctagttgtttaaataagttacaggttggtttgcaagaaggggagtgtagtggtttttcgactacaaagattttaggatccaatcatatgaccatcaagaaatgttcctcaccggatgtgatagataaagataagtttaatacgctccatgacaaggtgaaatcgaggacgatttccaatcaagaaggggaggatgatgagaacacaactagctcggatataaccatggctactttatgtattaatcaaccaaaggtgcatatgttctatattagatttacttgttatatatttgaacaaacgttgctaaagaaaagagatcgagtgtaaggaatgcatggatgattgaataagttgattggggaccaaaccaagaccttctccaagtcttctttcatctcaccacgtcacttttggcccatagaagacaagagaacaagttgtacacgttttggattcagattcgggcctcctgacagcatcaacttcaaatggacctagccgctgatcgaaaacagtttattcagattattctgtcaagaacagtttcgctgctagatcggtttgtggaaccccaaattcgtgtacttaatcattcatatgcaaattggttgaaatctatcttgttcttgcttgtgttcttcgattcgcatgcagagattagccttctcggcgaggtcaaccgggtttcggcacggttgataaccagaggagacgtggtgctgcgattgcggggctcagtagcgtgttcgttcagaagccggatcgagttgtgtcgcgactccgtccaaatcgactgtttatcaatacctatcggaagatcggggcctaacaccctcatcacacctgttgaggggaaacaattaggagaacgcgagaaaagagacctccaaatccaagcatgcatcaaattaatctccaactgcatgcagaattgcagactgtgaggtgtgggggtgtgggcctcgtgcgcacaggggacatctctacgataggttatccttgatttctgttgcacgcgtgcacctggagctcaggtgaccgattttggtcacctaactcaggctaatcacttgtccggttccttcaggccaggctagggagaatggctctcagggtggcaaccaaacaaggaataaaatgagtcagactagtctcagaccaagcatattcttggtagcaaccaaacaggcccaaatttctcccgtcgctcccctcaagctgttctgccaccgcccatagttcaacgcattttcctcaaccgcgttgccctatcgccggggaaccaccgcccacagccgaaagctggggaaggtctcgacgcccctcttcctcagagcccacaaccggtcgacggtaggtcccctcccctatgccgcgctcctatctcttccacgtcggcgacggtgctccagtgctcaatctgcatcgacacagtcttctacggttaggctgccccactcaggtatgatccctggatatctatatttactacttcaatctagacggggagatggattccaactgattctattgttcactgtcttttcaaataaccctatttcttcaagtatctgtatttcttcaagtatctgaatagtggatgatgtaattcatgcatggaatggtttattggtgcatgaactggccttaatttgcagtcaaactccatccatgtgttacaactagatatttcctgaatacttttgctaggctctgaattgttctatatttgatcccttttgctagactttacatagactaactatttgctgactggacaggtgttttgatttttgcttatactaaccctgtactgctttgatcaggaatgacataattactataaatagtaatactgttctagcatattcatatgcatgtttgcgtataaatgttgtgccttgattctgaagaaaaatccaaattcgtaaaatcactgacaaaaacagaaccagaatatgctcacacatgtttgaattgtgtgtacttaatcatgtgcatctgctgcttcttattgtatttctgtagtggggctgttcggcactaggaatgtgtggtgttggtttaaatcagaatggagtcaaagatcagaatggtgttggtttatgtgtggtgttgggattttgattctgaagttcttttttcttattttggaattcagatggcatttaatccagaatttggtaaaacaattctaaatttacaatctggtctttgatttatttattttgacatttgccaaatgttcagcaatgtagctatatatgacattttccaaatgcacagccatttaggagttttttctagctaattcagtaataaactagaccatgcctatttgtttgtcccctgaaatatgtgtcgatttgtggatcttagaccatgcctatttgttcgtcccctgaaatatgtgtcgatttgtggatccctgtttttttctcatcatgtcgctgttataaatagttcagcatcacagggattttagctttgaataaatatatccctctgttgttttctgtggtgcctacctgtttgcgtcatgcaatagagtattcaccctatctgtgtattgcttggctggactttgatgcccaggaaatcattgtcaacaaggacactacgaatatagtttttttttttcaattaagcactaggaatacattgggttcagtatatatatactcttcggaagtagctatagcctatatgagatattcaatggtgattcgataagggcagtttaggttgtagttttgttcagttcgagctattcatatactggatctttatacaagtacttaccttggattatatttttcattgcatttttaagctgaaaaaattagtagtgtgcgtatactacctttaagtattatattgttgcggcgataaagtacaatgcaatttatctatttgttatatggatttggtcaaaccgataaaattatgagagtgatttctcattgaatacatcatcatccaaattgacatagcttcttgtacttttagttgacatccaacttatgctttgtgcaatggtaattttttcccttattaaaatgtaagatttggtttacacatatttattcatgacacctggatatggaaaatgtcttgcattaataatgtgaactgatgtattgaaaggaacatttttttcagattattattgaatttatgaaaaaaaaacttttagttaacatccaacttctgctttgtgcagtggtaatttttttcctttattaaaatataagatttggtttacacatatttattcatgacacctggatatgtaaaatgtcttgcattagtaatgtgaactgatgtattacctaaaggaacattttttctgtttattactccctccgtcccaaaatacaacaacttttagtcctcataatttgtcccaaaatataacaacttctctaccaacattctcttcctaaccaatcacaaccctctgccattcacttttcccacctacctccactactcatccaatcacaaccctctcccattcacttctacctaccttcttaataaccgtgtcacactttaaaacttcttatattctgggacagagggagtagtgaatttatgaaaaaaaaaaaatattagatgtttagtgtaattgggggcttcaatatgtatgctacagtcactttaactccaatatcagatgttcagcatcatttcgtgttaattttatctttactgatttctcatggccactaacagttatgaatctcatctctgaaatgatgaaatttgtgtttgtcatgaaaaattatcatagatgacaaactattcagaaaaatgcaagtgattttcacttctacatatgtagatggataattgttgggtgcgggtttatttccacagcatttgcttttgtgaatttggcatagtcttggttaatatggagaaatttggttaatcttgacatctaaagtatagtaccttgataataaatgcgcttgagtgtatggatttatgtgggctcaattgaatgattcagagagcaaaattaacatttcatcctttaccccctcttttttcaattaattatatgaaaacaaaagattcattagatgtgttatacatcactgaagcgcatttatcaatttattttttagctttactgtgcatggatttagaaatagaattgttgccagaagcaaggggatttttttcgaaagttgctgcacttccaaaaaattctgttaagtggtgacgggatgaaggtggaagaatatttttttatcttcagccatttgattctgatgtttcctcatttgattctggcaattatcatatgaggtgtatcaagaggtgtggcacgcacttccgacccacacggcccgtgtgtcgcaaacgctgccaacggccgtggcacgtgtttctttctctttttttctcctttttttgggaaaataggcgctagtttttgtttttttttgggaaatctatcctttttttctctacacgcgcgcgtgatttttgttgcgacttttataaactgaatctttcaccttcaatatcagtttgagagttttgaatttgatttgaaagtttcttaaattaaagttgaatgttttgaattttgaaatgaaagtttttaaatttaaatcaaatattttgaatttcgaggtgagagtttttaaatttgagttaaaagttttcaaacatgagttaacttttcaaatcttgacttgaatttttttaattttgatatgaaagttttcgaatccaagttgaaagttttcaagtctgaactgaaagttttcaaatccgagttgaaagttttcaaatccgagttgaatgtttttaaatccgagttgaaagtttttaaatcttgacttgaaatttttcaaatccgacttaaaaatttcaaaaaatcttgatttgaatgtttcaaatctttacttaaaggttttcaaacctacgttgaactctccgtaattatcccaatttttcgcgtactaaaataataatactaattagggtaattaatgttaatgatggtaattagcgggatgcgctaatcacgcgcgggcgtgggggagggcgcacggctgcacgagttaagcagccggcgcaagtgccccccttaggaacccccgtgtcaaggcaaacaacaaggataaatgtgcattgtcaagaggtgtgtcaagggcaaggcaaacaacaaggataaatgcgcaaacaacaaggataaatgcgtactgtcaggaggtgtgtcaaggcaaacaacaagaattttggcaaagtcaaaaaaagaagtcgaccccacagggaagagcactaggaatatcgtgtataaaaacgttcttaactggtgagcaaaggtaggctcgcatgatcaaaattaattcaaaaacatattctagaagatagtaaattgctgatcgaaatgttactcatcgacatcctcttgttttgtacagcacgccatcacctcaggtggaatattgcatgattatcttcttcacaccatcgtgttctacatgagtcagtttgcaccatgctgataatatgttaacacttgtgtctctctaaatatgcacttttgccatcgattaattttagtagtcattccatatagatcttgaaagaagacgttaatgagatgaccaacaattgttatattgttgtacattgtgaaattattcaaactgttatttgggtttatattcacaccctcatgttatcatcaatgggctgcaacaggcgtgtgccttgtgtgacaaatagaaaaaatcaatatttttttaagtacataacacaaaaagaaaaaatgaatggaattgacctaagagaacattagaatttgtgacatgcggaaaatatattttcttatactctatatatttttctattcgtgacatccgaatccattctaaggttttattaaagatgaatataattgcactgtagcgtttagcacatgcatattactagtattgatagggcaagaaggtattacatatagaggggttctgatgtgaactgtaaccgaaaatctttggctgtatcgggcaaggtttgcataccaaaaaataagggtggcttgggggttataaacctttctatacagaatcaggcacttctcttgaaatacctggacaagttctataatagaaaaaaatctaccttgggttaatttaatttggaacccttattatgggaatggagtgagcaatctcaaaggttacttttggtggaaagatgtttgcaaactgatggatctttccatgggcattgctagatgtatggtgggtgatggtgtcgcttgctatttttgggaagatgtttgagtgataaacctcctttgtctttccatatgtaaagattattctcttatgttgctaatgcaaagatatcagtcagaaatttttgatttggaggaaaattttcatctgcctctttttgcgcaagcttttcaggagttgcaacccttgttaactcttttggagagtgtcaatctttctcaggataatgatgtttgggtttacattttgggtaatctgaaatattcttctcagaaattttatgcccttaacttcagagctttacaaccaccctctcatttcctttggttatggaagtgcaaaactacttctaaagttaaagtctttggttggttgctgctgatgaatagactgaatacctagatcacaaacattgtgcgccacccaattgcgatcttaattgtgttctttgttctgctcatattctggaagatctgttgcatttgttcttccaatggccttttgctcaattctactaggctatgctgggtatctctcgggacactaccctgcatacaaagaatagttaccaaggcaagtgtttcatggagaagtttctatatggggcttgaaacatctggaagcaaaggaatggttccattttttactaaaaaatctcctctttggaggcagctatttaagggtgatctcctccttctgctgtttcgtcttattgagagagacaaagatgcagctatcaattggattgctatgttgtaatatttttatacctctctttttattaataaaatttattaacagtgggggcctcccctgccgtatttctttaaaaaaagagagaggaaattatagtgtagttatagtttaattatgcaatgtctaaactttgtaccgtgcttcatgtaataggtaaagaaatgcttgattgatgctaatttagtgtttaaccatactgtttgtttgcaaaattacgggaaataaagtctgaattagtttcatcgattaaccatgtcgtagtgtgcaaacaaaatcctttgaggcctaatcttttctttgggtacgtatcctgtggtggaaaaaaatccgacagatttctgttccgttttctgtcgaaagttattttaaatgttcattttctaatcaaacgttcgattagacagtctggccggttccagaatggacagagagataaattaagcagtgaccggaccggacgcatcactcgatggcgtccttgagggtgttgccgatgtcgatgacgaagcggtacctgacgtcggccttggcgaggcgctccatggccgtgttcacgtagtcggcgccgatcacctcgatctccgccgtcacgccgtgcttcgctgccaggtcgatcatctcctacgtgtccgccatgccgccgatgcagctcccggccagcgtcttgttcgctgcaacatgcatgccacagacagaatgtaatggatcacaacacagagcagctagctagctagtagctagctgtaatggatccggatcaaattaagcacttacaagcaaccagagcgaagggagggatctccatgggcttctccggcaggccgacgaggatcatcttcccgttgggcttcagcagacccagcagcggcgcgatcggaatgttggcagacaccgtgttgatgatgccgtccatggtgcccgtcgcggcattcatctcgtcggcattcttggagacgacgaacgcgtcggcgccgagccgctccagcgcctcctgcctcttccccggcgacgagctgatcaccgtcaccgtcatcccgaacgccttggcgaacttcaccgcgacgtggccgagcccgccgaggccaagcacgccgacgtgcttgctggggacgttcaggccgtggtacttcatggggctgtacacggtgatgccggcgcagagcagcggcgcgcccttgtccagcggcatggcctccgggaacctgaccacgaagcgctcgtgcaccaccaccatgctcgagtagccgccgtaggtgacggtgccgtccttgtcgacggagttgtaggtgaagatcacgcctgggcagtggttctccaacccctggttgcagctgtcgcaggagtggcacgagttcaccatgcacccgacgcccaccttgtcgccgcccttgaacttggtcacgttcttgccggcctccgtcaccacgccggcgatctcgtgcctgcgccatcgagtgcatgtttgtttgatcagaattaattcagaataatgcatcgtactccctccattccaaattgatctacatatagtttttttttaaggttattcctaaattatctgcatatttgtatttattcattaagtctattcgttatttatgcattggagtaaatgggcattgatgcgtgcatccatgcacatggatgcacacaagtatttataacacacatgcaatatcttaatttgctattagttagaaaatagtggtgatggtacatgcatcgagtttgttgttagagtaaatatagtatgagagagttattaatttttcttggtttttgtgtacctataaaatatgtagatcaatttggaatagagggagtatgtaacaacgtacaaaacctgtttgtaaagctagcttgcttaattaataattacccaggaacaagtgggtaggtggcgttcttccactcgttcttgatgctgtgcaggtcggagtggcagatcccacagtaaagaatctttatcaccacatcatcatctccagtgctcctacagattttcaagtaattagcacaaacgctatttatattgttgattaaagaaaaactctacgcacaggcaccaactactagacggcgcgtcttttgtaaaactttgttcatcattattttctttgtatgttcttaaatcatttttcagcttttcaatatcaatattattatttatgctctcaaattattatcatctttaaaacgaggcctaaaaacgtactcaatctaaactctggcataaaaggcaaatcgtatatggctaggaattatacagattgtgacaatagtcgaagaaatacaacccatcacacggtaaagtcctaggtgcaacgctaccagtgcactagatatgaacagagagacaatggccaattactgtgcatatacagttgtactcaacacatcgtacctctaaaagtccaaacagtacgtactacagaaaatgacagatccaagagaccaagactacgaggtgatcgatctgatcacgtaatcacaaacaatgcggtttggattatgtgtcaacataagcctcccggtgcatgtacctcacaaaagaacagtgcaaaaccacatgttgatcgattttggtgtgtaataggttggactgccactagatcgacaaattaaaccgtcgcatgaagggacgtacgtgatagtatcatcctactatgcatgcaccctaaacagcagtacgactacctacctacctatctactagtatctatctatctatatcatatattattctgattattttctaggacaaacagtactaaaatataattaagttgttgctgaaataagtttatttcctataaattaatttgtgtgatgccaagaaattaatcccaaggtcagaacctggattggatatttttgtttccgtcgcaaaatataacatagcctttaaaatttatcccaaaatacaatttctccaccaacaatcctttatcaaccaattataacccttcaccatttaatttccccatgtacctgcacttcttaatcaataataaccttccaccatttaattctatgtgcccaaatctagatggaggtagtaccatgtactacgacatgtcggcaaaatcgaacgaaacaagcctgaacagaatcatgaactatcatgaatatcgatgggaatagaggtttcaacagaatcatccatctccacgcacgccaacgccgccgccgctgccgtgctcacgaacggtattccctactcggtccggcgccggcgccgctcacgaacggcatcacgtgtacgaacggaacagcgctagctagcccctcgcaacattacactactatctagagaaccctatctagatatatataggagtataattgaagtttcacctgcgggagatggtgagcggggagaggtggccggacgcgtcgcgcgctgccagccccgccgccgccgtgggagccatcgatcgatcgagaagacagcaagagagaaaccgacccgatccgatgtcatcgtgttcgtgcttgccgggcggtgagatcagaatccggcgtgttttatagcctcgcgcgctagatgcgctctctcccgcgcaggccccacagccccgatcgatctgcgccgtatgtgggccgcgcgagcccagcaacgctccagatgagaatttttaaatttttaattttactagaaaaaatacacgtgtgttgcaatgggtgaagattattttaatcttattattatatcgagttaagatgaaattcactgtgttaaattcgcttggatatatattttgttagaaaatcatgagctgcaattaggtgtccgaacgtctcaagttagtagtatgtgagtttttaaagagatttcttgtacgatttcttctgtatttttaaaagcgaacgaatttaaaaactgactcaaatacggatttgtatttctaaaatcaaacggatttaagaaccgactcatacgcggatgacgtactgacaaaaacatttttaatttttataatagtagagatagagatataatagtaaagataaagatatatgtgcgcagtagcttgattgaatatttctctgattaggtttttgtatttctcttggcaaccgtcatcgatcggctgttgttgctgatcgtcttgctgcacgcgtggatattcaatatgtgggtagtaatagatctcggctttgatatcgctcctgaactttttttttaatttttttggaacacgtatacacagcagaccgtattgaattgagtttctgatgaacacggtaggaattcttctcgatacagtgtgtgcgtgtagagaataatcaacaatggtacgtcgtgctgcttgcctcggcgcacggcaacacacctgactgctgctggttggtgttgatataggtgcgcaacagcaggtcccaaaccgtgttgcccaacagaccgtatcggcaagatgacaacctcgcggaggcggttggtttgtgacaatgcacaggacaaaacgcaatcggccaaaggcacgatccgaacatgcaaattttcttatggaaaatctaatgtttaaagctcgtacatgttggacacataaaatagttaaattggcagtgattatatgcgaggccgattcgaacacgatgacttaccaagccaccggcaaaaacattttcaatttttataacagtagagactagaaaagatgtccgtgcgttgcaacgggtgaatgctatttaaatcttattattgttatacggtttagctaaggtgaaatttactgtgagaattcgtttggatattttttttagaaaatcatgagctgcaattaagagttcgacactcatctcaagttagcatgcgtgttttttaaaaagattcttatacgacccctttttatttccaaaagcaaacgaacttaaaatccaacttaagcatagatctgtattttcaaaagcgaacgaacttaaaatccatctcaaacacggatcagtatttccaaaagcgaacaaacttaaaaaccgactcaaacacggatgacgtaccagaataccggcaaaaacattgttaatttttataatagtagagactagaaaaaataccagtgcgttgtaacgggtaaatactattttaattttatcattcttatacggtttagttagggtaaaattcattttgggaattcgtatgaatattttttttaaagaaaatcgtgggctgcaattatgagtttgtatttcatctcaagtaatgtgagtttttttattaagatttcttatacaactccttttgtattttcaaaagcaaacaagactaaaatgcaactcaaacacagatatgtcttcccaaaaacggacggacttaaaaacgactcaaacacagttgatgtaccaaaataccgacaaaaatatcttcaatttttataataagtagggatttattaaaatactagttaggtgcccgtgcgttgcaacaggaaaaaaactatagcacgaaacaatacatcaaatatttttaatatgtttaaagtagaaagtgtcaatagatgcatgttgcaccataaagtacatcaaaaaatatttgtgcagcaattcacgggaaatgaatacaatgccctattttagacatcatcccaaggcatttctacacatgattttctcacaattgatcaacacccaaactctctttgaacatggctctaaagatgaaccacactcacttcgttgtgcaaagcacaactgcataggaggcagttagcacatatgcccgtactgatccagctcacagaaactgcccgatctattatgtttcctttggaaaacaatatgtcaatcctatagaagtggagaaaaataattgtaaataatatatgtaagaaacaaattattttttttgctcatttacatagtaggtggcacggaaatatataagaatgcgtaaaaacaatttatattgatgtgtatataatcggatgtaccgaaatatataaaaatgtgtacataatcagatggtggaaagggcgtacttgcagcacatcatcttcaactcattgtacttagcatgcggatgaggaggttgcacaaccaattataagtgatgcactgcatatgtactttttcatctctctgacaaggccacgcaaaagcttggccctaattgcactgatgaataaaaggcaaggacgcaaggtaaccaaatctagaaccactaataaacaatatccttatttgttaaaagatcagaaagtaaattatactcataataatagttcagttcttcagtaatttatctccaagattcagtctcactatatttcacaatgttgttaaggtttaatttcttcagaccctgagatcaagtataattaatttcttagatcttataaagcacccatggatcaaaatatcagtattacttagatcttgtagtgacatgccagaataatatattcataaaaataggccaacattgattatattttagtgcaatgaaataaaatattcaatgtcctatagttatattatatatagagcaggtgatgcatagttaattaatgtctttcctattaagttatcagaaaatttaacaaaagaatactggaaactggaaaagggtttcatggataatgcaccaattaaaaaaaaactcgaagtcagctgttaccttacctgaatcggaatgcaaatcaagccctgcttcttgttgcttaattgcaaaatataggcttctgtgagccttttgagccaaggaatcaaagtaagaggaaattatgtatatgtaggtccagagttaaatgaacacagttattcaaccgatgtgtcatgtgctatcaacgagcatgagctgaactcaaatcttacagatcatcaatccaaaatacttgctgcatcttgcttaatgtatagccaaaagtctgcacagcgtaataacttgtgctagggtgtcaggaaagtgcacgagtctccttatggatggaagttaaagagacattaactgggattcttcatgtgctcagcctgcaaaacgcatacgtccctgccattgcaaaaacgacaaacaaaatattcagaaccaaagtggatcattcggccatcttggccaaaacatgaacatgtttggaatgacaattttcaagaacaatggaagtcagtaagataggagaatatcttacctgcacttcaataacttcaatgctaaactcagctgcataaccttcctggctaattagatgagcgcatcttctatgctcttccagttcagctttcccttttcaaacaaggtctttcatcttacttgccttcagttgttcgaaccttaacaatgaaaaacaatgcatatgccacacatattgattaactttagtacattgtacccaaatactcgctgccaaacaatattaccaaaaattaccttgtcattcatgaaatgtgtttagagaacatgtgcataatgacaggtaccgtcattcatatttatttactccactactgaacagtaattttgtaaattatttaagaaacatatgcatatatgagggatgaaagagaacaaccgaatttgcattctccaactgattttgcatatcctgaagtatattatcttggggtggccattcgcacataatatctcatatctacattattgaaagtgtatctgagaatatttggaaataagaaattattccgagaagatacttttaaaagaatgatagtatactgcatgcaacatcatattgcacagtgcccccatacacactgcaggatacctaagattttcactaatttgacttccatggcgctccctttatttttgaacatttagaagttaaactattcaaggaatttgattactctcagatcaatgttcggggcagcagaaaatggcacacatgtaaaaatatatagaaacatatcaaactctctgaaggcaccacaagaaaaacattttaatcgctcaccaggcaatttcagaaatgtttacacttgtaaagacttcatatattttttttttgtaaaggctttaagtgtgcttttttttcgctaatgttgatagagatagcttttcttgagctcatttttgttgtactcacagcacacaaatagtcattttgtttaaaaattcagaactatatctaatagatgggagaaccagtgacatatatgttgatcggttgatttcaattggtgaggcactgttgctctaaaatcaggttggaagttgaaagaagtgattctcacaagtgaatcaagcatttgcgccgctatctcgtggtagactgaagaatgatggcctgtcttcagtctgcaactctgcatgcatgctgcatccatggtcttcactctgcgaacaaaataggccgataatgcttgctacagtactgtttagtcccaagcactcaactaaaacctggagaaattccacctagaaagtaaagtagatataatttaggaatataattcaccatgaaatttcaaacagcacgaggaaaaaggcctgaccacaaatcaagcaaacagggaaaaagaaaaactgacagaaaaaagggagtactcctagatcactcggcatggtagcaccaagacacgctattgttctcatggcgagcggaggcggctgcaatcgcacatacggtgctcgaggtagcgacggcgcccgcgtgtgatgcaacgcatatggcaccgtctctcctcctcctcctcctcctctttcaaggactccacggcgacctctggccggccctctagggaggcagcgacctcggagaaggtggaaccggcgcaaggtttaaaggcgacaggtcagcgaggcgcggcagcggggggagcgggaggaagtggggtctcgtgcgacgtgcggtggcgcttgagggtggaagcggcggcgggtcagggaggcacggcgaggaggaggaggaggaggaggacgaggggtcctctgtctccagcacaagcaggtcgtggcgccatccccagtttgttcgctttgctaataaacgcatttggcacatttggatccatcttgaggagaaggagaagacatcaaactaccaagggatgacggcggcgtcgtggatgcgggcgccgacagtggcggcgaggagcagatcggcaaggtaggtgtgtgcgacgaactggcgacgggagggcttccggggatctgtcgagggcgagccggcgtgatggagaccgtgaggcgcgacgggagggcttcaagcggcggggatgggtcgagggagaccgggaggcgggagctggggaggggtcagcggcgccgggggtggaagagtggagcgggcgcggcgatgtggggatgcgcgaagatggattgggggcttctgttgcgctgatttcggatcgcttctgttgcgcgtcgctgtgaagcgttcgttttttttttttcacggtcacgtgtctacgtttttaagttggatcatgagtctacattagcttcaccatcaccactacagatcttttaagtagtagaattgttgtggctctatggttttaagcggtaaagttaggctcgtctcaacgggaattagaaaaccagcgagtttccgaacctcgggtgaaaattttcttctctcttgtctcatttatttattgtatttacctgtgtgcaatttacattcataatgacgtacttgagaccctatcaccttaggattgtaaaacataacctagttgcttagttagtcttacccttcaccaagcctagcaactcaggttagttttaattaggcgctatttatttttagggtaatttggaaccatgccattataattttgcaaagtttgagatatgtcatcggtatctcaatgacatgtaggacccacatgagtcaatggcatgtgggtcaggatggcatatctcgattttgcaaaattataatggcatggttccaattttctcttatttttaatatcgtctattcacccccttctagtcgacatctcgatcctacaactacgtcgattaaaataatgtattcattctgacaaggtgatagggggcacaactatttacacggagtgaccaaatcgctatcgtttctcttccattcttcttcccccccaccccagtgttgacggaacagaggagtcagcatcgaggtggtggcctagaggggggcttttaactatttgccactcttacgaatgttgcttaacgatttgtcactaggcccagatgtcataaacacatgagggcccacatgtcattgacagggtgtggcaaatagttaattgccatatcacaagagtggcaaatagttaaatttcccgcctggaggaggtggggtggcagatccgtgggcgaagcctctcccgcgtcatcgacacactacctcgcgttgtgggcgcatcaataacaaccaccgctgctaactttggtctgtgcactgcatgcctctgacgggcccctcttcgccgcgtttgcaagggccgccttcgggtacgccgtccttttgatgcaaaccattcaggctaggcttcgccagctctaaatcagtcttggcagcacggcgtcgtcttcttccgcctccatcaccgcatggcaccctagctctgcctagcactccttgccaccgcttctccggatcgaggataataccgccttctccgtcatcctcttcagttccaattccggccagcgccctctcttgcaaccgcgccatcaaccggctcatcctcggcttccacacagaccccatcgaccaccccaccagctcaccactcgacgtgtcgatcttcttcaccccgactcgtccatgtcgctccacctcgcctcctccaagccaccttgaatccacctcgatatcggctcccagaaaggggaaatgagaaagagggaaatgagaaagaggaagaagatgacaaatggggctagaggtactttgacctttcacgatgtttatctctcttagtgaactgaaaattaatattttaatgtggacgggatacaacagcaaatattcacatgttggatgtgtctttttccaaagatcgatttttaccatgttctagagctaaaactatgaaatcacgatttacctaatatcatacagtaaaatttacctaatatgatacagtactttatattatgcatacgaaagcaccgggcagacagatgcaacgagcaaaccacaggaccacaaagtccacagcatcttatctctacacgttccagtcacccaccccacctatcatcgtttcatcgccatcttcatctcacacaagaattctcctctcttcccaaataccccatcttaaaaacgagcggaggcgaccgtgtcaacggcagggagagaaacccaggtaggtttgttgtttgtttgggaatgggatggcaatctcgccatttcactcgcagccacagccacaacaacatcagcaagcaaacagcaacgccgcagagcctctgcaagacgcacacacgccgttgtacaccaaccgcacgcactggcccatccgcctctacggtctgcgccatccatcatctccttctcctcctccgcccacactatcaaagcatcaaatgcgtgcaaactgcaaacgccatcatatcatcctcctcccaaccactgcaacgcttgtagtatgctgggctgctgccaccacccactcgcacaagacccgggagcgttcggcctctctctcaagaggacagcaagaaagcgaaacgaaagaatcaaaagaatggatccatggagccacccagccatggacgccaggagagagagacgtacacacacacacatccatgtccatgtccatgtcccgtatcgtcatctcgcttttttttccctatggaccatgacatctgtgtacacagagagagggggtagctgcagcagcattcactcatggtggacacctctgacctctcaaccccaacggattccaagaatgccccccctctctcttctcctctccttggtcttggagacggagctggaccgacgacgaagccaacgctgcagacagcagcagcagcagcagcaagcaagcgccccactaccactccattacctgattaccacatgcgccacgccattaccaccacccaccctccctccctctccgctaccaccgctactactacaagtctagagagagaaacacatgagagattgtttggtttggtttggttggtgttcccttgctctctctctctatcttgccgtccagtccgtctactctagcaccatccatgaccatgcatgggccttttcgggtttttttggcaccacaagcatgggtcttcttaaacctcaccacggcgccgcagctgcaaccagccagcagcgagagcaccaagaagcagcggccgcaagaaacttccctccccacgtccaccttcccctcctcctttatttctatattgtcttcttcttcctcctcccttgcttgttcctatctccttctacctctctctctccctggctttcttggtctcctgctcttgcggggcgtttgttggtttcttcgcgggtgaggtgaggcggacatgaagaaggctaaggtggtgttggctcagccggcggcgagggcgccgccgtcgccgctgctgccgagggcgccggggcacagccgtggcggcggcgttggtggcggggaagaggcgtacagggcgagggccaagtacaagaatcttctccaggactacaaggagctcctcgaggtgggtgggtgggtgggtggattcatggcgtttcttggagtcatgccgtcgtggttggcttcgccgatctgatcttgatttttgggggttttgcgatttttcgatcggtttctctccggaagggggttttgtgatgtttgattttcctctcggtatttggggattttgtgattccgattggatcttggccgctttgtttcttgatcgattttattttcggtgttcttggttttctgattattcgaggggttttctttggnnnnnnnnnnnnnnnnnnnnnnnnnnnnnnnnnntgtgacaatattttgggttagatctgtggggttctgaaatttattatccttcttctcctaatattgaatgaattagcatgttttgatatgttccaagtcagctaataagtgtatcagttcattctggttcgtagttaaactttcttccaaggatcgcaactctcttaatctaggaggatttccacaaatgtggttcttgcaagtttgatggtgtttagtgtccatctcagttacttctattatgatgtttgctgatgattagctgtgttgggttacccaggaaactgaagcaaagaagaagagattacagatggagaagctcaagaaacagaggcttttggctgaagtcaagtaagggcctgaactcatcatcttctccagtgtgatttacatgcctggatgattatgctctacgacaatgcaaacatgttgatattgtctcattatcctgcgcataattgtgccgcgctgtaggtttttgcggaaaaggtacaaatccatgtccgaaaatccatcccagacgtttgtctatagagtaaagaatccggcattgccgcccacattgcggcaacctggttggtctcatggtgaagagtaccacacggttcgggctatcggaagctctagcaaaggcccatcggcgcaccggaggctgaatgctgctccaagagcatctccggtgattgacctcaacgaggcctgcgagccggtaatatttggggcgaactcggttaagttccgttatctgaagaaattatcatctgaatgtggttgaatttgctctttccagagttcagaagagatggaggagcttcatggttaccaggaacctgttagggttggcagggtcatgaggtacccaatggagggtgattttgccgccggtcctagtgatgcgaaaatggcggcattctgggatgtccggaacgccgcctcctcccgagctgggaagaggaagatatcatggcaggatcagttagctctcagagtataggttaataataacagtgttgagatagttgggaagaggaactgaatttcgttcatccctgttcctcgagttgtaaaagaatccttaagaggaatcggtggatgggtgtaatgctcctggcacttgttgagatcgtagtcgtgtataatcaatcacttgtctgttttgttagcgtgaatgccatctcaacaactactctagggctaatagtatttgagcaaatgaataattaatacaaatgctgtctgatgccttgtagtaggtgctgcagctgcatatgtttatattcttgtagagctgtaattcattcttgagctcaatcttgttttatgtagacactagggaatagaatggaagtcatggaacccatcaccattgtagattatatccatgtgtgaatattactatagtaatgtcagcatatatgttcactccatagtgatgttttatatttctggtagtggctaattggctactgtgatgcaatgccatgctagttctggcagccatatgtgttctttttcctggtctttcattaagaattagtattacagtaagatgcagcagtacaactgtggtgctggttaaaactgatgtttaggtagtgtagttcagcaggattctaaccccaggaatactggttctctgctgatgggttcgcatgtggtggcattatgatttatggctgcttctacaagtttgtctcatcttgtcgccatgatttcgggcaagagattattgcaattgaagactcatgtcacctactatcatgctgttcctctcgtgttgctggaatcagtggtagatgcaattctagtttcaatcctgatcctctctgcagtactgctcgctattatatgggtttgagggtctgtggggcctataagtcagtgagcctcattcctataataaattaatcaaaggtaagatgtgatatacaattagaataattttggattgatttattttagtactgagaaaccgtattggggggcataatcatttgacgattatcttaagacatcgccatcaatgaattattcgacgatgaatggagaatgtgcagattttatcgactcatgtagcctgtgtttagatccagggttaaagtgtcacatcagatatacggatacacatttgaagtattaaacgtagtctaataacaaacaaaaatagagatcccgcctgtaaactgcgagacaattttattaagcctaattaatccgtcattagcaaatgttacctgtacaccacattgttaaatcattgtgcaattaggcttaaaagattcttcttgtaatttacatgcaatctgtgtaactatttttttctatatttaatactttatacatgtgtctaaacattcgatgtgacatgataaaaaaattttgcgtggtaactaaacagggccttagtagcacataatagtgaatcatggaacaatatccacaaacacaatttaaaacgagcactttcgattgacagacatctcacaattagaaacaagtaatttacttccaccggcattatccccaaccaaatggcctagtgcgccgccacacgtccagactatcgcagatggccagaaatccatcccaacaagacaaacagtatggctctgtttagggtgtgcttagttcgtaccaaaattaaaagtttggttgaaattagaacgatgtgatggaaaagttggaagtttgtgtgtgtatgaaagttttgatgtgatgaaaaagttggaagtttgaagaaaaagtttgggccttagatctctagcaaaatttttcaccctgtcacatcgaatgttggacacatgcatggagtattaaatataaatggaaaagataactaattatatagattgccgtgtaaattgagagacgaatattttaagcctaattgctccattatctaacaatatggtgctacattaaacatttgctaatgacggattaattaggcttaataaatttgtctcacaatttacaggcagattatgtaatttgttttattattagtttatgtttaatactttaaatatatgtccgtatatccgatgtgacacgccaaaactttacacccctgatctaaacacagcctatatcaccggaactaaacgatcacattagtcatcttaacatgagacgatcaaggaatcatcacgaaactattttaaactctcgaaaagaaaattctctcgttatatgttatccaaacagtttaaaaaaaagatatattaatatatgataaatcactccataaacaatacaagatcgtatttaaattttggaaatagtacgaattaccccctgaacaattgcggtcagccgaattaccccctaaacccgaaaaccagtcattgctcaccctgaactttcaataccgg

SEQ ID NO: 5603 - DNA, 669 bp, Oryza sativa
agtgtgagacaattaaaatgtccatatctagcctcttgacatatagagtagcctcacttatgctcttggcaaatcctttttgaataaagtacttatcaatttgactgtaccatgctctaggtgtttgctttaatctgtataatgtcttcttaagtcagaatactttgttttctcccccttgaactaaaaacccttcaagttgtttaacataaatttcttcatcaagatagccatttaagaaagccgatttcacaacaagttgatatatcttccacttgttttgagctgctagagtaattattgtacgaattgtctctagccttgcaacaggagcatatttctcatagtagtcaatatcaggcttttgcataaagccttttgccacaagtcttgctttatatttctgaattgagccatctggatttagctgtcttataaacccatttcaactccaataacttctccatctttagatcgatcaaccaactcctaggtattattcttctcaatcatacgaatctcatcttccatggctttaacccaatttttatgttttttttgcttcttgaaaacagcgactcaacaacagaattattggaaaattcatattgtttgtccctttttgttgtgaagtgattataataatttaaccatacttcctacacatct

SEQ ID NO: 5604 - DNA, 1608 bp, Oryza sativa
ctatcatactgttgtaagttttgacgtttggttggaggccttcatcgataattctagtgaatatattctgtacatccttcatgcaattctcttttgtcaggacatagataagagaattataacaagcaatactaggagtccaacccctctttttcatctcatcgtaaaccctcagggtatcaaaaaggtttccaacttttgcaaaacaactgaccatgagggtataagatgtgccatcaggagtaatgcagtaatttgacatttctctccaaattctctttgcttcagctatatcagtgattacattgcaccaaccatctagaataatattgaaaccttctgcagtaagtgggaagaatttctttctcacgagaagcaattcctcagcatcctctatgtttttatttttgcaaagagcacgaagaagggagtaaaatacagtttgatctgcttccgttttaaacttctccattgcatcaaatgtcttgattgctttgttcacttcattggcagctgcatacctgaaatagccatgtccttacagtgagatgaccgtcgaccattatgcaacaaataaaaacaactcaactaaaaaaaaacaaaaaaagaagtgctactacaatatggactgatgcaaagcaggcattatgatgtccccctcacagcaagacgacaaatggacccgtatatatttttcatccaatgcataagttcaacaagattaaaggagccaaatcccagaattaccactagttaaaacactaacaacacaggaaatggtacttacggacttgcaacagctttatattcccaaacactaatccattcaataaatcgatccaaccatgaatatttgttgaccatcatagacaatagcacagttataacataatattcaagtggatcctggatccatagaagctgcttgtttgcaacagttttacttcctaatatgattgtgcaagctgataactgcttgttcaccaaatcaatatgatgtacaagtcccttgagggaggcgcacattcagtggcagtaccaatcagtaaggcggaccaaatcattcaaaatgcaggcatacatcaccataaacaagtagcaaacacataattctgacaagccaatcaacaacagttgaatactgcccaagcaatcaaatacttatgccatagcagtagcactatcacaaagctgtttcttatctcaacatggaaagctatatactcctctgtacagaaaaatggagacagattacgaagaggagagaacccacctctccatcacgatgaccatggcgcggctggtgagcaccccgcggcgcagcatgcggcgcacgaccgcccacgcgaggtcgaaccgccgcgccttccccgcggaccatatggtcaggtgccacgcctcggcaggcggcggaaggagggggcggtggccccgcgcgctccccggaggtggcgcacccctcctccccccaccggagcgcgagggccgccgcgtccgggtcgcggcggagctcccagagcgcgcggacgaggaggtcgcggcgggaggcatgaggtaggcccggggagggcggctgaggacaggagaagcgacagcgcgtgcttcggg

SEQ ID NO: 5605 - DNA, 7178 bp, Oryza sativa
  unsure (1)..(7178): unsure at all n locations
tttgttctcccaaccttgctaaaggttgtcaccccttatgtctaacaggtcaataataagttagtctattgattcatagtcacgcttgtaataaattcccatttaattttcctggtttcatatgtcaccaactcaaaataatatgttcaatttagataagcnattcaaaaaaagtatgataaatgttggtatccaagcaacctattagtatagcaacctacttgtcgacgggtgatacccgtagaccggatatagagggtattggggtacgttggtacaaggatctacgtagtacaacatcaagcaaacaaaagacaagaattatactggttcaggccctttgataggtaataaccctaatccagttgatgtgggattatatggtagaaaatacaggttacaaagggaacaagggaacttgtcggatccggcgagattgtagtcgagttgtttcgactagctcccgatgacttggctcctcgtaggctccggcttcgtaggctgtgttggttgtgttggccctgagattcaatgccctaaaccttccccggggggtcccttttatattacagatctggaggtctccacgtagaactcggaggtatcagaccctatacgatacgccaacgacccagttctgcccgagtatgattcttctcgtctgtagattccgtgaaaggtttctttataatatacaggaaatatccgcatgcgcgtgggtatgccatatcgatatgtaacgtatatcgaagggtaaagggtatgcgtaacccgtaaccctgacagtagcccccaacttctgcttaaaataaactcgtgcaaccatttgcaacttcgggtgtcgagattgttgttattcccggtgcgaggaccgcggagatagaccgtagtcgagcacgccatttgaagcccaacggtcacgagcgaattttaaactaaagtccagaaaaccgccgcgcgtaacggacccagaaaatttccgacgggcatctctctctgttccctggaattcgcaccgtcgatagtgcgcctatttaaaggaattttgggagtccattttgaagtccgccaaacctgttaaacacacaccacctccaagcactctttgccttctccgccgccgcaagaaaccctagttcatcaacctaggctcgtttttcggcgaccttcgatcagcaatggacctcggcaaatcggcttccaccagtgcaacgttgaagaaactccaggaggatggcgctcttcctggtcgtggaaccatggagagggaagcaggaggtactaatcctcagcccatcttgggtcgcatgattgcgatcgaagattatgttctctccggttttctccctccaccttccgaatttcttctcctggttttgaatttctatggtcttaggttgacatgtggagtgcgcatgtcaacggtgcagccttcctatcttttccaggctagcgcttacacatgttttatagttgcaaaacctaattataataatccgcaaatctccatataacaacattaaactttggatcaccatgtcttggtcatacaaaatctgaatcgacccgttcaagtctcctaatatttgttataacctaaagaaccttgtgcctttctttttatgtattgttattgcttctttataggcttgtagctttgcttgtgtgcttcgcgtagcttctgtcgttctggaggttcccgaagcgtggtttgcggtcgtcgccgaaggttcggaaggccgttctctctgagcaaggcaagtcacatcatccttgatcatattgaatcccagtttataaaattattttgatttaaattaatgcattatcgctttatttaaattcccgcgttatcactgttttatttagccatgcctatttatctttgttatgaccttatcgttgttgttattgttattattaccttgttcaccctaggaaaataaaaccccaactagtgggtactctattcatggttccactagtaggaatttaggtagatgcttcgccgattaattaggcaacattaggtggttttataactttagactttgggaattctcatatcatttagacactatggaatggttggcttatgttggaattggacacacacctccccctctattcaaaacccccaaaatggttttaggctgggctcgaggtgcatggttgggttttgttagtcgtacctcgggtactataaggattaagctcgggcctctgttgcaaagcactaccgtacttccacatgtctagtgggtaaggcttagtttgtggctcagtctggttataaacaaaggtacacggatggagatggacgaagtcgggggtcgatggacatctctaggacaaatgaaggctacacgagctgcggcccggtagtcgagatgtcatggcacagggttggtgtccttctgctaggggctcaatcctgtctgcctgtcccggaggttccggccgtaggtggggttgggtcggtactcttgtttatggctaggatgggttgggaactatgtcacatcttccgtccgtatgccgtggtggtatgtggcacgtggttacacgtgaggaagatgtgtcttgtgggtaaagatgtacaccactgatcagagtataacctattcgaatagctgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatcttgtatagctctaggatcgtgtttaccaaatcgctttgggaaactaagtgacttttaaatgctgtttactgcaaaacttaacccctatattataactcccttgtactcccttgcatttattctgcacttgtgggtgtgtcttgttgagtacggtggttgtactcagtctcgctcaatttttcccaaacccagaagaggagttcctggaagatgaaggctttggtgtctagctcgtgcctgccgtcaagcgcctgtggttgtcgcgctagtcttccgctgtttttcgtttgtcttcttgtgtgctgggccttcaccgcccatgtaataaattatctatttacgcttccgcttgttaaactctgaattgtatcaacttttggtgtaccttgcctcctgggacaaggaataatacacgcacgtaaggaacgcccattgggttatttccggtcgtgacacgatctctaacaccggatttgaaggcgcgaattacaaaagcgtcggtgatttcaggaattgtgtttctgccctcgttgaaacgtcgaacatattccctcaatgattcacccgagttctgtgtcaacgcgtgtaggtcgtcttcgatcgcgtggcgcttgtatgttccttggaaattggcgatgaattgttgccacaggtctgcccacgaagagattgagtagggaggaagatgcatcagccatgaacgtgcagaacccttcaacgcggttggtaaatagttcgctaacgcgttgtcatctgctccggcaacatagagtactgtggagtagacttgaaggaactcctctgggtcggtgctcccatcatacttttctattgctccgggtcggaatctctcaggccatcggacatcacgtagggaacgaccgaaagctctacacccagcgttgggggcggtgggttgtcggcggtcgtgtgtgcttcgtggatgtctgtctgacgatgaggaggacgcggatgatgacgatgacgatgggtcgcttggttccagcgtacgattacgaggatgacggcctggatctcgggaatcctgtcgtcgtcttccgctgttgtctcggcgccgatctccatcgtcgtcatcgatacggcggcggccatgaccagtattgtctggcacccgtcgttcgcgatcgttgtgatcgtggtggttgtcgtggtcccggtcctcgtttgagtggtctcctcgatttccgttatcatggcgccgtgaagagacatgacgccgagagcgattcacgttgtctcatgtgcgtcgtgcttctcggtggccgttgatttaatctcgaagatcgccagtgccgcgaggtggaggggtagctcgttgaggtgattccctccgttccggatcttcaccattggcctcgctagttggtggctgctcctggtgtgctgcggtagcggcttcttcaaacgcgttgctgaggttagtcaccgattcccgtagttgttctgtccaacgctcgaggtcaacattcagaacgggatcgtaaggagtttccctcagtatcgcttgaacggccctgatgtgctgggctggagtagtcgattgattccccacttctgtgttggtgtgcgctgacgtgccaacgtcatcgatagccaatacctcccgcggcgcgctcgttgtcgatgacccatagtcctcaaggagatgtaagaccgatggtttgtgaggatcgatatcgattaccccaacgaatcgatttgaagttggagtcactctttgttacttgctgttatccctgatggggacatatgacttaggagatagagctttcatggcgccgagaaagactttgcagctcgagaggtcgtgattctttgtcttgtgaataggacaatagacatcccgagttggagaagtacgctgaattccacgttctttgcaggcgcgaatttcagcacagacgttgaggaaaacccagcaatcttgcagagtgtgtttcttggttttgtggataggacaccaagaccttgtggcttcggaagtcatctttgtcggctcgtggttcatgtcggaaggacaaagtttggccgtatcagaatccttctcgagcttggatgtcgtcgatattccgttctccgtctcgatgggaggatatttcgacatggaatcgccttggttcgtagccactgcgttctcgtctccggtcattggaggaccggttgagatcggcgtcgtggtgtaaaccgggaagacgatttcaccgacttgagtccataccagcattgttgaagtagtgagtacttggctgaggctggtgctgacgttgttgtcgacgaagctggatgacatagtagtagaaccttgagtaccaaggccccctacctggcgtaccactgtcgacgggtgatacccgtagaccggatatagagggtattggggtacgttggtacaaggatctacgtagtacgacatcaagcaaacaaaagacaagaattatactggttcaggccccttgacaggtaataaccctaatccagttgatgtgggattatatggtagaaaacacaggttacaaagggaacaagggaacttgtcggatccggcgagattgtagtcgagttgtttcgactagctcccgatgatttggctccttgtaggttccggcttcgtaggctgtgtaggttgtgttggccctgagattcaatgccctaaaccttccccgggggtcccttttatatcgcagatctagaggtcttcacgtagaactcgcatgtatcagaccctatacgatacgccaacgacccagttctgtccgagtaggactcttctcgtctttagactccgtgaaaggtttccttagaatatacaggaaatatccgcatgcgcgtgggtatgccatatcgatatgtaacgtatatcgaagggtaaagggtatgcctaacccgtaaccctgacactactatattctgagacgaaaggagtattaatttctagttttagcatcagctctaggctctagaataatcttgaattcatctatttatcaaaaaacagaaacatgtaatgcatttgctttacttttcttacatattatataaccaaataacacttttaaatatttcacactttcactggaaaaaaaacatttatgtcctatttcgcagaggaaaagtttcattttttgcacacagttgtcatttcatcgcttctccctatgactaatttgcctacaatcaaatttcctttgcgaattaactccaaactaaaaggggtacctataaaacattcgacagaatggaaaactttcaattgtaaatactatataattacattgtaactatattttataactatattgtaactgctatgtaactgcaatataagtaatatgtaactcatatataactctgaaaaattggatggatcaattggttagttgaatgagcatgcaagctacaggtctcgggttcgatccttgctgtgcagcacaaatctcaaagcatatcgtatggttaaaaattttacagttttcacccttttccatttttctctccacagcacaaatctcaaagcatatcgtatggttaaaaatttgacagttttcacccctaaaaactgttgacagtataatagcaaatccgaactaaaaaaaaataacaaaaataaaccttaataaaataagataaatccgatctcaactctaatcggatgtaaaaaaaaaatcataaaatagacgaaagcagcaactacgcacgtgcagccgtggaggcgtggactcactcgcaatcgcacaaaaacgaactacggcggcggcggcgatgggaggcgagaccaccggtgttagcggcggcggattccgcaggcggttggagtactacctgtacagcggcgagaagaagcacgtcgtcgccggcatcgccatcttcgccgccatcttcggcgttccctggtacttcatgagccgaggtacccctgatcatcactgccctcggcctgctctttatcattccgattttcttcgaatcaggcggtggagtcgttagattcacctaggccggagtcctgttccgcgttcaaatttgatccgcagccgtttaggggagctagggttcttggtaatctcagccttagcacagttcgtcgtgttgcttccccctttctggttgctggattggggcttcgaggtagtactagtagtaaggttgttaaggcgaaggttccattttgctcttgtagtgttaatggtatttggtaggacggagcagtgtgcaaaatagttcaatatgaggatttttggttagagtataatctgtttctttttcatgatttgagnnnnnnnnnnnnnnnnnnnnnnnnnnnnnnnnnnnnnnnnn

SEQ ID NO: 5606 - DNA, 21141 bp, Oryza sativa
  unsure (1)..(21141): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaagggatgcaggctgcagcaggcagggccgacccgaggtgaggtgtggcgcggcatgcgtcgagcaagctgcgtgcgtgggcacgtgttggtcggtctggcccgtgctagctgggccgcgtaggaaaaaaagaggagggagtggactgggccggcttactgatgggctgaaaaataaaaggataggagagagaaggctagcccggcctgagagagaggggaaagaggacgatgaatagtgctactttattaataactagtgaggcacgtcgacatatattgaccatatacatccactgcctaaatcaatcatgagggttagtatgtggtaacataaatcataaaaaaactatgttctggtaatgttatcttattggaataaatcattcctgaagatgttgatagtaagttccatatcaatcctcattggttatcttttcacatgttggcgagcttaccatatcaatttgaggttatgtatgtacttaaagatttcttgtttgatcaaatttattttgaatttgtaaaaataaacccctacccccatgcctctctatgacatttttcttccgtacactgacatttttccctttgcatatgtctgaagcagcaacaaacactgactaaacatgtcaacgtgtgtaagttattttcaagatgagccgactcacaactgcaccggctcccctgcatgttcacgtctttcaccaccggtttgctccgctccctgtgccaccacagctccttgtacaacatggccaccaacgtcgcctcctcctccacgccatcgtcgccggccaccgtggtgccgaagttgtggaaccagcgttggccgttgccgccgccgccgcgccccacgggttgtgtcacaggtccactcggtatcgcagccaccactcctagtcatcgtcatcgactgccgccgccatccaaacttcgtgggtggccacgctcgtgcggacgtgatgcacgtagcacagctcaccggcgaggtccgagagacggtcgtcgttgtgtcaggccgtgcagcccagagaggacgggaccgcgtcgaacgcctcatctcgcaggttgaatcacagcagctcgcatggctgagactcgttgatgaaccagtagaaggaacccccacgcgtgcaggcggcgggtctcctcccgccgggactgatggcacgcgacgggtcttgcatgcgctgccatccatcgccggcgcctgtgtcgagcgtgaagatctcgtgtccgatgttgtagaccggcggatcgttgtgggacttgcagtagaagcacctgacgacgacgtacctgttccgccacgggtcgaagccaaccgccgccgttgattctgtagaccgtgggcatgggccgctgccgttgccgggcggcagcacaacgagctcctgggtggccgggttgcacacgagcatggccctgccgtaggtggcgaaggcgacaaggccgtcgcagtgggtggggatgatatggcgggtgatacggccgccgttagggatagacttgtggtgcatcggatcagtctcggcggtgatgtctagcggcggcgccgccaccgctctcgctcctggtctagcccccgcccgcagggtaagccttagccggtgaagctgacaacctcgaagttggagagtgtgctttctcgtcccatatatcttccgtgctcgcgacagcaagcaaggatgacgttggcagctgcctcgcgcgcaaccgctcgagttggcagcggaccaaggcggggtcgtcgacggcggcgtgccacgagcggcaaactgccctgaaacatgcgagggatgttactgggaggttcacgaagatgtgggagaagaacacgtcgtcggggatggatgtggtggtgcccgcataatcttctgggatcgcggcaacggcggcagcggccagtggatgcggtggattgatttgccggtgaggtgaggagggcggagcggcggcatggggatggcgcgtgtggtgcagtttcttcctttcgcagcgattctttttttcgtgcgcggtgcggtttctttcttagggatgacaggtgggacccacgtgagagtgggtctagaagattgcgggattggtaatgaactggtactttttatattagtagattagtatagagtatagatatagatttaatcaagaatttgtgcaaccggacccacgtgtcaatgagataataatgcaggattaagaggatgattactgtgcaagattaattaaaggaacatgggtcccacctgacagtgtcccttttcttctcttctcgatttctcctcttctcgatttcttctctcctcgttcctctttcttcttcacgcgcgcacgagcggaggaggcggaggcgaggcgaggggtgcggggcgcggtttttttcgatttggcgacggttaagcgctaattggagggttaagcgctaattgcaactaaacaactcgtgctttttatattagtctatatctagattatattcacaatatgaatttatataatatagtatgattataaaagaaaaactgttgcaccacattcaagaatgcatcgagtttgattataagattgaaaagaactcacagttgcagcccaaatctgatgtcgcaaatgaatgaacattaggttgcccggagatcagcctccttagcagcgccaatgctgttctgtgctttaccaccagctatcctgagcctctcattcaaatggctttgacaaacttgcctgaaaaatcacatgcttcactctctcccctacttcctcaaacaatcgtccacttctttctagcggaacaaagagaaccattaggagtaaactattattatcatcatgatatttactatgagtaacagaagacctgaattttctctggatggtcaatacttagaaattagagaaatcatcaaaacacggaccaaaattatccatgcatgttccaaaattccatcaaaacacagataagatgttacttgaagagaaagaaggcaggagtttgatgcaaccatcttctcctgtagctttggaggcggaggcttgatgtggatcaaggttggcagcggtgcatggactatatggaataagagtgttattagtaaatgtaaaggtgcagcaatccttgtgccggcgaaatgaagatttggtttctgaaaaaaggttgactattagggcccaaggccatagaaaagtttgatttttggatctaactaagcaaccagcctttcaaatccaatttgtggggtagatttgcacaaaacctatcaatcattttcggaaaacctttttctaacatcttttccaatgaattagatttgcacagcacacacaaaaggattgatagaatttgaaaatcaatgtgtcattaggacaaaaaaaaattccctggagcaaattctatggttgctccctaagcaataacttttattttgatcaaccagcaattcatgtatttttatcccaacaaattaaaacatcaatgttggatgtagtaaatcaatgatcttaatgttaaaacttattaaccagaggttagctcatgattcatgaatatttatttcagaactcgccaaagtttgcaccatgccaaagtatagtgacattctagactttaggtatgtattggtcacaggaaatgtgaatattctgaagattattaccagtcgaagaccatgcaaaagcctaagatgcaatccaaaggtcaaacctgagataaaaaaaaggaaaaaaaatttagagcaccacatcattctgaaattgaagtccaccaaatactgaagcagcaccattcagggggtaggccagcatgacatccatgccaacgatacttgtgagatgaccgacaaagaaatgctcgacttcttcgcacaaagtgtgatgattagtgattaggccaaagatacttgtgaaaaattaattccttcatgaagtccagaaggaaaacttcgatgtgatatattctcttgtactaagaggggccaagatggtaagccagtcaacagtctcaccccaattagaacactttatattagaaactataaatgttaaaagggaaaagggattatgtgcttgatttggttacatgatacctctccaccaattttgttagccaagcacaggccaacagctcctccatttttcttcccttatatctaaaagctattcaaatgattcaggatacaaataagctattattagtaaataataaagtaaaattcacaagtagttttcagataagtaaaattctgatgaatataaagaagcaaaattcacaagcaattttcagataagtaaaggccatattacgatgcacagatccatggaccatggggcatgtttaatgtaaaagtcagtcctaaaatacatgatctacaataccatattacaatgcaactcactaaatccacagatcacttgaaaatccataaaccacgttggctgaaacaaccaaatccacagaccacgtttcaataaaacaatgtaggctcaaatttgcaggtaaccgatggaaaacaaaaaaaaaaacgggatttcaaccgggggtggaggccggcgaggtgctgcaacggcgaaggggagggcagagaccggtgaggagcataggcgatggaaggaggcatgggagacggtcggcgaggaggagcgattccctccctgcatgcccgtggctgggttctcgccgaggcggaggcggcgcgcggtcgacgggagggatcgagggaagtggctcgtggtgggggaggagatcacgcgtcgacagaaggggagggaagcgtcggcgctcggcgtggggagaagccgcagagcgagcggttgttcgtgggttttcttttttttttttcctctctctctctcgccggacgacgtgggatttaattcctctctcctttttaccgatcgctctaaccgcggattagcagaggtgaatcgctaattgcagggtgatccaactcttgatataatccgttggatgaatagatctaagggtcgaaaaagataagtgttcgatgaactggtgctttttatagcagtaagtatatagattattaagggattggaattggagtacagtttttattttttttattcaggattttattatgaatttaaaacttgatgaattttggagggaacattagatggagggatatattgatcaaatttgaaatcattaatggcacgagatttcaaaattttgaaatttaaaacgtaataaaaagcgtttttaagtaaaggagtcaaactcaggatgctacataaaggttttattagggttcatcttcccgaccggagaaaaatcaccaagaagagagtacatattaactacctgatcaaggcagggagcataactcttatgtagagtgcttcaacaacgaataatggagattgccgaatcttaattaggtagctccagaaaaacttgtcccgtctttatatttgtaactagaaaaggtagccgcaggcacattactgacaccttgtttaatgttgcttgaaattttatgaataatattaacatgtgggtgatttttttgtaatatgtttttattatattctaaatatgtttttgtccataatttgtttaggatcgctgctttaaatgttggtcatgattttcttctaactaccctatcaacatataaattctacattaaaattatttattggaattcataaaatcttgagtttatgagaaaatatcgtgtcgtggaaatggagttgattcgtatggacctatcatttgtactatatgtgtttttaatatttagtatatcatatttttggagtttctaaactttaagtaatagcttttcttgtgtactatagatatctttatggaatttaggatattttaatggaaaaaactttctattaagatatatatggtaagaggaaaattttgtccaattataacaaatttatatttacttctgctacctccttttttcatatacttactatgttcttggaaaaatgaatttaaaattgaaataagagagcaattatataaatgaaattagtttgtgtagagtatttataaataaaattgttgatgacattggttgaaattgggcgtttgtcaatagcatttttggattttgtcatcctatttagtcataaatatttgtcaactgataacagatatataatgatatgctttatattgtcatttgttatataattttcatgtctgtttggattatatgaaaagaatcaaaatgcaacctgaaatataattttattttataagttgaaatatattcaaaacagatagtaaaatattaatttaatggtaaataatatgatggtctaaacttcgttttcaattgtagagcgaatttagttatgcatgtttgtaaaagtgatatataataaaataatatatgtcgccatttgtttgtcatatatgatgaaaagggtcattatatgacccaaaaaacatttttatttattataatttaaaatatgtcaacaccactttaagcctatctcaactattacattatatgtatgtaaaaattttatgtgtaattttgaatttgtagttgattagaatttaatatgataaataacaaatattatctcaactactataaagaaaagattaaaggaaagggaagagaaggcgaggagggccagttgcgtgcatgcagtatgaagtgatatttttttaagggttaattggatcatgccactacaaaatatgccattttagaaaaatatcattactattcacaatattggctacgtgccattggaatttgaaaaaattagaaccataccactccatcacgttttccgtcaaaaatctccgctaaccccaactgcacgagggacctagctgttagtttcatcttcacttccctcccctctcttctctttccccttcctctctctccaccactgtcgtcgaccaccaccgtcactgctgctgtcatcggccacctccgtgaaggcctcaggagccactaccgtcgccactatcgtcggccctatctgcggcgggagacttaggagccgttgctgccactgccgtctgtggcaggaggctcgggagcagccgtcctcaacgccatccacgcggaagggctcaggagccccggccgccgtcactatcctcgaccccatccgcgacgggagggctcggaacctgcagccgccgccgccgccactatccttgatgccatccgcgtgggagggctcgggagccgccgccgccgtttctgtcatcgatcgcatccgcgatgggaggtctcgagtgccgccgctgccgccatccttgacgccatccgcaaaatcgtgaatagtagtggcatttttctaaaatggcatatttattgtggcacagaatataagtgattttagttgaataggatatcatagtactacgaatctaaatccatgtccatgcatccataaaaaaattttatattttgggacaggggaatatgtattttctaattaacttcttattattttaatcttattaattggttttatgtgttttatattgtctagtgtaagctacgtgttgttaatcatatggtttaaaaatctatctgtttttccattaaaatgtgtgttgagtggccaatagctggtccaaagcaatgtatttcttttacttattaaatacagttaattttttgttctttcttcgtttcgtacttattgatatctcctattgctagatcaaactagacttatgtagcacatctactataggttgcaaaattcaggtcacgctagtttgtgaaaggaaaccagggacgatccatgtctgatcgtacatggatctaattagttagttttggggatttggccgagcctatggctgaaacattttctgagtgcttacacctttttctccaaaagtttctcatttgcattaagagacctacatacatagcaaagtacgattgaaaccacaaaaaatagttgattgatccaaataaataaatatttacaagaaaatttattttcattccaaaattgatgaaactttcaagttctaaacactcctatatgcaactaataatttgttcacggctttgaaataatccatttataaacatatttccccaatcttgaaagaaacgaaacttggcaaactgaggttagctcggctgttttttattaaggaacctgccaatgatagctgacactgaagtgctagacttggcatgagtgatcgtatttacagcaaattattatttccatggtgacgacgtgttattgacaacaagatgtcaatggtggctttgtcaatttcaaaatatgccagcccaatctctcggaattggtaaggctaggatttctgcgtgtgctttcattgggatcaatgcacgcgtgtgtatatgagcatctgtgtgcttgtactgtgtttcgtaaaaaaacaaaatttgtatttgtttgcaactttcaatttatatatattcacatattgttgtgttattacactaaattttgagtatgcacaagcatggtttacctgtttattgcatataaaattttctgaagtgtataaatgcaaatccaaaatgggtgtattacactaaggtgtatagaagatctgtactgatagcactaggatttgagatgctctctgatctctaggtcctagtactacattgaacaatatgatatggacatataaaccacacattctgccaaacaaactccatacatatgtcttcatacacgcaaagcaaaacacacacacatcccaacttcacatgcacatggtatatatacaccttgtatcatctcttggtatttaacatgtcacaaaactatgaccacactatatcaaaaacgcagaaaaattaaatttaaaaagcagtaaaaaaacttaagaaaaataaccacatatccatcctccaataaataattcagccaagaaccagcaggaagaaggtcgctcccagacgaagcatgcaggctgccaggcgggggtcgccgccggcggccgtcctcgtcgccgcgccgcggtggtggtggcccctggtggcgacattgtgcgggtccaccaccggcgtgccggagccaccgtcgttgggattgttggggttgtgcgaccggtggcttgtgtaaccgcgtccatgtccgccgccgccgccggccgtcctctccgtcaccaccatctcgctgtcggcgcctgtatataaaaaaaaacacacgtatagtatcaattgaaattgtatcagcaagtttctgttcttcacgtgccacaaaataacatatttttttagataatcataaaataacatattcaagttaattactccatccatcacaaaatataacaatttctaacccttaagatttgtctcaaaatataaaacttcttcaccaaaattctattctcaatcaatcacaacccttcaccattcaaattttttcatctacctccacttctcaatcccatttaattttatctagttacacgtgtctaaccctaaaaatccttatattctacttcctccatctacttttaatagtcatatttcatcttagcatatagaccaaggataaataatcctacttatcatccatttaaacatgctactagtcattcctcgtaaacaagcgattcattaatatttacatttctcgatgcctatatagctaatcttgtgtggaagaatgaagagtcacgcattaaatccaaaaaaatcattaatttgataggttgttggattgaaatatacatatcaaaaataaatttttcagatttggaaatataactatcaaaagtaaatggagggagtagtacagagcgagtacttgattttatatgtccttcaaaatttaaaattgtttttttctactcttttttatggtttgttctggatcgagcatgacacatgatcatcaggttgtttgtttgtaaacaggacgtgatgatgccatgttatatttattattggtgaataatcactttgtgtgatatcacgagagcattagttaggaatataattaagtatcattaacggcgtgcagtgcaagggtctccggaaatgcaggggaataatatctcattaattatactgtgttcccccacatggacaggacagagcatctgttcttgacagggttttcaggcaggatgcctgatctgcgcgctcacacaccacatgagtattcatcaagtttttattattattattgtcttgtttattgatttttgactggagattcaagtatctaggccagccagacccttgatatgttttgaataagttaattactaactaatataggcatgtttggactgaataatattttaacaataaggaaatcaactgctttgttttccaagaaatttcttccagatctgaacattttaatttagtactgaattcttcggtccatcgacggacacaattaatcagtagggccatgcttgacattgcaattacttttgttcattttgcaggtggatatgcatttgattagtgaggaaggaagatatatagatagataaacgggacgacaacttatgcgaggctacccaaaatgaaattagaaacgttttacaaataatagggtgtagataatttcctcaagaaatacacggtgtagataaatttcaaatattttctaaggttttgcttatctaaacttatggcaattagccaaagggaaccaaccacagctataatcttgcctttcttttttagggacccacttctggtgttggttgtacttttgacataatcaaaaaattcatcgtgcataatgcttgtaataaacaaacaaatcttcatgtgtttcccacaaaactaatattgtaagtagtggaacgaaagttaagttgaatagtcgaacatcatgtccaaccccaacagaaccatagaaatcatgttaataacaactttacaaacattcagaaacatacagttctatgcagatacaatacaaaacatatatacacgggagttgtcatcatttgtttcatagaaacatagagctgaaaaaaacgatgcatataaggatactatggtgtaagaaacctactaagacagacatgcagagaagagaaggaacactgcgtacctgtacccttgatagctgcagcaacatgccttgctccatggatacttggaacaaggagtaggagtaggatgagggagatagcaaggcaagatctctttgcactctccatggctgcaatgagcagagctaatgatgtagtagtagtgtaaactgaactgatactctgcctctgctaccaacactcttcatccttcccttaaaaatcctttaaaaatgagatagaataagttcttcaaggaactttccacttgtactgccagagctatggacaccaactttattgtttatttttcttatttctttattttgtaacatccagcactaatacatgtttcctgtttttttttttcttatcctcagctttctttccccaaaagcattatcctactaataagcaacaatgcagcaaaaggtggtcatatttaaaagatatgcaccaagttgttttttttaaggactagtactattattgcacattttagatgtgttgtttggcccgcccaattacgcatgtgggtcttgtaccaattgatggtatgaaatgtcatgacctggtcgtttgtaatgaatagaattaacatgaatgcttcccaaactcctaaacggtacgattttgtagaaaaaaatatatatgtgcgaatttcttgttatactattttaaatccattttccaactttatcatagttaatttatttgtttgtacccatgaaatattatcacaaatcattcagctattcagccaataattactaaggaccagagctattcagaatggaacaagtcatgtagaacactaacttgtgctgtttaggcaaatatgcataggtaggctttgaatttgatcaaatcactcaggcagcgttcacacacaagtatttgtggaacacaaacttgcctctgaagattaaggtgctcatatggttgatgctgcagaattgtattctcactaaagaaaacctgatccccaaagtgtggaaaggatccaagaggagcatgttttgttcagtgcctcgaatcagtagaacatctactcttcaaatggttgtaacaacttctccaggaagctcaaatggtttgtaagatcaactttaggcacaaaactaaaactagtaatgattgtgttggcagcaacattcagagttagctccttccatacagacaattagtcttccattttttttatgggattgaattttggcctggcatggtgtttttgttaatggttcttgtttaaaactatatttagcttagcttgtttagatccttttggagcataaagtagtaatcatgctaagttttctatacttgtttctttttgtgcagagtttctgtacttctttttctttcttgggtccttgtactccggtttcattgtttttgtcatgaagatgggactccttgtttcaaaagaaaatacattcaaatcgttgttcttttagatgcacatcataaggacctttaataaaaattaaaactctgatgaggggagttacacgggatatatcaaggagagttggctcgttttaaaagaaagaccggacctaaaaaccttttttttaaataatggatttaaataaaaccttgccattacatcccagggatgtatacagccacacctaaaaaaacgacaacacccaaaaaatgagtgaaaaataaaaacatgttttagcacggcattatgacacaaaacatatatatgacgtattatctatgtccccattctagccagttgcatggctagaattattttttttagctatatttacgacggcacattttaaaaataaatagttaaatcagttttacaacttatattgtaattaagttttgcgatgtagtacgtagtctagagcttacaatgctcaaatggcacatttaggtcttgggttatttcaagcctagaaaaaaaaaaggggtcaagctgagccctcatcaaaacacgtgttaagaatccatctgagcatacctactgttgaaagtgaatagaatcgattgagaacgagtaagagagaattgagcgaatgaatcggatgttctttattgatcaatgaaggggtggcaaccgtagacgcgaaggttgggaaccatcgcgcccgttgcgacggatcatcgagtggaagagacgcggttgcttcggttgcgatcccatcatgagatcaccttgtagtttcataacacctactatagtagaaagagtatgattaaaattaagtgaaaaatatgacaatatctttcgtaaacccattcttctttagagtatagacagagagaatgttaactaaatgagattttctactgcttttaaggaggtacagttctaatttaaattttgatgatctctcaatacggtgttaagttacaatgccataaattaacactgccgccttacaaaccagtgaaatcactctaacatgaaaatgtgaaaaagatagtgaaagaataccaaaaaggatagctaaacaaaattaacccctgatcaactaatcttctactaccattgagcctaagtacatcgaactagagaggaagcagccaattggcagcagcggcgaggcgacgccgcagcaagcgatcgccgtgctacctccggggcggcggtcggaggcggcggcgccggatttcttgcccttgtgcttgcggccaccgcggccgtggcggccatggtgatcgccgtgggagctttttactacgaccggcaactccgccgccgtgctcgccgtttttttttcctcagctcctgctcatcatcaagattcaagacaaacaagacgccactgggatcagatcaatctaaccacgagcagagagagagatcaatggagagaatgaattgaattgcttgcccgttaattcgttgctgccaattgcagacgaatcaccggctgcaagaacacacgaggaggccaggaggaagaagacgaggaggagcagccattgtttcctgaccggtgaatccatggttggtgaattttattttgctcggtgtaccgtaggatggccgcagcttacgtatttaaatgcaattcgtggaaagatgagtacgttttttaagtttagcaacggattatacgattccaagaacgcattcaacaaaatctcgatttcttggaaagcgcacacacaaaattgcagattgaagatgcggaaaaatctcgccgggaatccccgaatcgggcggattcttggcgattcatttggattcatttcatttcattctatgtacacacagcaagatgaatcgatttaaattcaaatgcgaaatcgggagcgattcgggtccagaattcattcattcagaagcgaagcagagcgacgacggcggcgacaaggagggcggcgcaggaggccgccatgggagggcgcacggatccggccgccgcgctgcgcctgcccgtgtggtgctcggctggctccggcctgccgtggccgctgccgtggccgtggccggcgccggcatggccgctgccgtgaccaccaccacctcctccttccctcacggtgacagaccaccgagccaccgccgccgccgcggcgtgcgtcgtcgtcgtcgtctggtcgctggcctctgcaactgcaattcacgatcaaacacttgacacaaacactaatctcactctcctgacgaagcagatcaactagcagcaaatcttaacaacagtgactgacctttggcttctttggcatcattcagagcacgagctccatgaacgcatggtggaagaagagcaagcaagacgacgacggcgaagaggagcggtaacaatctgatgaggcgacgattatttggtcgcgatcggcaagccagcagcacgggaggaggacgacgagtcactgagcctgcaactgatgatgccattctgaatccgtcgaatcagctgcgtttgtctgctcgcctcacgctggtcatctgaattctgagcgatcgatcgtcgtctgaatcctctcctcccaaatcgatcgccgcagtccgcagatacgtttgtggtgtggtggactgtggagtggatgcaggggaggggaggaagcttatctggtgtgtgactgtgaaatgagtttgtgacccacatgatgcacatctgtcacactgtcacactttctctgcaaacccagctggtatgtactgtgccatgtacacacaagctgctaactggaactattcactccgtatcaaaataacgccgtgtttagttccaaaatatttctttaaacttccaacttttctatcacatcaaaacttttctacacatataaacttccaacttttccgtcacatcgttccaatttcaaccaaacttctattttagcgtgaactaaacacagcctaagttcccttcgattttctaattctttttgaaaatttaaccaatttatagaaaaatgtagtacacacttaaagcattaaattagtttcattaacatattttgatagttcttttgttttgtgttgaagatatttctatatttttttataaacttggttaaacctaaaaagattgatttaaaaatctcaaaacaacttataatatgaaacaaatgtagtagtagtataagtctaacatttaaaataactactcttacgagatagtagaaaagagaaaaatgacatcgatgccccttgttaaatgaggggtatttagaagtaaggttagtggtatgtcgatttaaatcatggtatcttacctaccaagatagaacggttctaatcccattttgtatcataattttataatattcatatccgacgtaagtgtgtcataattacatatcaattttgctatatatttatcgataaattttctcctaaaagtttgacagatgtaattacagtacagccatagtgtaattacactgtaactacaatgtaacttgtatgtaacttttaaaaatctctacgtaacatgttatttcggtaaaatagagtatgggaacaaatcctctcacatgtacgtgttgtgacttagatctaacggtttaaaattatgtgaaagttacatacaaattacattgtagttacagtgtaattacacgtaatttacagtgtaactacactacgactatattgtaattacatttgtcaaatttttaggagaaattttatcgacaaatgtataggtgatcccctcagttctaacaaccttaggcaaactaagcttccaatttttctttaaaacaaaaaattccaaattttagtaaccaacagtaccaccctatatcataagcataacatctcatcggggatagggttgggagactttggattgtgttcactcaaagaaatctctagccatttcaaaatgagtagccccccccccccccctccagaggaaaaaaattgagatgtcttacagtagtatactattttggatagggttgggagatttagtgtttattatatggccttaaaatttttgaaaacaggtatggatatggaaacttttggaactcacaccaaaatctacggctcagcaacaaacctttcatatgtgttgttccggtggaggcagtcgaagggatttaacggcttgtcaagcggagtgcacatcaatatcaatacaggccctacgatgcagtcatcacggcattgctgcagtaccctgtagatttgctcctttattgctgtctagtttcattaggaagtttgctttctttcttcagttgacctctctcttgttaaagatggttcaactcttatctatctcctggtgatgtgttcggaattcatttcccctaaactttgtcttttaataaaatgtgatgtgtttaaaaaaaattcatgagctccataatggtgaagaaagaccgctgatgccaggagctagagcgcgctgccggagagaattacagatttacagcaagcaaaattctccatgttacaactaccagaaacaggcactgttctgaaacacgcaaacggggtaaaatcaggagaaacaaatccatccatgttcacgtacgccacatctatactcggaagatgatcgagggtgtgtttaatttcatatcaaagtagtattgtggcccacgcagattgagcggctagcatcattatatttttatatgttttctcattatattattcaaatatattaaaataacaatataattttaaattttgcaataactctacaaaactactaatgtgtaatgttcatattatattttatatacgtgttagttattaattatttttaatattaaattttagttatttgtaaattatatatattcttatatggattctagactcgtcttttaatatttctttttttagtttcgaattttctgtaaattgtatttctatataaactctatgctcttcttccaatattatttatatttatttcttaatttttatattatattttatatacgtgttagttattaattatttttaatattaaattttagttatttgtaaattatatatattcctatatggactttagactcgtcttttaatatttctttttttaattccaaattttctgtaaattgtatttctatgtagactctatgctcttcttccaatattatttatttttatttcttatatttcatattatattttatatacgtgttaattattaattatttttaatatcaaattttagttgtttgtaaattatatatattcctatatggactcaagactcgtcttttaatatttctttttttaattctaaattttctataaattgtatttctatatagactctatgcttttcttccaatattatttatttttatttcttaatttttattatttctaattgcatttctatgtggactctaaactcatctttcaatattctttaattttttaattttttgaatttcagttacttctaaattatattcctatatttgtatttctatggactctagtcttctcttctaatattttttattttaaattccgaatttcagttatttcctaattgtatttctatacggactctaatcttctcttctaatattccttatttttaattacgaatttcagttatttcctaattgtatttctatatggactctagtcttctcttctaatattccttattttttaattccgaatttcaactatttctaaattgtatttctatatggactctagtctcctcttctaatattccttattttttaattccgaatttcaactatttctaaattgtatttctatatggactctagtcttctattctaatattccttattttttaattccgaatttcagctatttctaaattatatttctatatggactctgttttttcttttttcgattaatgtgagaatttctaggccatgagagcgaacgtggaggctcctttttctattcctttaataatataatagatttggaagtttgactaaaattgaaagtttgaagaaaaaagttataagtttacgtgtgtagaaatattttaatgtgatgtaaaagttgaaagtttgaaaaaaaaagttgggatctagtcaagggccggtcaattctgtcggatggatgccgggtctatgatcatgacgtgaagggctcagataatctccatgactccttgaaatcaaccacgtccatgcaatggaactttgcactacagtcagagctatacgaggatcgatcgaatgtggactgggggattccattcagtaccgttcacaacagaataggccatttaatgtttgaacacttgtataaattattaaatatagactaaaaaaataactaatagcacagattacgactaatttacgagacgaatcttttaagcctaattgctccatgatttgataatgtggtgctacagtaaatatttgctaatgatggattaattaggcttaataaattcgtctcgcggtttactgacggattatgtaattagtttttttattagtgtccgaacaccccatgcgacaccctatataatacctgatgtgacacgttaaaattttacaccactggatctaaacaccccaaaaccaatgcaaaagatgaggccaccatatataatactctattccatatagcaatgatcttaactgttgatttatgagttattccatctactattaacatttgatgtggtagtataaacaaaaatatgacctattagattacagaaaagaatcaaagatgaacgatatatagactgatttagctattaacagaaactacgaagatagcccgcgcattcgcgtggacatgtactgtatgtaggatgaattactaaaagcatttcatgtcttctattattaccttaatcatgaaaaaagtgacagatcccatttatctatagatcttgtaaggaaaggtaaaaaaaataaaacatgagtcctgtaggataagaaaacgtgaaatatctgtcgaatgcaagtataaaactgtctatttgaaacaatattataattatttcgaccttgcatacatacccagtttagaagttacaacacttctaagtgatttaatatttaatactgattttagttcgttcttaaatatttaacaaacttattaagtcatatgtactattataattaaacactaataataataatagtccgtgcaccacacgggtgagcggctagtgacattaaatgctcgaggcacaaacggttttggctctagttttaaccaatcagcttggtcacaggtgcagtcaaaaattcaacaattgctctagaacttcctcgtctcgctggcagcattgggtcttaatttaacttgctgtccatgggcaaatcgtcggtactgatcatcaaggttccaagaaaggatagataaaagtttgccctatgccgccctcgccctctctatttgtttgaaatttcaaaataacagtaataataatggccacgtatttcggtcggtcgcctacgcatttgctgctgtatcagtcaggtcgaaccatgtgcatgattcacccccacaactacttggatgctacaggtgacttcgtttatttgaaaatatatgcgagcatgcacgtgtatgccagatatcaaaaaataatatagaagcggacgctagtatacactcgcacatactacacacctctaggaacatgcatacgcacatattactcctcttatgtctatatataagcactcttgttatggtcatcaacatatcttgagattgattaaattagctcgcgggtactttattgtcgaatattaggttgtttattattaagaaaataattaccgaatatgagcactcgtaccaattctacaacttgaacttggacaggtgaaatgttttttaaaaatatagtttttttctgaatctacatgaatatattggtttgaaaaggaattaattgctgtaatataccttcgtcgcgtccctaagatgcgaggttgtggcagacgcgcgcaatcactgtttggggatgcgaaggcgtcggcatcggacggcgtcgcgcagcagatgattgaatatgattaaatgtgattagcatatgattgaatataaattattaaaatttggaataagttcattttaagtcccgagacatattatatatggtattgcaattcaaaaatgtaattcgaactcgacgtcgagatgagggtcctaaaatttgaacttgacatcaaggtgagtaacctaaatttatttgatcttttaaaagcaaaatttatatatgaagttttcatataaaacacgttgtttagcggtttaaaaaacttgctaacaaaactcaagaaagtaactaagccggtccccactttagcatagaccccaaggcatcggattcagctttggtgacattggtatggcaagtcaccggatgacataccatgcatctgagccatccaaaacgaatccaacgtctgctttagttgggcccgcacgcatgcaaaaaatatcgccgttttcatccccgtagcggggacttacgggcgggaaacgatgtgtagcgcccgttccgtcgtggggcctagcgggaaa

SEQ ID NO: 5607 - DNA, 21821 bp, Oryza sativa
  unsure (1)..(21821): unsure at all n locations
ctttttcccaaagaagaaagggacgagccccctttctctccctccttttcccctttttcctcccgccgggcgttatcctccctccaccctgtcgccgattggacgcgagcgccgagcgccagctcgcgcttgaccgcccaagtggttccaaaccgacattgtgcccttaaaaggcccggggggccttcctttttttttccttccattgccattgttgccgcctttcgaagttttgtttcgcctccgccgttcatcgccaagcgccgggaaagccggtgcattcgtggacgcggaaggggactccgggcgctcgtcttcctcctcttccccggcccgaggccggagagattactcccgcgccgtcggcctctcgtcacagcgcccctcctcatctcgatagtgcctccctccgttctccctcctcgctccatcttccccccttagttttcggtagtagctcgagtagcctccccgtagctagccggggccgccccgaccgttaccgccggttgcagtgtgctcgccgccgtcgccggccgtgctccgtagcacccggttgttgccggcctcgctcggcgtagctccgcccaatccgacgctagcaacggattcccgtagccgcgtagatgctctcaccgccgggaattggcccctcgtgacctcatcgccgtttcccccttttgctctccgccggttgccgccgccgaaatccgccgccgacggactccctccggcgaatccaagccgttggctcgctccctctctttcttcctcgtcatcccggtgtacgccccgtcgcccctcatcgtcgcaaggcgccccggagaaaccgccgccgcccgccgtccattcacgggcggcgccttcgtcttcctcccgccagcccgcgtggcagccacgtaggcgccacgtagacgccacgtcggcgccagctcggccaagatcgggtcgggccgaccccggtcagcccttccgtgcgcgcgttccaccacgagccgcgaggctgcgcgtgggcccgccgcaaccgttcctccgcgaaccgcgcgcgtgcaccgcgtccctccncaggccgcgcgcgtacgccgcatgctcgctccgcatggtgagccgtgtcaccgacaagcgggtcccacccgggaccgcgcgtggtgagcccggtccaccggctctcttctcctccctcccgcgcgcgcgcgtcttgggccgccttgggccggccggcccatttagctcggccggccgccccatttctcttgggccggcgccctaagccgcccgagaaaagtctatattccctccctctttccttttcttttcttttctttttcataaaggatttaattaaatccttttcttttagaccaaaaaatccaataatcttagaaattcaatatcttcccaaccgtaaatccgtttgactccgttcaacttccaaaattcctcaaatctcgagatctatctaatggcacgcatagaggtcattaatagggcttttttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcgcttaaactgttgtcccgtctgcaaggcagattggcggacctacctaatttgttgcatttgatccttcctttgataattgttatatcgtgtccccttgtaaccatctagttgcgtctcgatattcgtgcaccctgtgcgagtatcgacggacgccttcaaacttaaaatctgaaaaacttcttgggtaaaactcgggttttacaaaagacttggaaaacccgacacctgggtcggtacttgcgaactaaatgaatttccaaagccgcggaccgggggacgtaccgggtgtacggtttcccgctctcgcacttaaggaccgtttccttggaatttcatccaaacataagacaagtatgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgagattgctgtggtggaaaggggttcgatgtttgaaaaatctgcagctgatgggatcagctaggcccgggtggccgtttgaaagttgttggcccgggtggccgtttgaaagttgttggccgggtgccaatcttgaacaattctaaagactgatacattgcacatactccgactggatgagacgcactgtctcatccgtgtcgtttgagaagcactcacttagttgtttttagaaaagagtttgaataaaatcaattgtaaaaacaacagcatttccttgaagcctgcattaaacacttatttcccatggtttgctgagcactcccgtactcacccttgctctatataaataatccccccagttgctgaagaagatgaagcagatcctgctgatgaggagttcttccaggagcaagccgggtacgatgagttttagggtttcggcctaattcccaagtcgcgcctgtgttgtttggtccaagtcctggcttccgttccccttttgtaatgcagttgtgagctcgggatctgtccgcagcccaacatgactgtacctctactctataataaagagacctctgttgctgtgataatccgtcttcctgtgataccagcactgtttcctgggactggtatcgattaacaggttaatttggagcgtcaagggctagttccggtcggtactagttcggggcgtgacacgatgcccccaatttctcatcgtgcgcgtccgtgagtcagcggggagtgtcaccgctgaatctgggagagtcgccgccaccgtgaccggaaaggtgacaggccgactagctcgccgcgagtgtggagggggtctggcggctgccacgtgaggccggggctggggccctgccgtgctaccgcggcaggccgcgtgtggaggcagccagccaccgggcctgacatcaacgaggtccaaccgcctcccggtgcggaagaggtgcctgcgcgcccctgtgcttcatcaattttgctgtgtgtttccctttcagttgggtgctttggctctgttgctctattagtgctagctgttggattagctagcatatgttcagtagaattggcgagatggaactccaaacatcaaaaatatgccaaaaccaacacagagttcagatacatcagggtcctcgtgcagccgccgcccggtcccttccctactcgcggcggcgcggcggcctccagctagctcgcggcggcagcctaaggcgggcgaggggaggcgaaaaggccgcccagtcccctccccagtcgcggtggcgcggtggcgggcgcctctccggcctggcgcggtggcggctcccagctagctcacagcggtggcctgacacgggcaaggggaggcgaagcgacgaggcggccgcccagtcccctcctcactcgcggcggcgcggtggcctggcgcctctccagactggcgtggggaagccgcgatgcgagcacgcgagattggggcgagattggaggagacgtcgtttggcaagaagggtaggcgcgtggggtgaaaacggagtcctgcaggtgggccagtgcagcggaccattggattagttttcaacgccccagatcactccaatgtcacaccgtgccatgctatcgcaatatcaccgaatctgaatccaaggcttcatcctacctgacacattcacagtgcgggatcgtcatttaagcacccttaaatgccacataagcacaagattcatttagagcacataacccatggtacaggatttcagaccctagtcatttctttgtcaatccctatgatattttctattgtcgaataaattaaaacttttatagtttacaccctataacaacaaaaaggagtacacatatatctagcctattgccggacccatatgtcagacctgacctatacgttttctcctccccaccaaactctccctcttacccaatcccctactcctcgtacagcgccgccgcttctcccctccactggcgtctctcctctccaccgccactatcggagaggcgattctctagcagcagggaagtgcagacgtgtcccctgatgaagattcaaccaggggttggctacaatcgatgtgtggaaatcacctaggatggggcacgagttccccacaatccaaccaataccaagaattatacaggtttaggccacccggaggtgtaatatactactcctaattttttgtgtttgctatctggatctagaaaaatacaaactatactttttcaagctaaactcaagcatccctttcttagtggcatatccccttccttttatagtccaaggaggggctcagattaccatttttgcttttcctctatgttctctcttggttgtcttgccactgccagttggtttccttccaatcttcttgaaaaacctaccaaaaatatgtgattaagttgccccaggctctccgggcattggtttgggccagctccatgtagctcgtggtgggcctaccgatccccaacctacccaaaatagtgccacagctcctttttgtccagttggaaaagtcgtgtgtcgctgggcatgcgcgacgcatgtacagacgcccgttgtccctaatcactcagcgttagtgtcttttccatgtcttttaccccaggccacttggagtttccctcttaaacctatttcatttatggcagtaaacgtttgcccatagctggtagaggggcacgttcactactcaacaaagccttctggttgtgccccttgtcctagaaaaggtagtttagttatttttggacgagcttcttgaagatgtctttgatgaaaagttgtaaatgtgtatatcttatatgtctcaactctcctctcaaggaaagagatgcatctcacaagggtataggagggaccaagtcccagaccaagctgtgacccagtttcctttgcctacaattttaagatatagattttatatgtctcgacactcctctcaaagatgagcatgtaacctacaaggacataggggggaccggatcccaagctggactaggattcaagctccccttggtttgtttgcttgagacataaatcttgcacgtctcaacactcttcttgaggaaagaggtgaaacatacatgagcaaaggtggggccgggtcccaggcaggccgggatctaggcttccctcagccttaatcttaagatgtatatcttgtaagtttcaacactcctctcaaggagggacgtgttatctataagggcaagggagggcctaggtcctgatacaggcttcctggccttcctcagccttccatcttaagatgtagatcttgtacgtttctacgcttctaccaaggaggaatgtgtaacatacaagggcaaatgagggcccgggtcccgggacaggctgggaccctggcctccctcagccttcaatcttaagatgtagatcttgtatgcttccacactcctctcaaggaggaacatgcaaaatacaagggcaaaggcaagcattggtcctagagcaggatgggaccaggcttccctccgccttggtttatgatcttaagatgtagatcttttatgtttccacgctcctctcaaggaaggatgagtaacatacaagggcaaagatgggcctaggtcccagagcaagctaggatccaggcttccctcagccttattcttaaaatatagatcttgtaggcatctacgctcctctttgggagggacgtgtaacctaccagagcaaaggtgggcccaggtccctaggcaggctggggacccgtgcccttcaaaccatataactgtcagggttatggataccacatatctaatagtagttgactaaatctcggtaggacccaccacataccatgtcctatacggaaacaacctgcggatataggaggagttctggataaggaaggacaaccagagttctacatggaaatgacaaagactactcggattgtatccatattggtttccctagttttacttggacaaggggacacctatgactataaatacaagaccccctaggaggagaggacaatcaacgcccagcatggaagacacctaccatagacgccacaaagccacaagccaatacaagccaacatacgtcaagacaagccgccggatatcgacatcagagatatgtctagatcgaccctatccggtaccttcagaggccgaccgtagggaactagcgctgtctctgatctcgccgagcacaaactcgacgaggaagactaccctgttgtctactacgagtcagaactttagaccgccatatcaacaacagttagataggctaccccaaatattgtactggtgtgattatggtgaataagagcaacgaccggcttcggccaacaggatgtagggttattacctgacaattcaggggcccgaacctgtataaaaatcctcgtctccatctcttttacctcggtctcgcgtatatcctagtaccaacgatccccatactatgcaaataccggaatcgcgacatcaaatgtcgacagtggcgcgccaagtaggggatcttttggtgcttcaaggtttcgacgagatgtgtttaagagatggattctccgacaacgagctactcgacgacttcagctgagggggagatccaacctaaccagatcggaaccatcatcgtcatcaacaacttggtctatcgagatcatccaagcctcaagctccgcggcgtaccaaaagatgtcagatcgcatgatatcgaacgagtacgcaacaaggtaattggtagattggttttttaaattgatctactaatttcgtagatacatccggcatgtatctacaaaggtacgcaatagtttatctgcaatttatcgtacctattcagatcatacagcattgtcaaatccatgatttattttgtttacctagagcatgtttttatacaatatctgttgcgcgggtgtccccgatgttaaatcgactacggtctaacgctgggggctcgctctgttctctcctatatgaatcatgcttgcttacggtttgcataatgcctgatatttacatttgctcattatgtcctgataatactagaagatccatgcagttttttgagtacatactcgatattatctactatatgtcttgccttctagaaaatattcttcaggaacaattgagcacctgagtaggttgtggtcgagtacaccgcattatcgaaaacgatctcgacaaatgctgagtcgtcgtgcccaacctaccaacgaagaccgacgacctatctcatagtaccggccatggctggactactcgagaaaaggttgttaacggataattcctcgcgaacgtcgtcggcttgatcacccgacatgattgcgaacggacatccggatatgctacaagttgggtgtgtgagtcatgctggccacatgagatgcacatgtaataaaccaactctagcgcctccattggtgttcgagagataactctacttgctcgctggttctcgaaccagcacgtagcaatctctcgcaccgcaacttccattggtgtccgagagataactctactcgctcgctggttctcaaaccaatacgtagcaatctctcgcactgtaacctccattggtgttcgagaggtaactctactcgctcgctggttctcgaaccagtatgtagcaatctctcgcaccgcaacttccattggtgttcgagaggtaactctactcgctcgctggttctcgaaccagtacgtagcaatctctcgcaacgcaacttccattggtgttcgagagataactctactcgctcgttggctctcaaaccagtacatagcaatctctcgcaccgcaacttccattagtgttcgagagataattctactcgctcgctggttctcgaactagtacgtagcagtctctcgcaccgcaacttccattggtgttcgagagataattctactcgctcgttggttctcgaactagtaaaacgtagcaatctctcgcacattaacttcagatggtcgaggtacgactacagcaataacgcagcggtcctcgcaccatgacttcagatggttgaggaacagctacgactggtcttcgaccggcagcgtagcggccctcataccacgactccaaatgatcgagagacacctactcactagttcttaaccagtcaattgtcgcgatctctcgtacatttacttctagtggtcgagttacgactactatctggtcctcgaccagtggtgtagcgattctcccactatttccacttcaagtagtcgagtacgactactacctggtcctcgaccagaggtgtagcgattctcccactacctctacctcaacaaagttgatatcaggtacacaatgttgccaagtgttttacccagagatcccttaccacgatgacacctagcgttcaaacctatcctcatgtccctttacgctgtcttgacaaggcctccgaggaacctaagggaacttcggctagggacgcccagagccgataaggccttgtcgaatcctgtagagacaaaagaccatgtaagagctggttgtgtaagagttctcgccgtgcgtattaaccaagccgtataatcagaaattgggttttccaacttcacgactgggggctaggatcagtgcttgttcaaccgaggcaggtcaaaggtccaagagccttatcttccgagaacgattctccgacgacaaggctaggggctagggagagtgtataactcaacaaactgactgatcgaagtcggtaaaagagtagacgctcatatacaaaacattggtctgtaaaattcaattcattttcaattttctatacatattataacatgtcaccctttgagcattcgctcgggggctatttctatctaatattcttttctgagtattgatttcaggaaaattctattcgacattgacgaagactccatgtctctatggttctacacaccaagatcgactaaggcgagcacaacaaatgttgacaaggtttcgttgcaagctctgtgccttctcgatcactcgagaacagttggtggatctcaacaaggaatacggaatgaagagatggtgtactcgccgagataagatttcttgacttcaatccaaattctcgattacagcaagatgggagacatagtcgtatattctgtactttcttggttgacgtcagagattgactcagacaaaaccctttaggtgcccgcacgaggctgataaaggaagtctaacgttaactctaaactcaccgagaacggtcacgttagcacgataacagttactccaaggtctgcgcacggttgagaatatgaattcgttcatttgcatcgaagtcgggggctactatcagggttatggatagcacatacctaatagtagttgactaaatctcggcaggacccaccacataccatgtcctatacggaaacaacctgcggatataggagttccggataaggaaggataaccagagttctacatggaaacgacaaggactactcggattgtatccatattggtttccctagctctacttggacaaagggacacctatgggtataaatacaagaccccctaggaggagaggacaatcaacgcccagcatggaagacacccaccatagacgccacaaagccacaagccaatacaagccaacatacgtcaagacaagccgccggatatcgacatcagagatatgtctagatcgaccctatccggtaccttcagaggccggccgtagggatctagcgctgtctctgatctcgccgagcacaaacttgaggaggaagactaccctgttgtcgactacgagtcagaacttcagaccgccatatcgacaacagttagataggctaccccaaatattatactggtgtgattatggtgaataagagcaacgaccggcttcggccaacaggatgtagggttattacctgacaattcaggggcccgaatgtcatgaccggaaataacccaacgggcgttccttacgtgcgtgtattatttcttgtcccaggaggcaaggtacacctaaaagttgatacatttcagagtttatcaagcggaagcgtaaataattaatttattacatgggcggcgaaggcccagcatacacaaagacaaacgggaaacagcggaagactagggcgacgaccacaggcgcttgacggcaagcacgagctagacaccaaagccttcatcttccaggaactcctcttctgggtttgggaaaaattgagcaagactgagtacaaccaccatactcaacaagacacacccacaagtgcagaataaatgcaagggagtacaagggagccataatatagggggttagggtttgcagtaaacaacattaaaagtcacttagttgctcaaagctactttgtaaacatggtcctagagctatacaatattattaatcaaggccgtgaacccacacgaacctaccttaacccaaggcctacgatgattcagaccgaactggcaacccgaccctgggtcccagctcgtcccaagccaacccaggccaaccattccacattttagttgttaagaaggttttaagaattaaaacactaacttgggtacattgctaggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctacaatcaaaaccatgcaccccgagcccagcctaaaaccattttgaggattttgaatagagggggaggtgtgaatccaattccacaataatccatccattccatagtgtccaggtgatgagaatattcccaaagtctagagttgtaaaaccacctaatgttgcctaattaaccagcgaagcatctaactaaattcatactagtggtaccatgagtagagtgtccactagttggggttttgtttaatctagggtgaacaagttaataatatcaataacaataataataaggtcataacaaaggtaaataggcatggctaaataaaacagtgataacgcgggagtttaagtaaagcgataatgcaataatttaaatcaaaataattttataaaaatgggatccaatatgttcaaggatgatgtgacttgccttgctcgctttcccaaacgtcggcttcaacttccacaaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtctaattctgagttcaaatggccaagttatggccatttgaagtttatatgctctttaaatgaatatttgcgaatttcttcatttaaattttagtttaaaaagggtttattgcgtcagccgagggggagaggcgcgcggaccgggtccacgggagtggggcccacgcggcagcctcacggtccacggtggaccgggcgcacccgggctcacaccggccggcgccgtgggtcccacacgtcagccgcacccgagggcgcgggcggctgacggccgggccccacgtggcagccactgggcgcgcccgaagcggcctcgccggcacggtcgacgggaggcggcgcgcccgcgccccgatggtcgccggcggcgacctccggcgcgacggagcggcgcccgagagagggagggaagggggaagcgagatggcggtcctcggctcaccctgggtcgacggcgacgacgggaacggcgaccgaagcggagagaggcggcggcgcggctcgggtcgacgaggacggcggcgttccggcggtcggcgggcgaaacgaaggggtggacgaggtcgacgaggacgcggcgaaccataaggaggcgatgccgaagcgggaggaggtcggggcgacgacggcggcgaaccaaagctcgcggcgacggcggagagagaggacaccggcgcgagctcgattccgacggggagagaaagcggcaagggttggaaacggaggagggatgcatggggagtgcttaaatagtgttgggagtgagagaggccgcccgaagggaaaggaaaccgcgcggcgatctcggctccatcaatgacgccggcgaagtttgcgggggaatttccgcccgtatcaatgagagagagagagggaaaagtggggggaaagggggagggaatcacggggagtattcccccccccactttattgcacgcggggacggcgggatgcggcggaattcgcggcggcggcggcgctagggtacgggcgaggcggcgggagcggcgggaggtcggggatgacgggtgggccccacccgtcagcgagggtggcaggcgggcccgcccgtcagcggcgcgcgcgcggggaggggccgagtgggccgcggggagaggagagagagaggggggaggagagatgggccgagccggcccaagggagggaagggggacttttagggtttttcttttttttaaaactttttcaactttgtttatttcttcttaattatatttgtgctctgaaaattccactaaaatttatttacacattttaggcttttaggaaatatacaaaaatcctctaagccctttttgacttttactttgcacattttaatttttggaggctttcacatacggattttaattattctaggcataatttaaaggatatattttagagtcgttttcggacatgacaccgaacctgtataaaaatcctcgtctccatctcttttacctcggtctcgcgtatatcctagtaccaacgatccccatactatgcaaataccggaatcgcgacatcaaatgtcgacaataaccatcttgtaacgcgagataggggccctaggactcacccttacagtgggtcccaagccccgttattatgcgccttagctttatgatggtctaagtaagctttttcatcttaattaatatgaaaagagtgctagatccatagggaaaggggtaccctagttaccatttcaccaacagccattgttcccttctccccttcccccggtgcatctcctccctagaacctagcggcggcggctcagcagacgaaggcagcaagggcgacaggaggccatgatggcaacaacctccctctcctctccctttccacgaaccgagctttgacggggccaaatcgagctccgatggcacagaccgagctcgtgctcctctttgtccacggccgcgacatcgacggtgtggcccaagggctcatgctccacaaggacaccggcatcgtcatcctctcaccggccaccgccgatgctaccaccaacaagaagaggaaccacggtgcctacagatgtgtagcactcctctaggaggccgcaccgatggtcgaggtggccttggctacatcggtggtcgtggcgatccgaacttgctgctgcttcagatctgcttgtgccaatgcaacgagttcaatggcaacttcgagcatagttgaacgactacagcgactgaaatgcttgcagaggtagcatcatcgttgtatcttcatgggcaggggacttggcagttgatctgctcctggtggccctaagcgatggcaaccccgacggccctcaatggcgacaaccacaatgcatagcgcagccgcttccccttctcccttgtacaactccgtcgcttctcctctcttcctcgtctactcactgagtgggccctgcgcctgacgctttgcaggacaaggctctcgtagctcaaacaagacacaaagaaccaaactagagccatggacctcacctactctctcctccacagcagccagtgccctacgtggctagacgagtccacacatcacgcaagagcattatgaatggccaaagaggagcttgcaatgctcatgctttaatacatatgtcatcctttaaaatttggtacatttgggactgagggagaaatgataacaatccggcccaggtggggttggccgaggcccaataacttaaggttgcccggaccccaacagttcttagtcacacccactcggggaaaggcccaatctccctaaaagactagtccaataggggaagggtagttctcccctttaaggtggcttcctcctcccaagctaagcaaggtgggattattcaaaggctcacacggtcaccgcctgacttttgtgtctttgccagcgggtaatagtggaggatgtcctcatcaatcccacccccttaaacaagggcccagctctgataccaaatgatagcaatccggctcaggtggggtcggccgaggcccaataacttaagattgtccagaccccaacagttcttaggcacacccactcggggaaaggcccaatctccctaaaagactagtccaatgggggaagggtggctctcccctttaaggtggttttcacctcccaagctaagcaaagtgggattattcagaggctcacacagtcgccgcctgacttttgcgtctttgccagcgggaaatagtggaggatgtcctcgtcaagaaagggcaccaaaccaaaaactagcatgaagttgaaataaaaggatgagtaaatttcacctaaccctaggtattatggtctaagttgtataaaaccacaggggttttgacacatgatagataaacctatagagtttcacaaaaccatactactgatcattttgattttgaaccaccacacttttgagttttacaatcacatttcaattttatgagttatttatccgtcatataaatgttactaaactttttaaaattttaatataggagtattccgttgttttgtgaacctttatgatatttgtagttacgtggcatgtattaaaatatctatgatttgtataactttggaccataatggataaggttttataaaaattacttagataggattaacaaaagaaaacaatacgccccatacatgccgttgcatcttatacaaaggctatatgttctcatcttatattcttatgggtatgtttagttcacgccaaaattaaaagtttgattgaaattagaacgatgggatggaaaagttagaattacgtgtgtaaaaaagttttgatgtgataaaaaagttgaaagtttaaagaaaaaagttgaaaactaaaccatgcctatatgtgatacagttgcagttactcacagaaaaatgaagcgcgtctggtccatatgatccattaattccggcagagggacggggacgaccagcaaggagccaaaacgcggagccggaggacgaggcgcccgtgagtccagcaggacgggtcacggtcaccacgacacgtccggtccaaaaccaaaagccgcgccgcgccgcgccgtcctccgctttcactccctccagctccaacgctgcctgccaacccgcccgctgccaccgcgtgagacacacactctctctctctctgcttctgcacgcacgactgctctgctctgctctcgtcttcccagcacggcggctttaacaccccgcaggccccatggcaccttggtcggtgccagtgccttctttcgtctcgtactgactgaccccaaccctagctgccttgccctgccggtgtccgtggcatgtatggtcatggtccccgtaaacacagctgctggccacttttccatcagacacgcattcaggctacactttttcaggccggccacacacgatttctgcgcaaatatctgctcatctctgggaatgatcagctttgacaatttgccattacggagaatgatctgcattgacaatttgccattacgctggcacacatcggtgttcttttctcgtcgttgagatacagattttatcttgatttgatttttgttaccacgcttttcaaactactaaaaaagtatattccaaaaattgttttaaaatatcaaataaatatatttatcaagtttataataattaaaaattaattaatcatatgctaatagctttcttgttttattgttttagtgcaccaatttaatcttcatcttcgtcatcatcagtttcaattttcaaacaccgccgacgtgtctgttctacttccatccaggcagtaacagattttgcaaacgaaaataaaaacagcatacacagcaacagatactactactgctggcaaaccatcaggcattagaaggagaaaataaacaccaagtttccctctctgtaaaatgtgaacaagagttttatcatctgtatgctgtatggttacacaaaacaaacaggagtgaagtgcccaccaccacttgcgctactgtatggccacttgtacaacaccacacaccggatgaatccaacttaggtacatttgctaaacacctacaaatctgttcatgctaaatgtaccaccagccagctgtgtatggtattgagtggaacaaatgaactccggaatgtgcataattcaattcaattttaatttactaaaataaacaattggcatcttccttccttctgtccaaatggcaaggcaacgcctttgtaacttagcttacacatgctgcagcttccaccaagtaagctcagcgatgatggaaatcccctccaaataaataaataatcttggatcaaccacaggagtagatttgacttctctggtagcactgcacaagaattgacatagcttctggtttgccctaatacacacagatgaagctgccctaccactgtggaacaaaagaaatgccggagatctgtatttctatctacaggaaagaatttaaaaacttgggcttgattcgccgcctgcaaaataatttcttcaagctcgtatcgccgcatatatggagtgtaggctgcttagttacaatccagaccacattcctccagaagagggccattattcttcgcaaggaaaggatcgatccggacccatagaagtgagaagattgaagccagtagaatggaccagacgataacaatcgttggtgtcctgttttgccttccaaccaaacccttgaggaacggatatagatggacaatcacccagaatgcaaagaagagcttcccgaacagaggtccccatgattcatatccattgttgatagcattagaaactccagctacaaccccaatgaagttcaacagcagcagtgtagttggaggtatcaacaaggtggtccatttgaacgtgtatagctctgagaactcttcatcatctccggcctttgatgtcacagtgaagctggtatcaacaccagcaaggactttcagaagtccttggaatacagcgaagagatgtgaagaaacacctccaatgacccaaaactgctcattcctccaccagtcatcgatggccacaccactccatctcatttcaaggatgccagtgacaaaaatacagatgaaaagcgacatgaaccatagactagcaacattggtgagctgcagtttgaaataaaaatgatgtaagattcagacagaaactcagaagatcacaaaattatgtagcacaataatgcttacctctggagtgataaacttcccagtgagcaagcatatggcaggcaaggtacagtaagccagaagtggaatggatgtccagggatatacgatagagttaatataagaaaatctttccaaaaatttcaggccaccaccatacccataccaaagtgggcaatgtttgctgaagaaaatttcaacagatccaagagcccaacgaaggacctggtgaagacgatccgaaagattaagaggtgcagaacctttgaatgctggccgctttggaatgcagtaaatagaccgccaaccatggcagtgcatcttaaacccagtcaagatatcttctgtaattgaaccatagatccagccaatctgcaagaatacatgatttacaggtgagaggaacgtcttcaattgattaaccatcagtttataatcaggtctaggtttcttacctccttcccccagtctgtcttgtcttcgtaaccacagctaataacatgtatagcttccttcagtagagaagctggacttgcactcttcagggttccaccattttcaagcaaagttgatgcaacaaaaacagaagactgcccaaatttcttttctagcttctgttgattcacaattccagctttgtctgtctcagctcctgcagtaaagaaacatttgagttttactgtgatgtttttcttatgttaccttatgttatttgacaattgttagacaagctgacaatacctggagcaccttcctcaatttcaccaagagcatatgcaggagactgattttctgctttcttgaaaaacagtcttttctttttctccggcttaggttttgttgtcttcttcttagtatgcctgttaccacaacagcagcagcagcaccatttaggccagcaattgcaagttctggatgggggcttctttgtttttggcgcatcataaccatagagagcttgccgtctgaagacacatccagtaccaacatagatggggccttgaattccatccagacctttcatgttgatctgtacaatgcaaatattaggaaccataatagtaacaagcataatatagaccacaaggtcttagtaccagagaggctgaatcttacatcgaaaaagacaacgttccggttagcatatcgatcatgtcggtcaataccatcaaacctctgagggaactgcacatagcacactttcttccccaccaaaggatccatcatgaaacacatcgcttcccttatggccttgctattgttgatgtagtgatcacaatccaagttcaataggtatggagcattcgaaagaacagcagagacgcggacctgtcaaacaacaaagagagagaaaaccatgtcaaacggtgctaaggctgtaaatctacatggaaattgatacgagacattatgtgaaggatcttttaccaatgcattcatagcaccagccttcttatgatgattatagcctggcctcttttctcttgagacataaaccaagcgaggaagctcatttccttccacatcacggccaccactttggccaaggaagacctattgacacaaaaaattgaacactttgaactaaagtaacacagaaagaagaatcgcacgtgtgtagtaaaacaccaaaattgcaaaagcattacctgaatcattccaggatgatcgcgcacattgttgcctggccaagggcttccgtcctgcattgtccatccttcctctggaaccttttgggctttggcaaccaaggcgttgatcctcaccttgaattcctcataatctctctggatgaaaattaaacttgtgtaactagctataatataaaaagaataatcgagtagaaaagcacgaacaaatgaggacatctaccttcattgctctcctctccctaacaaaggacgctgctaccttatctttcaggtagtctatcttctgctggaagtaccactctggagcacgaggctcgatattgaactttttgcagaaagggacccatttctttgcaaattcagatgtttctgacagtgcttcaaatgtgagcattgcagcaccatcatcagaaacatagcaggaaaccttttcaactgggtaatccacagaaaggatggaaaggacggtgtttgctgtgactaagggaggttccttcgatggatcaactgtactgacaaagaagtcgactggagcaagttgagatggctgaccttccttgtcaaacctgatcagacaagcaaaaagtttgttaccttcaaaccttcagcaaaaggatagggcaagtatttcttggtttggggatttaactaacctcagtgacaagcggtccaggtacgtctccctctctatgggaagccactttggaaattgatcaagaatccaagacatagcaaaccagatttcacatattacagagatgagccacaaagcaaatgcatcattcacaggatgcatcactcggtagtggaagaagaaccccaaaaccaccaaccggataattataatcatcctatagggattaattcggcttgaagaaattggaactttgcgagatagtggttgtcgagcttcatccattctggtcaacagattaaagagacactttacaaccagagtctagtaacaatatttgcaaggaaaagacaaatccttacataataattaaattataacctattgtgtctatgcatcatacagaattgacgatgaaactccaagcatatgacatgcaaaaattagtatttcattacatcataatattttccatgaatattaaactaaccaagcccaaatgcaaatcatggtcaaacagtgaagtagccaagataaaacaaaaataatgtactgcgggtaaaaaccatgtaaggcaattatgttaatctagcacaaatagttgcattccttctctgggatctgtccaattataggcttacgagtatcctctacgaagtaacaaaacattaagttattggcaaaaaaaatagtagtatgtcagcatttttacagtaagattctttttagcattccatcaaacaagactttccatatatgtttgttcatgtactgttaatatagcaattagtagcaattctaaagatagtctaagcattagacaacggcaggccatgggaagcagctacggtcatttaatcactgtaaccacatgttctaactaacatttggtgagcaagcaaagttaggtggtcacatacagtggcagatctgcatcgccgtcgccatcccagtcgccgccgccctcactcctgagctgctgcatccgctcctgcttctgcttccagccctccatcctctccttccatgccacactcccgtacccgtaggcggcgagatccttggacgggtccatggatctcggttgcactgcaaccaaacaccaagcacatcgatcagcaactcacaccaccagcagcagaagctaaccagattccaaccagaaaccagatcacccaccaggaacgctcggatctgcgaaagggagcgggtggatcctcttcccgccgccgccgccgccccccatgtagggatggcaccagcgcgtgctgctccggcgggatgtcccaacctggggggcaccc

SEQ ID NO: 5608 - DNA, 37382 bp, Oryza sativa
tgttgttttgacagcgagtagtcggtgggatcgtcggtagtgaagtggcgtgtgttgttgctggacgtgagtgtgagcgagtgttcggtggaacggcgcggtgatcacctcgggagtcgggattaataacagcaatatgcacaatagttagagcaggtataataattgatgataaaaactcctattcacgtaggattttgtgaggacgagtaaaaaagacgagaggagagagaacgagagcggatgattaacttgtcgcctagcggcacacgtagcttaaagttgtgggatccgcttgaccgtttgtaggctagacatccacgctacgccaccgtcaacttgcttgcatccacctcatccgtcgatgcccttgtctttcgtgcccatcgtcagccacgaccttcgccctcttccacatccgtcgcagccgtcaccgatgcttgagttcgcctcgtccatcgtgatcgtcatctttgtagtcgcatgcgttcttcatcgttcgtcgcgacctttataattgtttgcgtgccatccgactaaagatttcgatagcaacagttaaaattaatagcagatgattaaaggaccaattttaatcacatcatgtcgcagaacatcgtatagatacattgattaaactcaatttgtttgagctgttttaggatagcaactccttggactattgtgaacacacttttcaaaattgctaaatattttttgttttgtaaaatctttctgtatgaaagtttcttaaaaaatcagataaatccatttctcaaaattataacatttaatacttaattaatcatgctctaatcacttatcttatttttcgtgtggttaattatattcacataaacgaagcttcgaaattattaatcccaagagaaaggggttgaaatatggaaggagttgaggggattaaattgctcgaagagaagattaaccgaataaggtttcacgagtttggccattactctacacatttagcatatgctttaattggagagcgcatcaatttgacatcgtcattatattttggtcatgttcttttctcccacaaaagttggatgaagattaagattttcgtggcacgcttttcatactgctaaatgatgcgtttcgtgtaaaaactttatatatgaaagttgctctaaaatatcatattaatatattttttttaagtttgtaataattaaaactcaatcaatcgtacattaatactacctcgttatgcataaaaaaaacttaatcttcctcttctttttcagggaaaaaaaaacaccacctttgtgttcgtttcgcctcagcttcagaattctactactagcaagctactgccctagatcggtccgcattccactcttactagctcgtagtcgtacgcccctatgactatgagtatgagcgtgtcctgcgaaagaggtagcgacgagaaagacacccggcaccggcaagatgtctaaacaacatgtgcgtggaatcctctgatcctctctgtgatcagttggcatcccggccacttgattaaagaaacacaaaacattgccgtggactaaccacgtttcctagttgcaaaacagaatatacccagcacttgatgtccactgcaatttcacccccggcaactagtccataatactccatggtacttcacccataaaacttccgttaaaaaaaaaatctacctatgtatatagataagtgtttgcctaaaccaattgttagaagtagacttctttttatatggaagaagtacatacatactctgatgaagtgattcgagaatagactcattcgaaccagctgttctacggtaaatgagataaagtaaaccatatgattaattgagcattaattattataatttgaaaataatttatttaactttcgaaaagacttatgtataaaagcattttatacataacacatcattcagtaatttagaaaactaggaaggtagcccgcgcagttgcgcgggcactttgtttgatgttgcttaaatttttattacgaactttttataattgtttgtttaagggttatttttttctgaaatgttttttttccaaatccattattgtttaataaacatgttctatttgcacaataaagctcgtgccctctaattagttagctttttgttacatacttattgcagtctaatcatctaagaactaaaaaataatgcaatgcttatgctaatgggtaaacatctaattagttagctttatatgtcaacatttttataaatatgaatcaacttttgtgtaaacatctaatactaaaataggttcctgttgtttatttattcatggattgaggggattcaaaactatgttaaatacatattcttgtagagtccaattctattgtgcagtgtaggagacaacccataagtgtgcgaggctagcgagaacacaattattggatggttaaatattactacaaacatatcattatctggaatgagcttttatatgattgttcccataatttcattttttaataaaatttttagttaaatattaggaattatgtaatcgaaagtaaccaacccacaaatattttgtttagctagcttgcattgggcatgaattagtaacaattagattttataatcgtttatctgaagcctataatgtctatccacttgtcataattatcacatattctatgaagttctaaaagaccctagaaaatatgtgtttcaaatatcagataaattatttgaaagctttttgcatttgtagcatggaatttgtttggtcactatacaatccacttgcaccttctactcaatatgccctatggtgacaaaaagtaaggcctagctggactcaatagcactcctcttatcctctattgatgcactattattatctcattaaaactggtctactcagtgtctccctgctttgcttgctgtctcattctagtttgcgcaagaaaatttttgggttccaaagtctaaacaatacattgtaaattttttctgtctagtagatgacaattgtttggtgataatggttttcttgcacctccaagtcatcatgttgcatggttgtaaaacttgtatatatgctgagacacggaggttaccatacgattcattgtagtagtgtttacagtttcgatcatgtttagttaatctttcttttcatgtctcggtgtatcgtaacacataaatggattcaaaatttaattcttcaagtgaatatgtgcatggtgacatgtttatagaaagttaatgtccatatatatggatgataagatctttttaaaggtttgtgcatagagaaaacatactttattttcatacccgtaaggtatggaatataagcacatagccaccggcaagtatatatatgtaccatatactaaaatgctattaaataccgtctaataaagtaatttaaatgttacatagaatatattctagagcacttatgtagaagatcgtttggcactcttggattatttgagcacattttagagaattcatgaattcgattgtttcctctaactggcaaaactacatttttcgatcaatcacaaataaagatataaaattataattgttatggtagctagagtcaaaagccgaccttaaccaaatatgtcattctggatatgtattggcagtgaaaacataaagtaaacatcgattgtaccaatatagcccgaggggcattgtatgtatgtacatacgtgcaccatcgcccaacatccacccctctgccctcattcatgccctctccccatgtattgtctctcatgttttcatcatatattaatcatgaaccctaatttattataatcttttaaaataaataactatttttttatcgaggacccatattaactatatttgaacttctaaaataaatattgtattttttgttatattctgacttttttcatatcatttaaataattattaaaaatatgaaaaaaccaatgatatataccttacctgttgaaaatatttttggtgaattttctttgcatatatgtataatttaggatttattacaattaaaataccaaccaaataattttgaaaaattccaaatgatttgagaatgttaatcttacacaaattaaaatttaaattggatctacttaaaaacacaactaaattacatggtttgcatttttacatagttcaaactaccgttatatatttgttaagtaatatttgataccataaagtatatagtttgatgtgattacttttgaaaaattgttgtggagttaattaatacatgtggatgtcatctgccacaatgtattttgtgctaaaatatagcgaatataagacatccatgtaaaatcataataaaataaatgataattacgtatttttattagtaagatgaataatcaaacacatgctcaaaagtcaatagcggaaaaaagtaatataaaaatatttaggggtatcctaggttaaaaaataacagtagggtgaatgggaagaaaaaaaaaggggatgagtacgtactacctgcctacatacatacgtgtgagggagggtggaatatgtacgtcagtacgtgtactgagggagggagggaagagtagatgtacgtgcagggacagaagaggaagggataaactattggttttaatctaatctaatggtgtaaaataatggatccaccagtttaaatgaaaattgagggttagatgtttctcgtctattaaaacgccatgtggcggcttaggagcatttgtagggggtgccacgtggcggtttaggagcgtttataggaagtttaatggacttttagtatataatagatagatagatgtgctcgtggaaacgagaattgagtggtgaaaacggatcgaatattattcgatccaatccgctctgaattgatccgaaacaaggataaagtatgagtttatagaaatccgacgaatatggatgctaatgcggatacggatgtggtatctaaaatccgacggatacggattatccgatatctctatcggattatccaggaggctgtttgcctgataatccgaaattgtcaatccacgtaaccactccatctgttgaatacaacatgaaccgttcaataaaatagcctaatttatcaattaacctagacactttaatttgaggctcttactgtctcaccttatacttacgtaactgtgttttaaaattatggacatcatctattcatgatgtttagcactccagtatacgatagatcgttcattgattattattgtattgttgtttgttgcatcgctaagttgatgttgtattaattacacatatacgtgacatctgataatttttaattcgtttctaaactgggtccgtattgactttgtaccatttctgacatctgaagcaatccgcttcgtatccgcatactattcgcacccgttccagatccacttaaaaattatgtttaaaatatgataggactattaacggtccgaatccgatccatttccaaccctaacaaaaaaaaaaaaaagaaaagcagctgttcagaagtgggagaagatcgatctcgtaatcaagtgcgagccaacgagagagcagcagcagctattgctagcgcgtgcagtaccactagtccagtacgagtactccacgccggccgtgggcgaggcgaagggtcccttaatcccggccgctcccaccacccaaatcggccaggtctccacgcgttttcctcccctttccgacgtttccgtgcggtgcgcgcgcgcgcgcgcgtgtgcgtgcgcgggttcgttcgtatttcgcggtagcccgccccgcctgcgccgaggcgccgacactttggcagcttctcccccgcatcactcgcgctcgtctactactatggtttttcttttgtttttttggttttgtgagcaaccgaagccgcactgggctagcgaggtcaatcatgggcacattgcttacagcttttgtgagcgagaccgcctcctggtggtggtggtgggtgtgggtagggggccccgtggagtattaaaaacgagtggttgttgcgctgggccacgtactggtagggctacgtacgagcgaagcagcgcgtgtgtcacggagcaggcctgactctgttcgcctcggctcacttcacatgcatgatcgatcgattccccgattctcccggcccccacaaacttagtccgaccgacgcgcacatgtggagaggcggctgaggtttggatgcattgttttctccttttctttttcatggggaaaattgctcagatgggcacaagttggatggcatactctaatatgcctcatagtttgttgccattgctaaaatgctctctaaagttcaggtgcacgcttgtttatttgccacggttcaccatttcaacccatccgatgcataatttgcttcttcttcttcttttttttttcctttggtgcactgtcttcttttctgttctccacacatggagctggcttctcaggatggggtgtaccgaggcagtaggccaagggcctctggtgtgtgttggtgacagccagaggccaaggttgagctaaaacttagggcacgcacgttggagaacactaccagtggtctcaactctcaaggtgccatgtggattaaaatcacacaagaatcacataacccatagtggagaacaccctaatatatattttgcatttcaaccctttattatttatatgaaggtccttggggtatttcttgtaataaactaaattaaaacttttatattttagaccctatcgcagtgaaaaaagatgcacatatatacccttaccctcatatggacccctcatatggaccccacctgtcagtcacactttctatttttttacctatcccaccacccatctctctcgttcttaattgtctcttccctttcctccatcgacacctcgagcgttgccatcatcccgacacctcgagcgccatcggcccaccatcccttcatgattcctcgttacaagaaaccacaccgccctctcctcctcatccttgctgaaaaccctcatgatgaggacatcctccactattacccgctggcaaagacataaaagtcgggtggcgaccgtgtgagcctctgaataatcccaccttgcttagcttgggaggaggaagccaccttaaaaaggagagccacccttcccctattggactagtcttttagggagattgggcctttccccgagtgggtgtgccaaagaactgttggggtctgagtaaccttaagttattgggcctcggccaacctcacctggaccggattgttatcacctcatgtctccggacgctgctaagtgatgcggatccaggcgtggggggaatctagcaaccgggctattggcggtgcggatccaggtacggcggccgcagccaagttcttagtgatagcggatgtggcgcccaaataatcgttagatctgttgatgccaaccaagctttgttccctccccaacctccagtgtgctagccgctagatcaggacactaggggtctgtttggttgatgacctgagttatgtgcctgagttctacctggccaggcatgttgaaaatttgttgtttggttgatgatccaagcctgagtaaaatatattaaacataaaaagtacacttgtgtgagttaggatgattaaaagtgttggtagtagtcacatcaatgaataatctatgaagaagaagcaggcatgcaccgtgcctgcatcaggcgtccattttcggtggcctgagtcaggcaagtcttcagggagacaaccaaacaaagttgtgtgttgctcaggcttgctacaggccaggcaaatctccatcagggtagcaaccaaacagaccctaggtcattggcctcttcttccctagtcgtcgttctactcgacaacggcgacgatggtgatgggggtcctcccgatagcgtgagatgaggtgcactctctttcccactttctcttcggattgttgccgactggaccacacttttgcttcttttcttcccaaaccaccgtagctcatgtaaggtaactctgacacagatgtagcccctcccaaatctccactgtcgcatccaaacctagttggcggctagaaccacaggcctaaaaccacgctttgagcatggccttaggagggctaatgaccagatcttagatggtgaagctcggctgataactagaactaggattgtggaggttgagacaagctaggctgcacgaggcggtgtagtttgtgtgagcaacgaggtggtgcaatcgcttgaatgcatgggaaaaacggagctcacacccctttgtaagggtttcttgatgagcggtaagataattgaatttatatagctacttgtggaattctaaagcctaaaacaccaattctcatacactattacatctattttgttctatatttgatgggttgttgtctaccaaataaatgaggtagaatggagaatccatatatgatgcaatattatgattataattatttgttttccaatgaacacgcgtttcatgcataaataaaaagttaagcaagagagacaagatgttcccccaagttctgttatccctgttctattggacttctgcctttcttatttttttaaaaaggaaaaagctagggcccatctattataacagataatagaggctacagtccttatattatactagtgtagtatatatggataagcaatatgaatccaaacgacattaatgggcctcacctctaatggaccaatttatgttaaagtttccgcactaaataagccatgttaagtattgttaacacctgtttttaacaatttggtaattaatgcatatacattaattaattcttgttgtttaaataggcttcgtgaagacttgcaatataatacagtccatctatctattgcatatgtgttgtaacatatcgattttgctagatatttgtcatcaaatttctccccctaatatttgtcagatgtaattacagtacaatcgtagtgtaattacactgtaacttgcatgtaattacactgtaactataatgtaacttgtatgtaactttcaagaatctctcggtaacatgttatttcagtaaaatagaggtcgcgggaacaaattctttcatatatgtgtgtgatgtgatttttttcttcctccatagaacaaatcttgtaatagatctaacgattcaaaattacgtgaaacttacatacaagttacactgtagttacatgcaagttacaatgtaattacatacaagttatattgtaattacactacgattgtactataattacatctgtcaaatttttagtagaaaatttgtcgacaaatgtataggtggtcccgtaacatattactgccactgtaccaagggctgcttggttaaagttcctacgttcgggtaaaaggattcggaacctttctccctagcatgaattgattcgttagtacataattaagtactacatctattttgttccgaattctttaggtataatttttttaaaatgcattgtttagtagtttaggaagtgtgcacatgaaaaatgagaaagtagatatggggaaaagggagtgccaaacacaaccctaaacatccttctcctttgcttgtgcatgaagcaaaggatttgctggggagcaaagaaaaatactctctccatcccattttgagtgcaaccatgagtttccgcgtccaactttgatcgtccgttttatttgaatttttttataattaatatctttgttgttataagatgataaaacataaatagtgctatactcgtgacttacgtttttaaaattttttaaataaaacggaaaatgggacggagggcgtatgcgttagattgttacgtaaaagcacttacaacatttattgaaattacagtgtatgtttgagtgtatttttttcctgactctaattaaatatatgtttgttgagttccaaacttgttttcaggaactcccattcttgccaatgtgcaattaaccgttgcatgtacttgagtttgtatgtacttgagttccaaacgttgtatgctaaacttaaacttgaaaaaagtacgaattaccctccttaattattacggtcgaccatattaccctcctaacccaaaaaccagacattgcttaccctaaactttcaatactggacgaattaccccctcgacactgttttgagcagttttgacttgatcttgcacgcatggcactaacgtggcaattcaatcagcaaaaagaatccatgggcccacatgtcatgtctcttcctacccggtcgctcgctcgctctctctctctcccgtgaacgcgctcgagcaagtggctgcgaacgggcggtgggcggcggcgggtggacggcggcgcgcggggagagagagagagagagggcaaaagagatagggccaaggcgtgttgaccggaagtggcgtccgtcagccgcataggaggcacatggcgacggaggctggtcccctcagggagccggcggtggagttcaatcggtgcctgtggccgaagaggagatccgcgccggtggccgaggaggagatccacgcatgtggccgagaaggagatccacgtcggtggccgcctcctcgagcatgagctctgcaacttcctgcataggaggtcgtgaaggtcagggggacggggagaagcggcgaaggttggcgacaagacgtccgtgcagcttccagggatgaggccgacctagcagcgtcgaaggaggcagatcaagatggaggtggagacgacgacgaggccgtggcgccttcgagctctcgaccggcaaccgccacgacaccttctcctcaattcgcgagcgtgataaggggatcgagctcctcaccgtggctcctcaacaacgacggtctccggcaactgccttcgagagtgggcgacttggtggtgtgcttgttgtgccgaggagaagaaagcccggccggcaagctcgacggtcggccgctgtcgcatgctttagcgaggagaggaattcaagagaagagatagagagggatacggattgagaaagacaagaggatagaggtgagggatagatatgacaagtgggcccccgatacttttttaaagaattgctgactggactgtcacgcgtatgccacgtaggatcaaaaccactccagattgggttaggggggttatttgtctagttttagtagttgagggtgtcgaatgtctagttttaaagtctaaaggggtaattcagacgacctaaatagttcagggggataattcgtactttttttttcttaaggtaatttatcatccgaacattttcattatagttggataaaggacattatgactttgtggttttagctgcaggacactgcataaagtgacttttggggaaatacactctttaaagtttgatatttaccggtggacaccgcacgctttaaaataataatttgtggttggagaggagagagaaatcacgtgaaagttttgaaatgcctttgggcctgcatgttagctctcctatctctcttctctctctatccccttcttccggctagggaggatgccgtgataggtcgccacagtaggtcgatagctgtagtgggtgagcagccactggctgaagtttcgctgcttcgtgggctgcaccctggcgtgccgtctcagctctggggctgcatcgaggtgaggtcgacggcgaacttgtcgcccttggatgcggcgatggaggactccaccaaggggacagcgtggtcgacgccgggaaggagaaggtcaaagcagtagtcgaggctgtttgaggcgcctgccctgccacgctcgcaccaacactcgaggcggccccatggctctcacaacctgttatcgatggggcggaggttgagctatgtgctcgggttggagcgactcacccggtctgtccccggcaaggccacgaacgttgtcaccatcaatgccagtaccatagccgaggcgtacaccgccaccttcagcattgtcggcccgtgtaatgacgacgacgagaacagcgacgacttccacgcaaaaccactccaaatccgccttggacagatgaaacgcgtccgtcagcgtccctgacggcgtctgctcgctgccatccgtgaccaccagtggcgccgcggtgacctgccatggcatcctcccattgccagatattgacggccatcagcatgggccatcaacacggttggtgatgcgcaccacttcttcttggtggtggtggtggtgacgctggagggagggagggagggaggagggggcggcgggagggggctgggagtcggcgtcgatggagggggcgacggcgaggcagggaggagcaggcattgggcgaggttggggtcgagctcgagctcccggcggaggtggtcgcagagctcgccaatcagaaaggagcggaaggaggaggcagcagcgctggccatggcatcctccctagtcaaatggaggggatagagatagaaaagagatgggagagctgacatgtgggcccaaggcatttcaaaactttcacgtgatttctctctcctcttcaaccgaatattattagtgtccaccaataaatatccaacttgtaaagtgtcttccccaaatgatgtcctatatctaaaacctctaaaaccgtaaagtcacggtgttatgtagagaaaaaaaagcttttaatgtgtattccccaaaagttacttcgtgtgatgttctatatttaaaaccgtaaaatcacgatgttttgtaggaaaaagatttgtcttaaaataataatatgatcacgaatatgtcaggacatacatcagctctattttaactctgctattttctaggaataacgtgtattaagtcattaggaattgctggattaagcagaaattgcaaactctcatagtaaaaagcgagaaaaaaaatgaaacgtaaccataaaacaggttgcccatgcggatccacaggttaaagtctagtataaattctctgcaccaaactaagaattaacaaattaacaccatgtccttgtttctaagtttttagtatgaactcaaaagaaaatgtggtcaccatcattcatcaatactgcccggccctaattagtcagaaaaatgcactcccaacaccagaaggttgcaatcaaaattagatgcacctacatcatgcaggaggcagccacattgtaaatctgctctctacaactgatagagaagaagcgtccaacaagaaattagtaccatttctacacttgagtaacaaaatgttcaatagcttatttgtaaatgatatgagcacacttgcgttgttccataatgtatacacaagcaatttcttcatgttatggctggataacagatgctcatagctttgcatggaaaatctgttaaaagacaatcaccacgcaagttcatgatagaagtattaacaactacagagcattgttaagcaaaacaaaaacccaaaggagacgcctcatttcgttcacaaacctagaactataattataatacagtaaacagaacaaaattcaatccagtgcattccccctcagctcccacaatttcactgtgccatcatcacttgctgatgccaacatcctcgggtcctaaaacatatttgagaagattagtacatttatctgaagtttaaaagataaacagaaccacgaaatgggtggtaattggtagaaacataagtattccattgcactaacttaatataacaatacttatatttttgttaattccctgatattacctgaggacataagtattccattgcactaacttaatataacaatacttatatttttgttaattccctgatattacctgaggacaccagcggacacagtttatatccatgtcatgtgccttctctttctttaaaattaatctgtatgaaggtccctcaacctgcagcaatgaaggtaaggaattagcatccttcttcagctttcgcaaaataaaatggcattatggtagagggaataataattgtacagttttttggagaaaatagtcatacataatttgccaataatcaaaacaaatggcacagcactggttaccaaaaaatgatacaacagtttatcgattggtcatgttcacattttactcctaggaaaattttgacaaccaggaaattatggaatccctatcagaacattgcactccattatttattattaaatatttaccaagatataactttgacaaacaggcaggctaagcacagaatgcaaagaccaaaaatcttgagaatatgaatgtgctaggaagggtatgataccatactactcttgtcctcagcaaataagcagattgcatcatcacctgcgccactggctataatatcctcgctgtcatgccaagaatgaacaggaaaatgtcaaagaatagtaaatacactattctattcattttaacatcttgattcatatgggctgaggtaatattggaaaactacaataatgattaaaagagaagaaattacatcagataaaccaccatcagtgcccacagaatttctggtagtaaaatttcttccttaaaatgggcatccaacatttaagaatgcagcaatggtactaagagacacagataaataaataacaagaataggaaaaagaaagaaagaatggactgcaaggttagtactttaaacagccctgttttgcttgaataggtatcttgatgtatataaagtttatcagcataaaatcataaacacaacaagtgcatccttttaaagaacatatagcgctctcaaatagaatcaataaactaataattataaaattcatattgacgtactgaattaatagagcgaacttaaaattttttaaaaagcaaggtattgaggcattagtaaacacaaccatagtttcacgaatttgtggtttcgtgacactagtagaagcaaaccataggtcttgttagttggcttgaatttatctactaacctccaagcataatgtggacttgagcaagtctaacttcctgctttctattattcattcgatcactttgccactgacaccgttgagggttattgttgttatttttggcatattattatttggcatgaaactagatgggtaaaaatccagcatgctatgaacaaaataaatgtttataaaattccatatgttctgcagtaaaaaaaaaatccatatgttcatgaatttccttatattgaaaattttaggatataaaactggaaccctatggtgagaattgagttgctttgacagtttggtggactccaaatacaacagggcttgtaacagcatgagaactcgtagttttgtgaaaactggtgttactagtgccccgaaaaccttgggtttatgaaatatacttgttgataaatcatgctcacagtttagctgaggaacagagttaacttgttagttctctatgataaaaatcatgtgtatcaaggatatcttggtgcttagagatcacctcaccttgaccaatgggctgaaaaaatggtccggttatgatatcccgtgagagtagaaagatgtcgcctgaaatcaaataacaaccatcctgttaaggagacatggtatggaaaagagatatttttgacacttcactgctgtgatgtaacagcagtatcaattgaactagggcaattacactgaagtcattattattcagtgatgcacggaactacctctgtttcatattgtgagtcacgttgacttctttttctagtcaaactttttaaaatttgaccaagtttatagaaaaatataacaatattttcaacacaaaacaaacatattatcaagattcaagatattttctagaaaacttacttggttttgtagatgttgctaaatttttctataaactttgtccaccctaaagaagtttgactaggaaaaaagtaaaagcgacttataatatgaaatggagggagtaacaagtatgtcttatccaaaaggaaatagccaccatacatgttagttcaccccagtataaagcagggcagcagaagtttaatcgatattgatcttactggtaaattagatctttccgttatagcactaaaatatagtacagctaaattagcatgttctgcaatagaaaagaatttatgctagccggagaccaaacaattctactctctgaaggacatgcctatcctcatttattggtgtacgttgatcacagcctcacagaactacactagagaatacaaaaatataaattacaaaaataagattgtataaaagcaatattggcattaatagatttgctatagtagtggcatagctgtttccagggaattataactaagttttagcttagcttttaggcagagctacgatatttcaaagctatcaaactttatacagcaaatatgagtcaataaattcaagaataagccaagtagagaaaataggtattaatagcacgctcttaccatgattcctggttgtcactagtttttggttgagacaaatcagcacttgtgtcccatattttcaatgtatggtcatcactgaataacagctgtatgacattagtaacttttcgggtgacctgtttggaacgcaggaatttcacaatcgacaagaagccggggaaaccccacattccataagaggccttgaatatcatttaaaacagagagtagctattacaaaacagacctgcatgtgaccatcctatcacctttctggttaaaagataatgcccatactgttgacgagtgaccactggaattaaaaagaacgagatcaattagacaaggaaaagatacaacaattagtcgagcactgaaagtaggaagaacatataagtattaacatgccaaacagagaaaaatgagttcatcaacaattgaagtgaacattgaaaaggagaaaaaaaaacgtatgtttaactaattacaaagcaggatggcagcaaagtgatcttattagttattatcgaggaaagttgaagaagatccctaattgtctattgtaagataacacaaacacattattgtgacatagaagccaaaatattgctgtagcaaagtagaaacagcacaaaatatcaaataactaatgtctaatggagaaaggaaagtagggaaagtcaaataactaatggccatggagcagaagttacattattttaattataataaagagcatcatgccagctgaaatttgatgatttggtaacattatacagtgatgcatgttacatgctaaataagtcaaacagattataccacaacctagtaccagctctatgaaacatgggatgaaaaaaaggccacagggataccaaggctagttaccagttattagcttcagttaatgtctgtacacagtgccactcatcatcaccgtcatcagcccagaccttcgccacagaaaatttgaaatcagccattattacacttgaacactaccaaatgaaataagcaaacgcatcacagctacaaagcataggggaacagcaagaaatgcttgtgtgcgatctaggcatttgtttgaaattaacagcgttcatactctgattgaattgtcgtagctgacagaaaccaggacatcaaggatagggtgccactgcaccatcttcacgtcttgtgtgtggccttgctgcaccgagacacactcgtattcgtttcctggctgcatctcccatatccacaccgacttgtcccggctgcacgtcgcgagcagcgacccggacgcgctccacgacacgctcttcacctcattctcatggccctgcacacacccccacaacagaagtagtaaattcaacacgcacaaccaaacgatcacaatgcaccacaacaacaaacagtcttaaccccatatctgaaactcccgagagccattttcaacctccaaggtggcgacgcactcgaagtcgccgccggagtactcccatatcgcggtggtggagtcgaagctcgcggtggccagcagcttcccgtcgggggaccatgcgcacgacctcaccgtgcggttgtgcgtgtcctccagcacatcctacccaaaccgaaccccaagtcaatcaacacgcgttgcagctgcagcagcatcagctcgaacgaggaggggatcgggcgtgatagttaccgagcactgccatgcgccgtcggcggcgcgcttccagatccggacggccttgtcgccgccgcaggaggcgaggacggggccggcgccggcgccgggggaagggttccacgcgagggaccacacgcggtcggtgtgccccgtcaggcggtgggcctcgcgcagcaccgccgccgcgccgccgtccatggccatggcccccgactccgactccgactccgccgcccccgcgcaccggcgatcgctgttgccctagggtttttggcggaggcccgcgatggctcgccggagtggtggtggggtgggaggggagagggcgaagaggaggtaaggtggaaggcggcggcggccggcgacggcgaggtgggggaggtgagaggtagggggaggagtcaaccgcgcgtggtgggcacgtgtgcgagcgtgacggtgataggctataggtgctcgggaggacggatccaaaccgttggttttgaggaagggcgattcccccaaccgtcggatggccgccaattggtcatccaattagtaatattttactaagcatttttatcaaaatcgccttaaaaggggatgatttgaggagcgtttacaaaaatgcctttaaatgtcattccacttgtagtgcaatgtatttcccttttcttcctcttttgtgaacttttcctctctacgtctataaacaaattagcaaaccccatccttagtccaagatttcatctcataccacttcatcaaatctagtgacggaaataatcattccctctctagtcccgcatgtcttggaaaattcagtcctacgagacgtacacacatcattttgctaaaatgattacttcaatgcgagagcggcaccgatgcgaggcgatgcaaatgttgagcctaacatagtccatttcaattcatacccttttggtcctatatttaaaggtatgcatgtctcaactccctttgatttagctataatcattattctttaaaaaatggaacgaccgaaagtgaaatcagggctaaccctctcatctactagaggttgcaatgctcaatggaggcggccttgatgggtgttgttgccaacagtgccatgggtctctcaccaaaacgacacctacgagagcgcaatcttggcaagatcgctactagtgacactaggattaatcgtgggcgcgatgcatgttgttctcatctttttggggactttagccagcatgaagcgggaggtgttgtgagggtggttgggatttgggtgtagagcgaggaaagaagacgagcgtgaggaaattcgatgagtatggtgacatgatgaccttgatcatcgtgatgtcacgtgatggccgtagggacctcgatgaccttgatcatcgtgatgtcacgtgatggccgtagggacctcgaggattctagtggccgagtgtttgtgggtgacataatgtttaccttccttctgttaaatacggagtaggtaaaaaatttaggttctggggctaatatttttactatctccgttctttaacctaaattaaggctaaaactatcgtgccctccataaatcaaggctaaattgattgtacaaaactaaaaagtgtgacctccataaactaccaacaagaaaatatgttttcctcctcccacacgtgctcccctcgcccaaaagtcgattcctcctgcacgcacccaccgacctctccctccctcccttgccacaagcaaacagcctttgaattatctagcagcatatcagatcagctatcattcatatcaacagcaacaacaccatttagctctagcatttcagcaacattcaacgtacacctcaaagtatatcagcagcaaacaaacaacaacccgcttcaattaaccgcacctgtagcaacatcacaatggcccgcttagtctgggatgagcttattagtgatgctacttggagaacttgaggatggtgttggtcgcgacctctgcgaggtactctctctgtccataaatattcgacgttgttgacttttttaaacacgtttaaccgttcgtcttattcaattttttttaaaatatacaaaactatatgtatacataaaagcatatctatctattatatactaaaagtccattaatctccctacaaacgctcctaagccatcatgtgacgttcctacaaacgctcctaaatcgccacatggctattttcaatctaaccgtcgagtttcacttaaattggtagccccattattttacaccattagattagatctacttgaaaagtcattgctactcccttaacgtataagctttatacatgagaaagttttacgagaaaaattaaagtatattccgatcggatataaacccatacgtactgctcgcttaaaaaaaaactaatatacgtgcagctataaagccaaaaaaagtactacattgtatattgaagccgtatataccggaaaatcatgtccatacgagtgaaaccgcttagaccgaaaaatctacatacgtacgcacaattaaaaaaacagaaactttagaaacgaacgtacatatgcgtagacaaaaccaagaaaaaaatgtacgtatgcgtagacaaaaaaacagatggttttttaaaatagtattttctatagtagaaaaacaaaacttattacttcacaaatatggtaaaaaacgtacaataaaaaatatatgatttgaaaatatatgttttcagctacacgggcattctttaaaaagttgatctaacagtatatacagtgactgactttatttatgcgtgcaagtgaagtggtactggaagaaacaatatatagtcactttctttttataatttttcatatacgtttgaatgacatgcataggatagtaaatggaacatggaagaataaacattttatgagtgaagtagataacttacgtatgaattctaattgtgatttttatcataaataacacaatggtccaaatagataaaaaaataaaggtatgatttaaaagttaaaaattataatgagttaaaatatattgttacaaataaatatataattcagaaggttgtggttatttaaaaattattgttgcaaatattttcataaagagaaaaagggagaaaatgtaatcaagaggataaacttcctacaaacgcttctaatccgaacatagtaccctataaatgctcatagaccaccatgtggcactctaataaatcatagaaattgtataaaataaaaaaaatcccgaccaatcggttttcatttaatttggtggacccattattttcaactattagatctatcttaaaactacaaaatagatttacttgtaaaaaggcccatgtcgtattggcacgaccggccaatatacatgcacgtaggtatgtaggtattccttcttaagaaaagtacgtacctacgtagagtatgtacacagctattcctataaacagtgcgtatacacaccgcgtcccacatccttatttttttttcttctcatcatttggattagatggaaaaccaaactaataatttaaactaatatcaactatgctttgcgttgtaaaaatatatgctatttcgagttgtattcaaattaggcgcatgtcattgaaacacccataaaaaatataaataaattgaaagtatagattatgtgatagttaaattagacttacattttccaaaataaaacaacttcaagtgtgtgtagaatttcaaaaattactcactctctcttgtaaaaaatactgatatggaaaaatgatgttataaatttatcataaatattttttatgtattatgtgtttactctattcatatattattagaaaattgaagatcaaatatattcatttgacaccacgtcaatatctttttctcctacttagccttcgttcgatctagctcattgacttagcgtatccagggcacacgaaaagtcacaagtcattagcacaagattaatcgagtattaaatattgaaagcttgaaaatggatttatttgtatttttagaaaacttctataataaaaaatattttgtaaaatatgcaccgtttaacaattcggtaaacatggtcatgataaataatgaagtagccactctgataagcactttagaacttaaccataaatttattacatatgcactaaaacttaatatgtagtgtataatatactttgtgaatctaggatagtataatatatcaatcgtatgtccccgataaattctatgtaataagttctatatacaaaccagtgtcaacaatcgtcgagttatattgtttatgatacatccatgcacaatgcacttaataattagttgacatccaataagcacgtgcgtcatcaagcaccgaagatatatgatgatacttagtgggaacccattaataaaaaaaatgatatataagtagaggatgacacaaaatcacaacaaacagtagttgactacaagtagactgtgagtttaagcaatagcgttcctatacttctacaaacacttgtgagatgtcatgtgatgctctaataaataggaggaaatttaagaaaaaatataaggagaaaacaaaacatctacccatcgatttgcacttcaaccgatgaatccattattttcaaccattaaattagatttattcaggtaagcccttgcttctataaactagctaatccctctctatgcacgtacatatataagagatgacaaaaataaaaaaagaagtgtgtgtatatatatgcacgtacatatacgcaatgtcaaaaataaaaaagaagtgtgtgtatatggttcaccccatctggtagttttcaatttctttctttgtagccctaaggttctcccaaattatacatatatgtagcgaccactctttgcgatgttgtcaaagaagccacgctgccatggcgccgcttcatgtcaccctcgccaattttcttgaaaatattttttttgactaacaatgtaaaacgcaatcataggtggtcatttaaacgtgtgtgcacccaccctatgaatacacatacgcacaccctacctcctatgagagagaaatatttgtcaaaaaaacatgaaaaagaacgaacatacgagagactaccattcgagaaaaaaaacttacgtacatacgtacaataaaaaatgtcatatggaatcatattttatcccttttaattatgtcgttctcatataaattgtgttaacaattagtacaaataattttgacaatatagagtatttctttgtacattacccatgaacatgcgtaagtgaattacatgtataataaaagaaaaaaaacatcaaaactcatattatgtttgcaaagaatgatgataggtaagtttacatataaccgaaacaaagtgattttttgtttgaatatgatagacactatcatttaccttatcaaattcacggtataaatatttccttcttttatggtaaggttacgaggtaatctactgttcttatagttaatatgatgatatatgactttttttcagatttttttatataaacataaaataaattgcccgcgcatctgcgcgggctaccttcctagtttaacaataaatcaaatgataggaaaagaattaataattacttaaatttttgaataagacgaacgatcaaacatgtttaaaaagtcaacggcgtaaaatatttagggaatgagggagtagctgtcgacgagcttggccactgttctaatccgtggcatgagctcgccggaggatgcgtcaaccacctagccttcgtcctatatctgtggcgagacggaccggtgaacgtacaccgacgagttcgtgaactgtgacgatgaactgctccagcatccgctccatgcagtccacgtcatagagcgtctccacaaagttgccagtgttggggatcaggaggtcctcatgcgttgcctccttgagctgtttgctggctctcatctccaacgcgtctcggcacgccacgccagtgtgcaggatcatgtcggtgcggagaagtccgagcacgaacctcgtcgtggcgacggccctctcgacggggagtagtgtgacgatctcctccatgaggaccctctgctccatgtccaagagcacagatccctacgtgttgtggtggtcgccatcgatataactgaattggcgccggctcagtctagaggtggtgcttggcgtacagcatgtcttctgaaaattattcggagtttcagacaaaacagaacaactaacagtgttgatgttgattcagtaacctctgagatatggaatccctaattgcgtgcagcttggcagccacctcctgcatactgatgcgctcattgggggatgacttggtgcagcaaagtccaatgttcagtacagaaagaaggcagtgtgctgcattttcatcggtagcaactggatcttcttggttgaggctcaactcttgtaccagctgaggatcaacaatctgcagcaacctgtcagggatgttgatatctgcatattttgcaatgctcaatccatccttaaacatgtcatctgttggcctcttccttatgaatatctctaagagaacaactccgaagctgtatacatctgcagcagttgaaacttgaccacctatggcacattctacatatcgtatgcaggaagagagttcattttagatgtcatataaacaaattatgaaactgttgtcttcaattaattgttaagaaaatactgtgtgaaatggatcatatatacctggagcaacatatcctatggttccatttattgtgaatgaagaagttgaaactgagttacccaaagatgttttagaatcaattttgaaccttgcaagtccaaagtctccaacatgagctgtcatactatcatccaaaagaatgttgctaggcttgagatcacaatgaataattggcccttgatggttgtggtgtagatatgccaatgcatcagatacatcaaccacaatgtttaacctttgagctagtgaaatagagcacaaatttgaagatctatcatcatgtggagttgagtacagtaatttatgcaaatctccccgtggcatgaatttatataccaatgctttgaagtcattcccacttgaatcaatgcttgagcacgccgttaagataggaactagattacgatgccgcacatttcttaaagcattacactatgcaatgaagcttttttgtgctccccttgtctctagactgaaaaccttgatagcaactacggttatgccctgaaatgactgtccttggtatacagaactgtatcttccttcgccaatcaaattggatgttgaaaacccatttgttgctctggcaagatccctataagaaactttgggaaattcactaccaaatgagggcaaagacattgagtttttcttttgttttcccttacagataaacaagaccaatatcaccaatgcaagtgtcaccatactagctaatggaatcactatggctagtacagatggcttgcgtttagtcgtatttgatggcgtaataggacattcaggtaggtgtaactctagtgcacctccacaaagccctagatttccatcaatttgtatggcacttgaattcttgaagatacctttagttgggacctcacctctaagatggttgaatgacaaatctatctgttcaagaagctgaagatcaccaagtaacattggtattgatccagttaacttgttgtgtgataggttgagaaactttaggctaattaatttgccaaacgaagggggaatacctccacttaaattattatgatccagctcaatatgttgcaaattttcgcagctgcccaaagtattaggaagatctccagacaacatattggatgaaagctgcaaatacatgagctgcttggcattccctacttctgcaggaagttccccactgagattattgaatcttaaccaaacttgctctattgttggaattctgaagatttactctggcacactaccatgaagattgttattggaaatgtcgattgttgtaaggaactgaaggtttccaaggcttggaggtatgttcccaatgaactgatttgactctagaaaaagctccatcaaatgtgatagattggaaagggaggaggggacataccctgtaaaattgttgtaggacactgttaggctctgcaatgttttgagacctccaagccattgtggtacagaacctgtaaaccagttgtcatccagtgccagaattatcaggtttggaaggtttgcaatgccagaaggaaaactccctgacaatctattgagccccaggtaaagatactgaagttgaactgaaaaattgcctagtgaacttggtacctgtccttccatttgattcttctcaagagagagtacttgtagctcggtgcaattagctaggttatccatgaactcccattcttgcttgctacgagcatggagctgattcatctcaaggttcaataatgtaagcttggcaagcttgccaatggaggcaggcaccacaccggtgaagttattgtcagacataccaagcttgaaaagattcgaagcatttgctaaggaagaagggatattcccttggaagaagttgccgccgatggtgagctgccggagcttgggcaggaagccgccgatgccggacggcagctcgccggtgaagccgttggtgctgaggccgagcacggcgagccccgacatgttcatgactgccaccggaaacccacccgacagccggtttccgtcgacggccagcacctccatcccgcgcagcgcggcgagctcgccggggatgccgccgccgacgccgttgttcatgcaggcaagcttcctcagcgtcgtgacgttgccgagcgagggagggatcgtcccggcgagacggttcgacgagagcaccagcgcctcgatgccgacgggcaggtcgccggcgccggggagtcctccggcgagctcattgccgtcgaggaacagcgccctgagctcggagcagttcgcgaagctcggtatggtcccttgcagcgtgttattgctgaggtagagtgaccggaggcggcggaggcggccgagggacgccggaatctggccggtgaatctgttcgtcgccagggagaggttcctgaggaatgttaggttcccgagcgaaggagagatgcgacctactagacctactagatcaatggcggtgacgcgtggtgggttcttggagctgcacgagacgccctcccagctgcacaggtggttgctgctgttccatgagatgagggattgctctggatcgagactgatcgcgttcttgaattcaagcagcgaagacagctgatcggtttcgtttccgagagctgagcagatgactgaatgggagatggtggacgccaagaacaccaagaggaaatgtgcagttgcagtggtaaccttcatggtcatggcgagcttgtttgctcgaatttcgatcgatcttggttgtgttcatacattgaaacggatcggaaagtttaaattttcaatgttgtataaaatgttcggacactcagttggtagtagttgaaatacctgaagaatggtttagcttaattaggctaagattatctgaaaactagcttcctttcagcgctgtacagagttgagagttttcttcataaaaatcctgcacacaagaaagctactagtcatcatctctttcagctcaaggatacattacacccaattcaagctgccactactagaaaaattattttttatagcattacccttttatttttactgtcgggtttgatgaaaatacgattgtgaaaataattggagggattccggttatcaaccgcttgcaaaaatttgattttcgctggcggtcacttaagaggtctgcttgcaaaaatagagatctttttataggttaccgacaactaaaataggattttcgctagcggctaccaaggatccgccgccacagcaacgggggaggccaacggagtgggaagcgatggtggtaggagggtgggcgcggatccgccggcggtggtgctcaggcggtcctccacggcggtgaaggaggtggatccggcggcggctgccacgacgacgacgacgatgggggctgccacaacgacgatgatggctaggctactccaacccctcccccccatctaccacttggcgaccatggcttgggctttggcaggcggcggccacggtgaggtgttgtggcagcagccggcggtgtttgcggctgtggcagttggcagcaccattttgaattttttttatccccaaaattgtcttcactggtggtctaattttgccactagccaaaatggtatttttgctagcggttgtcttagcatagctgcttgcgaaactcaattttcactggcggccagcattattttcacttgcctttagtcactggcggcacatctagccgctagcgaaaatccattttgactgtcagcgaaaactattttttagtagtgtgccttttctaattaaactattcactactcgacgcatacatgaaaacattagttgactaattataggctccttcctggttaccgaacgttgtattgcataatttagtccatgcttacatgagacaccagtggcagttcctatggctagtccatgaccagtgatattacttttgacttccccttttctttttgttgcagagatcctttcgactttccaccagggtttacaattttgatttcggtaggaccgaaattttaccaaatttcatgattttcggcacttttcggaccattatttttttgaaattttgaaagattttgatcgaatttgagtaaatttgaccaaattccacaaaaaaaagagaaaatctgaaaatttctatcggtatattgatttgccggtggggaccaaaattatcgaaatttcgaaccaaaattgtaaacgctgctttccatgtgcaagaaaataaatttaaagggatttgctaggtttaaaaaattgtggattactaagcctcaaattacaattctatgcaatgtgtttattgcatgcagtgttttccttccatgtttaaattaatacatggctcacattttaatcccctcctatagatatataccgcccaatccattatagactgttcgattataagcaatcaacggaccatatgacttccaatcgaattctcgtttatttgagtggagtgtcgagatctgtcccgtcgccctattctgtttttttctaatttagcaatgctcttttatgtctatagtctatataccctatggcaaaaactagatatgtaaacgatttacattatctttttttttttaaaaaaactaactagatatggaaggacgaggccaagaacgtacacaagactcacagtagtaaccttcgtagtgagcttgtttgatcaacgtacggacccatcgtttcgtttatttgtggaataagcgaaacaacatatttgtaatttgtaaataaaacttttatatacgtgtgcttagcaatctaaatgcaaaggctgaaaaataaacttttatatacgtgtgcttagcaatctaaatgcgtctgatgaacacggtttgagatgggatcgttttgactagcttttgatcgaggtagaaccatacatatgaggtgcatggcttgtagaactacacaagtgatagtgttttggattcaaattttaaaatatttttatacgatgatgattctggttgttaatgatgtcctttgaaacaaataaattgtcaaaatataataatgaagaccacgttaaaaccatatatatatatacggcttatattttgtaatgaactagctgtagataattcatacagccatcaacatttggatatttagaaaagatgcgaatgcttaacttaagaataacatgacatgttcctacttcccatgataacaagtgaaagtagactacagaagagaagcttacagctcgcggtagctgggcactcgaagcccgaacttgatgccggcagaatggtactagtatgatatattgatatgtgcacatatgcgagtttgcagtgtgtttgcaggtatggttaccttaatttataggcacggctggtaaatgcatgcaatgaatcgatgattagtcggggccagcttaaatgtgaatacacgatgtaccacttgcatgttgacttgactctagctagcttcgtcggtcttttggaaaacagacagcatcgtcgccccttgtatagggagtacgcggtaactattactcacttcgtatatgtatgacgtcgtcgacttttgaacaatgtttgatcattcattttatttaaaattttttatgtaaatatgaaaatatttatatcatgcttaaaaaacatttgatgatgaatcaagtcataataaaataaatgataattatataattttttaataagacgaatggttaaacgttggataaaaaattaacggtatcatatattaaaatatggaggtattattttttttttcaagttagggaagtgaagaattccggagctctttacgtcatctaagaatatgcacataattggtgaaggagctccgatccgtagcgttgacgatgatgactcaaggcgctacttcacatgacagtgtcgcaacgcttacgtacgtcccgttcttttcagcttattggtcgatcataataatagtatggattatcgtaggcatactttgcaaattggcacttttaatttatcagttttttctcttagagaactttaatttctgtatcaccttatcaacttactaatattcaatttattcgtttcgaccctccgataattacttcctccgtcctataatataagggattttgagtttttcttgcaacgtttgaccactcgttttattcaaatttttttaaaattattatttattttatttgtgacttactttattatctacagtattttaagcacaactttttgttttttatatttgcaaaaaaatttttgaatgagacacgtgatcaaacattgcaatcaaaaacttaaaatcccttatatcgtgggacggagggaggatactatatcattcaccatacatcacgggctggaccaacgcggcaattcataggtgcgaagggatgaccaataatcgataagccatcttccagtcatgatatgctagcagatcgagcccattgatttcagcacttcgatcagtcaaaggcatcccatcgagtgtcaattcttttgctgccatgttgatcccgaattcgcgatcgtcactgctcattagctagctagctataggtatcgatcagaatggagtcctgagtcaattctcatttgtctccatctagcttcacccgacgcaacttgtcggagggacgaccaaacgatcgatgcacactaccggagaagtgctcatctctcccaggtcgtaacccctttactcccgtgtagcgaaccgggaggaagaatccgggactaaagatgacagtctttagtcccgattcaaatacccggaagtaaagctccatctttaatctcagttggtaacaccaaccaggaatcaggactaaagattttatttatttatttttaatttggttgtgctgcctgcttcacacacacatatatatagagatatttatggtacatacatacatacatacatacatacatatatatatacatgttggactttgcactaggatcacctaggttagatctagtcgggtggttctatttgggattgatgtttgaactatagagattgaaaacgggagagggtttagatagaccgaccggttgaggtgttggaggatgaagaagtgccggccatcgtcgtcgttggcgctcggttgtcgtggatgcggcgccggtgaggtcgacggcgatgacggctgcgggagtgacggtcgtagatgtcctggcgatgaggtgtggcgcggcggtggcgcttcccgtcactggctgcgccccctctcgatcggattagggtttgtagggtggagttggcggcggcggtgaatctcgtacctcgtgccgtgccggcctccacccctcttttatatggcgcagtgtgacggggcccaccagccattaagctggacgcccccgatcagggcgcggtcaaggccctcttgagccgttgggctcaaggggagggagatcaatctaacattctcccccttgatctcactttttcttttagctttttctattccatcacagatttgtaaatagagcatgtttcatcgtcacggtcaatcaccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagcgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagtcagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacacatatggctttgttttcatttcattgagctcatactgatttatgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgtggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttttttattgtcccatcaaacttcaagtaccactgtctcgaagcttgctttaatccataaatggatctctttagacgacatcccatattttcgtttcctttcatgaaaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttgccacatcctgtacctgaggctcttgatgagtctcctgtactggcacattatctatttgaggctgttgtagctcctcctctggtgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcagctgactgttttggggtccaacttcccaatatttgggttaaatactttggcctctgtaggactcccccacacacggaggtgagttagcgagggtactcttcctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccatacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggggaaagaatttcattcttaactagtctctcaattctccccctcgaaatatggcccaaacgacagtgccataatttcgatgagacattggaagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagtttctttgcaaagaaggaacataaaagacatctcgaagtaaaagtgtgaagccattcgcgagctctagcggaagatctccaacagcttcaactttttcttcaactccattggcaactctaatggagctttctcttccttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcagaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccatggtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaagttcagcaggttctataggacatggggtagtcaacacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaaattagacataacacttataaccataactataataatgcaattaacaacgttggtcagaaaattacaacatcatagcacataattaatgttcctaaaattaaattctcccgttggttcgaaatttaattttagaaacactaattttcatcaattacatctatttgcagcggaaaactatataaaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaattggaaaaaatgctactgttctcttttctttgttttcggccccgagggacctcaaacagactttttccggtcggcccgtggccttttggcacgggcgggcgcccccttccccaagccgcaacctgggcctgggccaggaaagccgcccccccgcgcgcgccctcttgggccgatttcggcccggccggcgtcgaccgtccgatcagctagggtttcgatcggacggccgggcgccgagatcggaggatcaaaaacccccctctcccagccggccgccgaaaaccctagcttctcttctcttctctctctcgcgcgaccgcgtggatggcgtcaccatcgccggcgaccttcgcgcccgccgcgccatggccagcgccttttctcttctcttctccccccaccgtctctcgccctccacccgcgtgaagtgagagagagaacggcgacgacggagatggcggcgcc

SEQ ID NO: 5609 - DNA, 11585 bp, Oryza sativa
ctaggatcacctagggttagatctagtggggtggttctatttggaattgatgttttaactaaaaagattgaaaacggagagggtttaatatagaccgaccggttaaggtgttggagaataaaaaagtaccggcaatcgtcgtcgttggcgctcggttgtcgtgaatgcggcaccggtaaggtctacgccgatgacgcctgcgggagtgagggtcgtagatgtcctgccgataaggtgtggcgggcggtggcgcttcccgtcactgactgcgccccctctcgatcgaattagggtttgtagggtggagttggcggcggcggtgaatctcgtacctcgtgccgtgccggcctccacccctgttttatatggcgcagtgtgacggggcccaccagccattgggctggacgccccagatcagggcgcggtcaaggcccccttgagccgttgggctcaaggggagggagatcaatccaccaatacatacatatatacccatatatatatatatatatatatatatatatatatatatatatgcaatgtcaatatatgcatatgtgttaccaaccgggactaaagttctttagctcccagacaggggtctgacgtgccctgtcagggggcgaaccgggactaaagatcccttagtaccgttgtagttataaaccgggactaataaaccattttagtcccggctattgtggaaatcgtccgaccttttaaagatcacttctccagtagtgataagtacgtaccaaaaaaagtatacacacatatcgatcacactgcacagtaacacacgctatgctatttgcttgttgaaaaaaaattaaaagtatatactttttttctacctgattttacgagaatatatatacatgttcgaaaagaattgacaagaatataccatcgtcgtagagcaaatgtgcgaacttgcgcgccgctttgctgcgcctagcgaactgggcttctgatgagatgctaatgattcaattaattaattattaatttctaactaggaagataacccgcgcatttgcacgggcatacgcattagtttgtttcgaaaatagttctaacaaaataaattaaaattaaagtaacgtattttctattttgaattgagtgttctttatatctctctttcgtgaagaaatctcaacaactttcattggttttttttaccatcctgctagccctctctttaattacatgcaattagttatgcatgtgaatcaatatagatagaaaaaatcatttaaaaaatatttattgtagtagttataattattgggttcacctatttaaaggaaaatcaatggtttgttttttatcataatttttaggatttttaatttatttgagcgccatatgacatcttaagagtgtttctagcacaccacgcatgcgataggttgagcccgtttgtagggagtttatttgatttttactatataatagatacttcctccgttttataatgtaagtcattttagtatttcctacatttatattgatgttgatgttaatgaatctacatagatatatatgtctagattcattaacatcaatatgaatgtggaaaatgttagaatgacttacgttgtgaaacggagggaatagttaatatagcatttcttatattattgtttatgtactgagctgctagctagaaaatttggataaaaaagtgagcaggtgagataacaggagataaaatgatgggtctactatattaaatattaagtgaaaatcaatgatatgatgtttttctttttttctcagaactttttagatttctctaatttactagagcgccaagtgacggcttagtagtatttgtaggagtcacgtgacggattaagagagtttctataaagtttagttagtggacttttatatataacctggttttttcagctttatcctttttaatttcggttcatacgatcgtacgttacgttgatataaacgtaacatgtaattattttttttaggtagtacatttatacgtacattcctctccatccacatatgcataggataggaaggatgttttttgtttttttttctatttatgaatagtacatcgtacctttatctccatccatttgcatcagatccatattagaaggaatgattttaatatatttaatctaatggcctgaaatatcggacccactaatttaagtgaaaattaagggccatatgttttactttttttctcagaatttgtaggattttctctaatttattagagtgccactgtagcacaccacacaatgataggttgagagtgtttgtagagagtttatttgatatttactatataatagatagttaatatagcatttcttattatttatgtactgagctgctagctagaaaatttgggtaaaatagtgagcaggtgatgtaataggagataaaatgatgggtccaccatattaagtgaaaattaattatatgatgtttttctttttttctcggaattttttagatttctctaatttattagagcgccatgtgatggcttagtagtgtttgtaggagtcatgtagcggtttaagagcgtttataaaaagtttagtgacttttatatataacctggtttttttggctttatctttataatttccgatcttacgatcgtacgtgaagttcatacgaacgtaacatgtaatttgttttttttttgtgttttaggtagtacatacgtacattcctctccatccatatgcatcggataggaaggatcttttttggttttttctctgtttacgaatagtacatcgtaccttcctctccatccatttgcattagatccatattagaatgaatgattttaatagatttaatctaatgacccgaaatatcgggtcctctaatttaagttaaaattaagggctagatgttttgttttttttctcagaatttgtaggattttctctaatttattagagtgccacgtggcggcttgagagcatttttagaaagccacgtgggtgcttcatagcgtttttagtaagattaatggatttttagtatataatagatagatagatagatgatgttgcgagagatgccaatatgagagctgcaaaattttgcgagatctttagggatattgttggagctagtcttttacttgtaaaaatggtaaattttgatgtggggaatgattttgcaacacttgctaagccaagctacgactcaaagcacaacttgaatccctcaactagtcatgtttgtttcggcttaagattaattactataatctagattattaagtcagattactattaactgaattataataagccgacatagaataagttgttagctgtttgtttctgtggattattagttgtttgttagttgttagccacctaataattaaaaaagcacttttaaagtggattaccatattatagtaagctgtctgtttgtttcagcttactccgaataatttggattataataatcctaagctgaatcaaacagggccttaagttagtcacatagataaccagacacagactatgtgttcttgcagttcctttttccacattcctacttggggaaaaaaatcaggatttttgaaatttaaataccattaggccaaaagtaaatatttttggaccaatttgttaaaacaaaattccgaggctgaaagtttcgaaaatgctcaaaatcgggcgcccgaacagtgcaaaaaatcgggcgcctcccactcgtgcctctgcctcgcctcccacacgtgcgtgtcgcccccaccatatgtccccaccactcgcgctccgttgcaacaaccacccgatataacggaaacgcactatcaaggggatttgttttatttttttccaccaacaatatttcaggtagtgtactcgtgatgtttcactatgtatggatgaaatgttgcagtggattttggtactatttcataatttcatcttaatggacatgtgatttgttgatgtatacgtggtttaagtgttgcaatggctttaaattgtttgctgcatacgttgaaccaaattattttatctagtgatcttaatgtttttcatattttttaagaattgaaacattctttcgctatttgctgaaacattgtttttatatagggtgaaacaacgcccaattttttttggaaaccgttgtttcatacatcttctattatatactaaaagtccatttgtcagggttacgggttaggtatatcctttacccttcgatatacgtcgcatatcggtatggcatacctacgcgtatatggatactctctgcatacactaaggaaatcctttacggagtttatagaaggaaagaatcctactcggacaagactgggtcgtcagtgtatcatgtagggtctgatgtctccgagttctacttggaaaccgcctgacctgcgatataaaagggaccccccggggaggacctaaggcatcgaatctcagagccagcacaacccccacagcctacgaagtcggagcctgcaggagccaaaccgccggagatctagtcgaaccaactcgattacgatcttgccggatccatcgagttccatcgttccttttgtaacctgtgttttccatcatataatcccacatcaactggatttgggctattacttattaaggggcctgaaccagtataatcttcgtcttctgtttgcttgatgtcgtattacgtagacccttgtaccaacgtaccccaataccctctatatccggtctacgggtatcacccgtcgacagtggcgcgccaggtaggggaacatggtgctcaaggttctactactatgtcatccagcttcgccgacaaccgcgtcaacaccaacctccaccggggatttcctgcttcaataatgctggtgtggactcaagtcgacgaaatcgtcttcccggtttacaccacgatcccgatctcagccgacccatcaatgatcagaaacgagaacgcaatggctacaacccaggacgactccatgtcgaaggatcctcccgccgaagcggagaacggaacatcgacgacatccgagctcgagaaggattctaatgcgaccaaaccttgtcgtttagacaagagccacgagccaacgagaatgacttccgaagcgacaaggtcctggtgtcctatccacaaaaccatgaaacacactttgcaagcctgctgggtttttctcaacgtccgcgctgaaattcgcgcctgcaaagagcgtggaattcagcgtatttctccaactcgtgatgtctattgtcctattcacaagacaaagaatcacgacctctcaagctgcaaggtcttcctcagcgccacgaagacgtcatctcctaaggtccagcagtcaggcatatcccttagagatgaagacaaggaacaaggaacgacgctggtttcagatcgattcgtaggcgtaatcgacatcagctcacccgaaccatcagtcctgcatctactcgaggactatggctcatcgccagcaagtacgccgcgcgaggtattagctatcgacggaaccagcacgtcagcacacgctaatgcggaaacacaaaatcaaatggctacaccggcccagcacatcaggaccatcaacgcaatactgagggagaccccttacgatcccgttctaaacgatgatctcgcacaatggacagaacggctacgggaatcaagaaccaacctcaactacgcgttcgaagaagccgctgctgcggcgcacccggaacagccactaactggcggtgccaatggcgaaaatcccaaacagcaggagtcaccgcatcgagctaccccccacctcgcggcaccggcgatctccgcaaccacctcaatggccgccgagaggcacgacgcacatgagacaacggggatcgctcccgataccgcgtctcttcacgatgtcgcgataatgaaagacaggaaggccgctcgaacgaagaccgagactgtgttaatcgccacgatcgtgagaggcggacgcagggcgacgctggtcgaggacaccgccataatgacgaggacgacagagatcggcgccagaacaagaccggagggcggcgacaagattctcgagaacctagccgacgtcctcgtaatcctacactggaaccaagtgatccatcgtcatcgtcgtcttcttcttcatcctcatcattagacagacatccacgaaggacacacgatcgccgacaacccaccgcccctagcgctgggtgtagagctttcagtcgttccttgcgtgatgtccgatggcctgagagattccgacccagagcaatagagaagtacgatgggagcaccgacccagaagagttccttcaagtttactccacagtactctacgctgccggagcagacaacaacgcattggtgaattatttgccaactgcgttaaaaggctctgcacgttcatggctgatgcatctcccgccctactcaatcacttcgtgggcagacctgtggtagcagttcgtcaccaacttccaaggaacttacaagcgccacgcgatcgaagacgacctacatgcgttgacacagaactcgggtgaatccttgagggaatatgttcggcgcttcaacgagtgcagaaatacaatccccgaaatcaccgatgcttctgtaattcgcgccttcaagtccggtgtcagagatcgctatactacccaggagttggcgacaagacgcatcacaactactcggagattgttcgagatcgttgagcgatgcacccacgcaaatgatgcgctgagacgcaagaacgataagccgaagaccgggggagagaagaaaccagccatggacgcacctgagtcaagcaagaagaaaaatcgcaaaaatgggaaaagaaaagctcaagcggaagttctcgcagcagaatacgcgaaccctcccaagcgcccagatccacaaggtagcgacgtgaagaaagcatggtgccccatacacaagacggacatacattctttggaagattgtcttgttttcaaaaagtcgctcgagaagcacatggcatttgaaaaaggcaagcgagtacgcgtggtcgagaaggatgcggaggcggctcctcaggaatcggactcaacatatccagactctgacatccacgtttcacacattttcggaggttccacagcgtactcctcaaagcgagaatacaagaaagtggaacgtgaagtctgtttgacatggcagggggctgcacccaagatgaagtggtctgaacagaagatagaattttcggaagaagaccatcccaagactgccatcatcccaggatgctatccgatcatggtcgaatccactattcggaacatcaaggtcgcgcgggttctcatcgacggtggcagctcaatcaaccttctcttcgccagcacttaagacgtgatgggaattccacgaagcgagttgacacccaccgatcaacccttccatggaattactccctagtcctcgtccaaaccattgggcaaaattacattgcctgtgacttttggccaagcaaacaacttccgaatagagcagatcacctttgatgtcgctgaattcgatacagcgtataacgccatcatcgggagaactgcacttgcgaagttcatggccgcatctcactacgcgtatcaagtgctcaagatgccaggaccgaagggaacaatcactattcaaaggaacgcaaagctggcggtacaatgcgacaagcttagcctcgacaaggttaagcaaacgcctagcccacccgccacaactgagccacccaagaaagtgagaaggacaaacaagacgccaaaaccggacggcgcgatcaagatcgttccactctctagtgccaaccccgataagaacgtcaagatcggggcatcactaagcgagaaataggaattcacgctcatcaccttcctccgcgacaatgctgacgtgttcgcttggcagccgtccgacatgccgggggtccccagggaggtgattgagcacaaactcatggtgcgacccgatgccaagccagtaaagcaaaaactgcggagatttgcaccagaccgaaaacaagccatacaagaagagctcgagaaacttctcaaagctggcttcatcagagaagtacttcatccagagtggctagccaatccagtcatggtgcggaaggccaacgggaaatggagaatgtgcgtcgatttcaccgacctcaacaaggcgtgtcccaaggatcaatgccctcttcctcgaatagatcaattggtggactcaacagccggctgtgagctgttgagcttcctcgacgcttactctggctgccaccaaatcagcatggcgaaagaggacgaagagaagacagcattcatcacgccattcggggtattttgctttgttaagatgccattcggactgataaccacagggaatactttccagcgcacggtacagggcgcacttagcgaccaactcggcaacaatgttgaggcatacgtcgacgacattgttgtcaaaaccaagacaagtgactcattgattgaggacctgcgggaaacgttcgacaacctccgacgatatcgcctcatgctcaatccaaagaagtgcacgttcggagtaccgtcgggcaagctgctcggtttccttgtctctggcagaggaatagaagcaaatcccgagaagatcaaggcaatcgagaacatgaagtcacccacaagactcaaggaagtacaaaagctaaccggatgcatggcagcactaagcaggttcgtcgctaggatgggagaacgaggacaacccttcttcgctctgcggaagaagcaagacaaatttgtatggacacaggaagctgaagaggcattcgttgcactcaaggactacctatcaaacccccctgtacttgttgctccccaacctaatgaagaattattcctctatattgccgccatgccatattccgttagcaccgtcattgttgtcgagagagagaaagtacaacgaccagtctactacatcagcgaagctctccatgacgcaaagacaagatatccacagatccaaaagctgctttacgcggtaatcatgacatcaagaaagctacgccactactttcaagcccacagagtcacagttgtctcctccttccctctcggtgaagttgtgagaaacaaagactttgtcggctgcattgcgaaatgggtagtcgagctgagccagtttgatgtccactttgtgccacgaacagccatcaaagtcccaggtactcgccgacttcgtagccgattggactatgcctgataacaaatcagacaaccaaatcgataacgaaacatggacaatggcgttcgatggtgcactcaacagccaaggagcaggggcaggattcatcttgacatctccttccggagaccaattcaagcacgcaatccacctcaacttcagggcgaccaataacacagccgaatacaaaggactactcgccgggataagagctgcagccgcacttggggtcaagcgactgatcgtgaaaggggactccgagctagtcgcgaaccaggtgcacaaagattataaatgctctaaccccgagttatccaagtatctcgcagaagtcaggaagctggagaaaaggttcgatgggatcgaggttcgacacgtataccgcaaggacaacatcgagccagatgacctagcacgacatgcgtccagacgagaaccgctcgagcccggcacttttctggacatcctgacaaagccatcagtgaaagaggttatcgacgaagttagcccagccgcccccgacattagctcggaggccacagaggcagaacgcgccgttgtcgatatcgagaccacagacgactggcgcaccccactgatcaaattcatcaactgcgaagagttgcccgaggacgatgcagaggccgagaaaataacccgtaaagcaaaaatctactgcatgatcgggaacgatctatacaagaaagcaccaaacgggatacttctcaaatgcgtctcgtccgacgacggcagacaccttctccttgatatacatgaaggcatctgtgggtcacacgccgccggacggacattggtcgggaaagctcttcggcaagggtttctctggccaaccgccctcaaagatacatgcgacatggtccagcgatgtgaatcctgtcaattccatagtaaacacacaaagctacccgcgcaagcgctccagactatccctcttacttggccgttctcgtgctgagtgctagacatactcgggccattcccacgaggacagggcggctacaggttcctattcatgacgatcgacaaattcactaaatagatcgaagcaatacccacgggggaaatcaaggccgacaacgccatctaattcatcaagggggtattttgcagatacggactaccgcaccgcatcataaccgacaacggctcccagttcatcagcgccgatttccaggattactgcatcggactgggagtcaagatatgcttcgcctcggtctctcaccctcaaagcaacggacaagtcgagagggcaaacagcatagtactacaagggatcaagacccgcgtctacgatagactcatgtcacatgacaaaaaatgggtcgaagaactcccatcagtactatgggccgtacgcaccacaacgacaacgtctaacaaggaaacacccttcttcctcgtgtacagctccgaggccatgctccctagtgagctacgacatcatagtacacgagtacagaagtattccgacgaggaccaggaggagcagcgaaacgtcgatgtgaatctactcgaggaacatcgcgaacgagttgccgtcagtgcagccagttaccaacaagccctccgccgctaccacgagaagcgcatccgagcacgcatactttcgatcggtgactacgtcctctgacgggttcaaagccaagcagggcgaaacaagctctcacccaaatgggaaggaccttacacgatcacacaagttttgcggccaggcgcattcaaaatagcagacggtgatggttgcgagttggcaaactcttggaatattgaccaactacgtaaattctatgtatgagtcaatatcatccacacctgtaagacgccttacaacatcaatggagcctatttttaggtgcatattacaatcaaagtgttcctgcccgatgatcccttacccagatgacacctagcgttgaaacctatcctcatgtccctttacgccgtcttaacaaggccttcgaggaacctaagggatcttcggctggggacgcccagagccgataaggccttgtcagatcctatagggacgaaagaccatgtaagacctggtcgtgtaagagttctcgccgtgcgtattaaccaagctgcgtaatcggaaattcactttccaacttcacggctgggggctaggatcagtgcttattcaaccaaggcaggtcaaaggtccaagagccttaccctccgagaagaatcctccgacgacaaggctgggggctggggagagtgtatgactcaaacgattaactaaagttgtgaattgagaacacactcttacacacggtacccagaacatccatcatagggtacaa

SEQ ID NO: 5610 - DNA, 3866 bp, Oryza sativa
atgtatccggccgccgactcttcgggatccccacggggtactcggagctctctacaaaccttggccatggacgtgcacaactcttcaagtacgagttgaaccacacctcacgacctcagagcgtttccacagcttgctctttctttacttccagcatagttctctcgagttccgctacttcaaatttcgtcttccaatattggatacgacgatcttggccagcaagagcactctcgagatctgttcaatatggaaacaactaagtcaagctgcacccttctttcgggaacacggctgatcaagtcggaggagcaaaaagggatgaagggaccactaacctaaggaagtcgtcgccatcttcgtcctcgcggctaaaatctgatctacatcgtccggcgacgcgtgtggctcaaacgcaagagccggaatgatcgccggcgacttaggctgcccacgctgctggacatcctcgtcatcaacatctctacaaaggacaaaaaagtactcgagatcaaaatgctaaagaaaactaaggtgatgactgcatgcacaaaggcggttggaacccattggagttttacacagcatgtctaaggaatacaagagagtcaaaatcctactctttaaaaagggggagaacatattcccccaggtcaccgacttcttccatcacctccttacgcgtgtcgctagccgccccctgatccaagatctcgcgcagatcgagttcagggtgcgtcagcctcaaacacgcaaggacgtggcacgccccggtgtagatcccgttggatgtctcctctccgatgctggccgcatgcttggagggaatctcctccatcaccgccgccagctccgcaagagaagatgtcagcaagaactcatcgggattcgccgggatagtagacttgataccgcattccccagcgagttggtgcagaccagtataggtgacccgcaacgagccacggatttccgacaagttgttcccgagctccgacatgcggtgctcaagcccctgccgttgtcgctcattgccagccaccaactcccttatcttcttgaggtcctcacgagcctccgccaagtcgtgcgccagccggtcggcgcgctcgttcgccgatgccgccgccgacctcgcctccataatctcgtgaccaatgccgcgagcactagcctcgaggaggcgccccatttcaacctggagctcctcccaggtgaggacggcagccggtggaccacgaccagccgcgagatcgctggctgggccgcttggtgtcgcctcgcggcttccgggcacgaccacgacatccgtcgaggttacagaaggaggcgcgccggaagtccctccagactcgtcttgcgccgccttcgcccgcgccgccctacgagaaggctgtggtttagacaaagttcgacgaaatcacgaaaactcaaattcattcacttacttctcgccgagtgtcacaagccgctgccgtcgtggaggcgggggagacgcgtccgaggcctggagtataatcgatatgaagtcaggtggaagtattctgactacgtgatcaaatgacaggagaacttaccgagggggtaggtgcctttcgacgatgtccgattacagaggagaatttcctcccctttgttggaacgtcgccaccacttgttgtggcagcaacagcagcagcatcggacacctccttggcgactttctctttcagtgacgccgccacctgatggtccgcgagcggctcgatgatatcagtcagaggaacaacctacgctttattaagtcgtaaggcgatctcggaagaaaaacgcagaaggcccactgagtacacttacattgatggcagcgttgcgtttggccgcccccttctcgcaaaggggaacggggacattgctcgccgtcgtcgggccactgatcatcacctggccgacacgatgtctcacggcttcgccgctcagacctgtgaatcgagaaccaaagttcgataatgtcacgaccggaaataacccaacgggcattccttacgtgcgtgcattaatccttgtcccaggaggcaaggtacaccaaaagttgatacaattcagagtttaacaagcggaagcgtaaatagataacttattacatgggcaacgaaggcccagcacacacagagacaaacgagaaacagcggaagactagggcgacgaccacaggcgcttgacggcaggcacgagctagacaccgaagccttcatcctcctggaactcctcttctggggttgggaaaaattgagcaagactgagtacaaccaccgtactcaacaagacacacccacaagtgcagaataaatgcaagggagtacaaaggggttataccataaaggggttagggttgcagtaaacagcatttaaagatatttagttgctcagggctattttgtaaacacgattctagaactaaacaatattctttatcaaggccgtgaacccacacgaacctgccttaacccaaggcctacgatgattcagaccgaactggcaacccgaccctgggtcccagctcgtcccaagccaacccagaccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgggcccagcctaaaaccatttttggggattttgaatagagggggcggtgtgaatccaattccacaatactccaacaattccacagtgtccaggtgatatgaacattcccaaagtctagagttgtaaaaccgcctaatgttacctaattaaaagcgaagcatctacctataatcatactagtggtaccatgagtagagtgtccactagttggggttttgtttaatctagggtgaacaaagaaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatataacaagcagaaccaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaatcggatttattgcgtgagccgaggggaggggcgcgcggaccgggtccacgggagtgggg

SEQ ID NO: 5611 - DNA, 5970 bp, Oryza sativa
  unsure (1)..(5970): unsure at all n locations
agtgttttccccctctttattgcgcgcggggccggcggtattcggcggaatccgcggcggcggtggcgctagggcacgggcgaggcggcgggcgcggcgcgaggtaggggatgacgggtgggccccacccgtcagcgagggtggcgggcgggcccgcccgtcagcgacgcgcgcgcgggggaaggccgatgggccgcgggggagaggagagagagggagggagctgggccgagccggcccaagagaggaaaggggggggaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttagctttgcacattttaattgttggaggctttcacatggattttacttattctttgcataatttcgaggatgtattttagagtcaatttgggacgcgacagataagtcaggagaaacgcgcacacaagtaagtcagggtaaatgcaagaaagataccccgaggagaaacccgggtcgtgtcctccggtccagaatagtcaaaggctggatgggctcgagcctggagcggctggatccgtctaccaatgaagtcagcagcgacttcataccccgacaaacctcgtactcggagatcgtcgacaacatcgatgaaggactaaagggaaggggtcaaggtgggctttgcggtccaagacgaaatcttgtctggttgttcctcaggaacaacgaagataggatccgaattttctatctgaagatagaaccacctcctccgccatttgctgcgagaggaagggcactggaaggggatataacgcgacttcaggccatcccgaagtcggaatccaacgcatccagacaccctgttggattctatccaacgcaactcgtagtagaagcgaaagagatcaagaaagggctctacgccaatgtaggcctcacaaagatgtgaaaaaatactaaggaaggcaatagagttggggttcagatagagcaaagaaaggccgtagaagttcaaaaccaagagaagaaattcagaaggcggagggagaaaaccgcagagaatgtagtcctcgatcgcaaccatgtgacctaggacaggttggggttcagtacctcctgcttctctttccatggtcccgcgaccaggaagggcgccatcctcctaaagcttcttcagtgacgcgctggtggaggaagatttgccgagatccatcgctgactggagatcgccggaggaaggactgagattgacgagctagggttttgcgggagcggagaagacgagaaacgcttggaggctggaggttttcttcacaacaggcggacttcaaaatggatccccaaaattcccttaaatagacgcacttccgacggtgcgaattccaaggaaaggagagagatagccgccggaaatttctgggtccgttacgcgtggaaatctttcggacttcagtttaaattcactcatgaccgttgggcttcacatggtgttctcgactatgtcctgtctctacggttttcacaccgggaatgacaacagcctcgacactagaagtcgcgaatggttacacgagttcatttaagcagaagtcgggggctactatcagggttacgggttagttacaccctttacccttcgatatatgtcgaatatcggtatggcatacctacgtgtatacggatactctctgcatacactaaggaaatcctttacggagtttatagaaggaaagaatcctactcgaacaagactgggtcgtcagtgtatcgtgtagggtctgatgtttccgagttctacttggaaaccgcctgacctgcgatataaaaaggaccccccggggaggacctaaggcatcgaatctcagagtcaacacaacccccacagcctacgaagtcggagcctgcaggagccaaaccgccagagatctagtcgaaccaactcgattacgatctcgccggatccatcgagttccatcgttccctttgtaacctgtgttttccatcatataatcccacatcaactggattagggctattacctatcaaggggcctgaaccagtataatcttcgtcttctgtttgcttgatgtcgtattacgtagacccttgtacaaacgtaccccaataccctctatatccggtctacgggtatcacccgtcgacaccattaatcttactaaaaacgctctcaagcagccacgtggcttcctaaaaacgctcttaagccgccacgtggcactctaataaattagagaaaatcctacaaattttgagaaaaaaaatcaaaacatctagccttaattttcacttaaattagaggacccgatatttcatgccattagattaaatctattaaaatcattcattctaatatggatctaatgcaaatggatggagaggaaggtacgatgtactattcgtaaacagagaaaaaaccaaaaaagatccttcctatccgatgcatatggatggagaggaatgtacgtatgtactacctaaaacacagaaaaaaaacaaattacatgttacgttcgtaagaacttaacgtacgatcgtaagatcggaaattataaagataaagccgaaaaaaccaggttatatataaaagtccactaaactttatataaacgctcttaagccgctacatgactcctacaaacgctactaagccgtcacgtggcgctctaataaattagagaaatctaaaaaattctgagaaaaaaaggaaaacatcgtatcattgattttcacttaatatggtggacccatcattttatctcctattatctcacctgctcacttttttatccaaattttctagctagcagctcagtacataaacaataatataagaaatgttgtattaactactccctctgtttcataatgtaagtcattctaacatttcccacattcatattgatgttaatgaatctagacatatatatctatgtagattcattaacatcaacatcactatgaatgtggaaaatgctaaaatgacttacattgtgaaacggaggaaatatctattatatagtaaaaatcaaataaactccctgcaaacgctctcaacctgtcgcatgcgtggtgtgctacaaacactcttaagatgtcatatggcgctcaaataaattaaaaatcctaaaaattatgataaaaaacaaaccattcattttcttttaaataggtgaacccaataattataactactacaataaatattttttaaaagattttttctatctatattgattcacatgcataactaattgtacatatatgagaaataattaaagagagggctagcatgatggtaaaaaaaccaacgaaagttgttgagatttcttcacgaaagagagatataaagaacactcaattcaaaatagaaactcaattcaaaatagaaaatacgttactttaattttaatttattttgttagaactattttcgaaacaaactaatgggtatgcccgtgcaaatgcgcagagttgtagaaaaatatttcatgaggtaatttggttgtcttttagctttttatataattgaaacattttcgatttactaaaaatatgttcgatctactcggtgaaacttgatattttttcccgattcgggaatgttttcatgccgcggggtctgaagttcctgaattttcggaaatacgggaagtttcgaaccgaaatttcagggctgacggaaccaagctgccgcctgttcaattcctatttcagcgccaccttccctcccatcctcggcgtctcctcgaccatcatcgccgccgccgccgccgccgccggcggctcgcctcatcctttctccggccagccggtcgacctctccgtcagtttctccgcgccctgtcctactcgctggggtaaccaccgccatcgtcttgctactcctcttcgttccctacaaaatcctacgagccatttttcgttttggggttttggggttgggcaagggggaatttgagggctgtgatgataatgatgctttttcgttggtgatgccgctgatccagttttgcaatgggggatcgatcgacgccgttttctggatgaatccgtccttgaaatcggccattttacttttccttttttgggatcaaagaggtaaaggggttcttaatcttgtagaagaaatggccttggcaaagcagttgttaagtgttgtcgattaggtttccagcaatctgcggaggtggaatgatttggggactaatgtggttttgttatttgaggcctcaaagtctttagattggtgggtgaacataacggaaatttgtgtgattgataaatcaggtattgggatttgtggattggaggaactgggtgtgataggttatttttatcaacgtccgcaagggatttatggttcttttaggtatggtggcactggcaccagttaattaagggttcttgttgaggttgatcatttcttgtgctccttgttgaactgattcccgatttataatggaaatataggagaaaaaaatgtggaagagtggtgaaaattggtcttgttgcttttagtgaatggtaggagcacatgctttgcatctttcatataatcatattgcttcaaggaaataattgtgccctacccgtgagaaggaattggttgcatgttttagttgtattggcatatatctctgatgtctatgttgtaatagttcagagcatgagtgcatgacagcattgtgttttctttgcggatgtgcctgttgtagtggtagtggtagatgattcttttcctctttagaaacatgcagtccgtatatcttttaggaagtcatataacagtggaaattcatcatattgttctctagcccatttttcacttcgattcttcactaaactttcaatagttccagtgtgttttattgtttaaagcacaaaaacttgatgtttgattcttctgatgtagaagtaacaatctaatgttagttagtttgatgatattgggtgccttgaaattgtcgattccgttggattaatatattaatcaaagtatggtgagtgtgtggattacatacagcagccagactcttatatttctggaaactccgatccagcgttaagactagcgaattactctgttgtagaaaccagactgtaatttttaccgagtcaagtatttttttttggcgtaaactgggaagcttctttctaattacttaaacaagttttttgatccagccatttgaatatccatgtattggatgtgtattctgttacatattcagttagatccttgattttccatcctgcagatctgttcctttcatataatcccctcaatttcaaattcttgttccaaactttatcttttattatggagttttatcatataataatagtaattttgataggtttgtggtgacaactttgttcttattaaggtttgcagcatgtgtacgctctgacatgatgtagggtctgaataggaagagctagcacctgtgtggaactgcataataattttgtaatctgaaaaatgttacttacatgctaaattgtaattttctacttctcttgtgctttctatttccaccttatattaactgaaatctcattcttgttaccaaaagcgagctaacctatctcatgccatatctgaacatgcttgatcaggtccatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5612 - DNA, 945 bp, Oryza sativa
aaaaattctgagaaaaaaagaaaaacatcatatcattgttacatcacctgctcactattttatccaaattttctagctagcagctcagcacataaataataagaaatgctatattacctatctattatatagtaaatatcaaataaactccctacaaacgctctcaacctatcactatgttgtgtgctatagtggcactctaataaattagagaaaatcctataaattctgagaaaaaagtaaaacatatagcccttaatttttacttaaattagtgagtccgatatttcaggccattaaattaaatctattaaaatcattccttctaatatggatctgatgcgaatggatggagagaaaggtacgatgtactgttcataaatagaaaaaaaaacaaaaaagatccttcctatcctatgcatatggatggagaggaatgtacgtatatatgtactacctaaaaaaaattattacatgttacgtttatatgaacgtaacgtacgatcgtatgaacagaaattaaaaaggataaagctgaaaaaaccaggttatatataaaagttcattaaacttgatagaaactctcttaagcggtcacgtgactcctacaaacattactaagccgtcacgtggcgctctaataaattagagaaatctaaaaatttctgagaaaaaaaggaaaacatcgtatcattgattttcacttaatatggtggacccatcattttatctcctattatctcacctgctcacttttttatccaaattttctagctagcagctcagtacataaacaataatataagaaatgttgtattaactactccctctgtttcataatgtaagtcattctaacatttcccacattcatattgatgttaatgaatctagacatatatatctatgtagattcattaacatcaacatcactatgaatgtggaaaa

SEQ ID NO: 5613 - DNA, 455 bp, Oryza sativa
cccccttccctcccttgggccggctcggcccatctctcctcccccctctctctctcctctccccgcggcccactcggcccctccccgcgcgcgcgccgctgacgggcgggcccgcctgccaccctcgctgacgggtggggcccacccgtcatccccgacctcccgacgctcccgccgcctcgcccgcaccctagcgccgccgccgccgcgaatccgccgcatcccgccgtccccgcgtgcaataaagtgggggggggaatactccccgtgattccctctccctttccccccatttttccgtctctctctcgcattcaaacgggcggatttgcccccgcaaatctcgccggcgccattgatggtggccgacctcccgcgccggtttccttcctccccggccgctctctcccccttccaaccctatttaaaccctccacgcacctactccgtccggt

SEQ ID NO: 5614 - DNA, 629 bp, Oryza sativa
agaagcagagagcagagagagcaatggcgacggaggaagagctcacccttgaggcgcttgaagcgggtcttgcactgggggcaagcctgcgagccctcgcggcgctcgtagtcgtagcagttgcggcagacggggaaggcgcactcgttgcacgccacgaacggctccccgtcgggcccttccccgacgtcgtcgccgcatatctggcacgccgccttcgcctccgccgccctcctccccccaacccctccccctcctcctccatccctcggatcaccaccagctcgttccggttgtgcgaccccgccaccagccccgcgctcgcctccatcgcaccctcctcgtcggcggcggcggcgatagctggtgcgccgcgtgggggaggaggaggaaatggggggaaggggaggtggtggtataataatggtgtttgttggagagagagcagagcagcctcctccgcgttgctaggtcagcgaagggtgtgtttttttttcttttaaatttttttgtgacaaagattttcacgaggagacagagagaaaggagagtgtcggtgtgtgggagattaaaacgggaaatgtttttgtttagaagagggagagagaaaggaagggggttggtggaat

SEQ ID NO: 5615 - DNA, 37137 bp, Oryza sativa
  unsure (1)..(37137): unsure at all n locations
ctggaggacgttgagatgactacaggggaataccgtgttcaggatgctcaaattgccacccatgttatcccacacgagtctacaactggtagacatgagggggggctttgtgcatctgcagctgctgaagatgttaaggtgatgaacaaatacaaagggaccttacccaaaggtgctgctaaatcatcgatgaatattgcaacaggagtatttggtgatggtatcatgagaagtaagatactatcaacagctagaaaagtagtcaagccacctgtcagagcaagccataagcctccattgaacactctgcatagacccttctccacaaatagtgcttcatttggtcataagaagttgaaggtaaaacgtccagatcaaagtaaagatattcctatgaagattgcctctacatctggattggcgggcaaggacaaccttatcgatgaaaaggctttgagcttggaagatgatgatattttgaaggcactagttgttcatgatggaaagcttgaggtgtatctcaatgttccctcatgcgttcagcttcataggcaacatggaagtgggaatgctgatgataggagcaaaatcaggatgttgtgcaggaggtttcagtttatatgcagggctctcttacatgccgtcgaacagggttcattgaagattcgaagagttgaccttgcagctgataaaatcatcaggaaattgccaggctttaccaaacctggacctactgtgggaaatgttaatggagtggaagttggtgacgaatttatgtacagagttgagctagcccttgttggtctccatcgcccataccagggaggaattgataccaccgattataatggagtgcttgttgcaataagcatcgtttgttctggaggttatcctgatgaattgtcaagctcaggtgaactaatatacactggttctggaggaaagcctgctggtaagaagaaagatgaggatcaaaagctagagagggggaaccttgccttgaagaattgcatcgagacaaagacacctgtccgagtgattcatggattcaaaggtcaaaatagagaggacaacagtcattcaagagctaaacaaatcctaacatttacttatgatgggttgtaccttgtggtggattgctggacagaaggactaaaaggttcaaggatcttcaaatacaaattacaaaggattcctggacaaccagaactttctctgcacatagctaaagggctgagaaggtctctttcacgtccaggcctctgcatagctgatatatctcaagggaaagaaatggatcccatctgtgtgatcaatgatgttagtaatgtccatccaacatcttttcagtacatctctagaatcaagtacccgtcatggcttacaaaaagacatcctcagcatcatggttgcgattgctcagatggctgcatagattctactaagtgcttttgtgctgtgaagaatggaggaaaaatcccattcaactccaatggccaattgtccatgataaacccctcatttttgagtgtggtccatcctgtaggtgccattcttcatgccacaacagggtaagtcagaagggtatgaaaatccacctggaagttttcaggacagccaataaaggttggggtgtaagatccctaaggtccatctcttctggcagctttatatgtgagtatgttggtatcctgttgactgacaaggaagctgacaagagaacaaacgatgaatacttgtttgatataagccataattgtgatgatgaggattgctccaaggggaggccatcaactatttctagtctaaactcttctggtggttgctctcagaccatggaagatgtgtgcttcacgatagatgcgtctgagtacggaaatattggaagatttatcaaccatagttgctcacctaacctctatgcacaaaatgtgctttgggatcatgatgaccaaagggtgccccatatcatgttctttgctgcagagaacattctccactccaagagctcacttatgactataactataaaataagtgaagtccgcgacctgaatggcagagtaaaagttaaagattgccattgtggttctccacagtgctgcggcaggctctattagggcatggttgactgatagtactaggtttggtatttctttgaacaaaaaccctttgtaaagttagtgttttgcttgttgtcatttgagagctttgtagatacatggataacatggagtgttagtggtaaaaagcagtaaggttggtggtggttctgtacatctgttgtcctactacagcgaaatgcagattcttgcatagtactgtggtaatatatatcttgcccgtttgcgacactgttgctgagtccagaatatatgtggaattgaataaaattggcttggtgtttgaactatcccaagaatctggacaggactgcagttgaaagcaggtacacaatcaaacttctgttattttacataacgatcatttatgtcatttgtgctaacaatgagctaggacaatcagaagatggacaagatgtgtggtgtgcttttgaaacctgggaggtagtcttttggtctttggattcatgtgtgaggttggttactagtataacattattgccgttgatatgaatgttcaatgaatctgcttgatctgcaatagctattgtgctagcgaagcaatattttgaaccaatgtatgactagatgaatcacctttatctctgctagacgttcaatacctatctttgttataagaatttcctagttgtagtcttgttatcttgtagaaggtttttaagttgcaatgattgacaattaaatcttttcctatatgactaacagaacacttagcacaacttaggagctagtcccctccagtaaaaaagaatgcctatgtatgctgttttgaattctgaatttcacacttgatgtacctataatcagtgagaaatcagcatagccatatgtataccactaaaaggatcatgatattacagttttgctgatgtgtggcaattaaatgaacagccaaatatgcattttttgagacataaaattgtcaaaataagtattgcaatcaacgtactgtgcaaattcttttttccccattacattcttacgcatttttttcccctgataaggtgtttttaactctttgtacactgcaaacagatgggaacacttgattcttttcagaacattgtatgatagtgtggtaaactcgtaatgaaaaccattggcaacaaatggcattgatattttttatatttttgttataactgatggacttatagagggagctaattttctttcttgtagaatctttggtcctttccttgttactgcaagattaacttggtgcttgtttgagttcttgtcaagtttgtggctatgattgtatagcaatactgctcgtcaacttgcacttcaaaatatattactgtgggtactggtcgccttgatgtgaactatgcgaatcactaggaagagcttcttttaacttttaattcagaaaagaaaataagcacaacacacaattttcactgagtcagaatggtttgcacattcaacacagggactaaaagtaataacatttccattttgttttgttttgctaatttggtcaaatctgttttgatttatgtcaatttctttggtagcttatgatcttgatataacttcaacttatttcattctcatttcaatgcttccatagtaagcctattattggactaagaatacttacaaaagaataaattctgcagaggtggatgctgatagacattttttttcaaaagtaagcgatatttcctctgaaaagagaaacattgtttatatccttctgggcagatttcaataaaaaaaagtaggttaaataaagaccaataaactatagagttaattttgcagtcaaacactgagtgttttttttagagaagggaattgaagtttcaaagtaacttgaaagcgggtatgatttatctggtttcctgaaagtttatgatggatttgctcggtttcttactttagaaaaacttggacagctttttttgatggggaagtttctggttgctgtgtgttcagtcagtatctcaattttcagatgatcatgatatgacttgtggatactgaaaccagatagttctgaattgttccaaccaataaggtgctatggtaagtgccattctcttgattccttgtcttgccagatgaggcttcttaactgaatatctgatggtgctgcttttatctatgctgctgaattaactagtcgcagttttgagcagatcttcagcacatggttggtgtttagccagggataataaaggtagtgcattatttacaaggagatgcacatacatgtgatgaaattagttcaggatttgggttttgcctaaacttgtcgtgggattacatgtgtggttatgatgttaaccattggttaccatttgctttgtcctctgcagcaaatagagtgttttactagctcatagcctctgaagtctgaaccctttttatcttcaatgcattcaggaatatcttcgaattttgactctcataattctttctaaacccctaaaattttcccccagttttctttcgaaaggtaattttcttgatgggataaacatttcctcattttgcaggccatgtgctgcaacctgtaccctaggtcgaggatcactagaagtcgcagcgagtgccgaggtagcaaagatgaactactctttgaagtcttgatcaatcggtgggcatgattactggttttggcggcaagagagtgaagttatcagtaaaaatgtggattcagttaggtaggatactgacgtgttgcatatcactactagctaggaacagatatacctttgagttcttatcatatctttctggttatcacaggaagaaatcggctgtcacaaaattctctgcatgatttgattagctccaacatgacgcagtggggttgcttaccttggacagctggatgcatcaagaccaggtttacagttctaattcatttccaaccgttgttaacctctgagattccttactgttactgacacgattatctctcgatgtgatatgatttcctcgttctcacaggctatgtgttttagaccgagtggctgatctgagaggcactggatactcaaatcagcaaccaaacatcgggtttttggcagctaggcaaaggttgaacgaacgaactcctcttgatcagatcggtgggcatagccatcagattcagcaatcagcactagcttttcacaactgtcgcagctcaaaagatgattggcagaactgcattaccgaaagattacctgctgctggtagtggttggtggtttctgcaaacccatagtttcaggctctagctttattttttttccccttctctctttagactgtggcttgactctgacggaagtaaagggaaatagttgcatcagcacgaacttttttaattttttgaaatttttaattttaaaaataaacccttctaaaacatatttctagaatctaaaccttttggtcacgtcagcgctctaacatagcaaaaacacgccgacatgccacacatagcgggcttaaatagttttgtcccgccatgctagcgaaggtggcgcgtgactacgtaacactgtcataccaaccagaccgcgtgaccaaataatgcttccatgtcaaccagactggcgtgacagtgttgttttttcacgctagtctggctagcgtggttaaaaagttcagattttaaaaataagtttcgaaaggatttatttttaaaattaaaattttaaaaagtttaaataataataaaaaacccatcagcacatgttgcaatcccaatctgaaaagaacaaaagaaagactagagactagagagagtggagttgtcatggtggtggtcaacaattttgatggcctgtgggggcagcttattttgatggccttgcgtatgacagataacagcggctggtacgtattctgacattttgattggtcaatttccattccgtacgtgttgctatcttgctgatgcttttggtttggggcccctgtttagaaatcagggtcggcttggataatagcagtttcctctcatctttgggtagccgatcaatcatcaacgtgtggtggtggtggtggttaagaacaaattttagtctaccaaattggataagtttagagagagcaggttagcgggagagatctgcaggcgtcaccgggtctgcatgtgtcaccaggccgctgctgcctgtactaaattctcttccttttctaattgctggtaaagaagaattgctctgcgttctaaggtatagtagcataactagcatttaaatttggcaaaatttaaatatccaaaatataactgccaaaaataccagatgaaatgtcaaaagacactccactcttatctctgcgaccctacctactttctattaagtgggacaaccagtgattggcaatttagccttttttttatctatcttcttactcgttattaaagactttaaaaacagctatattttaaaacgtactccctccgtactcgtataggaagtcgttttggacagcgacatgatctccaaaacacaacttttacttcttatttctataaaaatatttattgtaaagtgatatatgtatacttttatgaaagtatttttcaagacaaatctattcatatagtttttatatttttaaactcaacaacttgagagttattcatgatttatattcctaaggtttaacttaaatattatcctaaacgacttcctttacaagtacgggggagtacgcctcctttcataaatcgaattaattttgataatatgtctgtttttttcgaaaatactattatattttttataaacttgattaatttaaagcagtttaattagaaaaatatcaaataacttataatatgaaacaagcactgtactggataagataagatttggagggtacttcctccgtttcaaaaaaactcaattcctaggtttctgtgtctaacgtttgaccgtttgtcttatttaaaaaattatgaaaaaaatttaaaaagataagtcatgcatataagtattattcgtgttttatcatctaacaataataaaaattgtaatcataaaataatttcatataaaatggacggtcaaacgttggacatggaaatcaaataattcagttttttttttggacggaggaggtaaggtcaaagagcggtaaatttttaatagagcagtagcagcggcggcagcagcaagagcaaatatcatgattattcggagtactagtgtacaagctacctgtacgaataaaaacaagcagcagaaggtcgggtgcagaattattacgctttcaccttcgttgcttctcctctccgattctctcttgctttccttccctttccctgtcgcgagcttacgcgtcgttgtcccgcgggggcggagagagaaatccccactctcactccatccacctagtctaatccagcttgctgccgctgctgctgttgctgctgcgtcacctcagtacctcacctcatctcatccatcgtttgctccgtttctgtgggatttccaccggctgattctctcgccctcctcccataaagcgaccggtggttcgcaccggacggatgccccaatctttgcatcgaggggcaacgaagcgaggtcacggatgcgggcgatgccaccgccgtcttcttgtccctagatccatcaaggtatccatttctttctctcccccctccgtgttgcccgtctctctgccacttcttgttggtctaatcgagcaagaagggggatgatggtttgtgtggtgtggcaagaacatcagggcttgggtttcttggtggtggaggttgttgatcgattctcgttgtgccccccctttgctggaggcagatcgatctatgtgggcaccttctgttattaaggaattatattcctttttcacggttttcaaggcttcgggagcatcataaacacgtttatggtgttgagtgttttgggtcttttacatctgtacagttttatatgaatcctataaatggacttaaaactatttgaaaaaaaggatatttgtgagttggcaaatatggaacctagttaactcattgccgaatggtataattttgcatattaaaaactttcttcaaggatgagcagaaaatttgagttcaaaatcaaatccagttgcctagtactttgtctgcatagaagatgcagggcacaagaattggttatgtaatgctgatacttgaccaattcagttgattctttactgatattcatatgacaggaatacaggattcaacctatgttcctaaataacaataataacgttgtcaaattgcaaatatgagtcatcctccgggttctgattagatgtttgttcatcctccatgctctgattactgtgcgtgcagtgttaggaggacagagacaagaaaatgcttgtatatctgccaatatcgtgttcttggttgttcatatccttggtctctcatgctttcaagttggccttggccatcagtttatgctctgtgcattacctagctttgtttaatgtgtattggtcaatcccgagaaaaaggaactacatgatgaccttagttcatgcttattaaagcagtgtcatatctctcatttcaagccatggaactctttccattgaaaacctcatttgaaacaacggttgaagtacaacagtagaacacaagattagtatttcttaaaaattgaaatcctagaatttagccagcattttatatgcactgatatgcatgcttgcactttgtggattatgtgtttgctctgttgcttgagtttattttatcctccttctgtgtgttgctttgagcgtgcttctgttgttaaactgatgttgatgttttctgtttatgattcagtgaccagttctctgatcagtgagaataatggccgctgctgaagcaagggctgcttggcagcgtgctgcaaaccgttgcatcgttcaggaggatagaaaaagagcaccaaaactagcctgctgtccaccatcatcagaacagcagcatgtcaaaagcaatggaaattgtaggaattctgaagaccgccctgtgcccaatttcatgccattgagctggaatcccatgaactccagtctgccacctgatattagatggtggcttcagttacaaccaaatttaggagggcagaagaatcttgcaggtgagcacctatattttctgggaagagagatcagtgataaggaagtggaggattcagcacaaaagaatatacacgacgaaccattattttgtgaaatgttcgacaccaatcctgagaagattgaggatgtttttgagccttcgtggatggtttccacagcttccatgaagtattcttctgaaacaggcttacaagacttgaaaaatataggtggctattcccaagttccttcgaagtgcaaagaaaatgccagtgactgtttgttcaatgataaagaattcctggatttcaaaaattttaacccaccaccgtcgaagaacccacagaaggacgattttgatatgaatgcgccttggaaaggaggtgaaaggagtcaaccatggtggcagatcactgatgagaatgagctggctttactggttgcagaaagagcaatgcagcatattgagaattgcgatttaccaagacctacccagatagttcgtgttcagggtactgaatcacgcagtcatgaaaatatgggtaggtacagggggtcatcaggtccagcaggtacaatgtcatatcctgatactggacaatgtgaacatattgaatgcagttacagcacagcaagcacagatgaggtggatttaaccagtgatggagtttggcaacagcaggaaagaaatgttgcacgcaggtgtgtatttcttctgccttactctgtcaccaatttaccctgatgccataattgtaatttccgtaagcatacctaaattttgatgcacatctattttaatttcctagttgatatctgaagttcaggtggtgcattacttctgtattacaaatagaattgctaaatattactgtagtctgaattatttggtgctaagtaggagtttccctttgtgttcgctaaaatgctgtttggtgctagtgagatcttttgtctgttcctgttcagttctctttttgaaaggaaaacttattatactggttaagtttcagttttggttcatttcagagatacattgttgctcactgcctacaggataatggtgccattgcccttgtttgcaaaagagttcatggacttcttcaaaaaagttgcttgttatatttgtttcatttaatcaatacctagagttttttttttaaaaaaaattcctattgttgattgggaactacacaatttcacaatctacattcatctattttaagttatgttccataatccgcactcggaaacttcaaatgtgctccattatttttcagtttcttgtgtttttctggttatcatttcatccaattttcctgcagtgatgcacaagatttttctaggggcatcaatacagaaccacgaggcaagcgaacataccagaatcctgcagagcaagctcaacttttggaggcactttgtcactcgcaaacacgggcgagggaagctgagatggctgggaagaaagcacaaagtgaaaaagacgatgtcatcaagctatttttcagacaggcctcgcatctctttgcgtgcaaacaatggctgaaaatgttacagttggagaacatctgcctccagcttaaacacagagagcatcagatagcaaccatgatacctgatattccatggattacactaaagaaaaggactacaccagatcatgagaaagaagattggacaaggaagaaaggcagaaggcataaaaatgcagggagtttctgtgacgcgctcttatttgccgttggtttaggtcttgcaggtgcagggctgcttcttggctggacatttgggtggcttctggccaagttctgaagttgcccatagttttcaactgagactagcttagctagctaggcatgtattttgctgtgcgcctgtatgtgatgattcatagatgaaatctccaggtatactctccatattggagtgagatggcgaaattttagacccaagaatatgttcgtttggaagctctgctagttagaagacacgaatgtatagggagcatttgttgcaaatttgcaatttgtaaatatgggaggaggacgtctgtgaatgcttgtacatactgatcagtagagaaaaaatgtcatcggacttcttcaacagtactccctccgtcccaaaaagaattaagaggggataagaattaagaggggatgtgatctctcctaggttgatctccaggttgatgtatgtgtttttgggacggagggagtatctccacctgtacctattatttggaaaattagcagcgttactgcagattgtgtttttcaaaacagggaactaccaagcggcagttctgtctgtttttcagtgaattgcaggttatgtgtttttcagtgcaagcaattgttggttatttgcctgaaatgaaattctgtcacattctagttgtttctgcttggttcttttacaatgttcaaatatgtacagactatcttatttctttcttttaatatgttcacatttaatttttgtttgcctgcctgttttcttcaaacaaggatggtagagtgctagtggtaattaatatgttacttcacctcttctacgactacagtatacactggccttctatgaatcgcctcttgatgctccttaaagtttcataatagggattttgtatcatctgttcggggttttttttttatttttagcattcttgtcaattctgtaacatttgttcagcatttcttatgtttccaaaatactagataggtctcgccaagcttagaatcgaattgaatgcaacaaagtttcgcatttgttctgtttggttccctgagcatctatttttcctaagaccaaggagtgaggtattggtgttgaagttatcgtacactgctccttagttgtcattttatttcttacaaaaggttagtggataacaaatatccgagggactacaaagaattgaaaagattttatcatagcctcaaaattatttgttcacattcatgttaaagagaaattgggttcaaaatttgataagcatcgatcccacacaattgccgtctttttttagagatacttctgaaaaccccctttttaattttttttattgttcaccaaattttcgtttaggcaaaactcatacatggctgaggtaaaattgcacgaacataacaaatgagcatttgacagtatactcaccgtgcaccttgaaagatgatgtgttacttctttgcatgtccgcaatttattgatttgtttcccgagccctgacttacctctagtgtgaattgaacgtgaggactcatccgtcaattcgaaaactttcctacagggttagtccacagaagatatgtgtaacatcccgccttcccccaggccaggcccgcttacatctggcagcttttatataggtcatagactgccctcacagaccaacacatgtcttttctgcacactaagatgatgtgttactcctttgcatgtctgtaatttattgtgttaattcgaaaactttcctacagggttagtccacagaagatatgtgtaacaatcccgccttcccccaggctaggcccgcttacatatggcagcttttataggtcatagactaccctcacagaccaacacatgtcttttctgcacactttgtagaagatatgtgtaacatcctgccttcccctaggccaggcccgcttttataggtcatagactgtcctcacagaccaacacatgtcttttctgcacactttgtcctcactcgtgtgcacccgggaagaatttcccggtcggtcactcatcccaaattgctccaggccaagcacacttaaccctggagttctttggaaatcggcttccggaaaagaagtcttaaccctggagttctttggaaatcggcttccggaaaagaagttgcaacttgttgatatgagtattctattaattctattaagccctgggccggaatgtcacaatatgcatcctatgtccatgaaagtactagctctaatggttcattaatcgaattcaacatcatgtctaatttaattaacgcagaccattttgacctaagcaccatgcttaaatcaaaaaccctatggatgtcttacgaacacacccaaactagagcatacaaaaataaacaaatgaagcataacatatacgatcaagccatattcacatggtggtactattgagtaaaggtttggtgaaccttgttttatcttttacataactgagtgtacttaccaccagcataatggatatgttgaaatctttgaaacagtggcatggtcacatatgattgtcgatctctcatccatctgatgcggattgtagcggggcaaggcactttgaccatgccaagccaggcagctgtaacatcctgaaagttaactactttctaattatgcatcatgccagttcttatgttcttaatacctgaaagtgcatctaggcccctaatgattttgatgattgattacaatgcgattagagaggaataacacttttattcaagcaaatatgaaggttgttatgtcctcgacatgttgtaatgagatgcataccccatgaatgcaacatcacgatgcaatgcggcaatgatcaaatggtatattgtatcttttaccttgcattgtgtcgtaggaatgccgtactattaagagggataccacatgcatataattggtagaacactagtgctcaaaatgcttcatctttgtgtgagttgaaaaacctaagccaaaattttaatcccgagttgtttcacttgtcacaacacttacaccgggtttctttgcaagtttttcaacatatcttgaaggttttggaccattttttatgttgggtttgatagcccacgaaactagctttccatagagtccaaaatcttcgaaatcggagttcggagtaaaaagttattgcactttttacttgagcaacattagactatccgatttgaaatcagactatccgatgtatcggactatccgatttttcacagaacttcactctctgtctttgtttgaaaaatcctttcgagtgagtttttctatttgtcggagtatctgatgttggatcagatagtccgatgatacagagactctgaaatttcatggaacttgagtctctatttgaggacgaagtttttgcttctaaaatatcggacactccgatttaacatcagatagtccgatgtctcggaaagtccgaaatttcatggaacttcgttctctgtttcttgttgccttggaggtttaaaatatcggactatccgacgtgggctgaaagattcccctccaatggccacattttttttttgggggagggggggttctataaataccccccacctaacccttttctagggttacccaactcatttcattctcattcactttgggttgagcttggtgctaaggtgctttggatctttgagctcattctccctctctcaaatccctcctcgttcattgtgtggtgtatcttggtggttgtggatttggtatttgagggcctagtgtgtgtttcactcgatcttgagcactagggtttgaccaagagttgtgtggtgtttgttactcttagaggatgaggactcctagacggctaggtgtcactcccgagccaccgatctacgtgtggttggccgggagaagtttgtgaaggcccgatctcgcctccgcaaggaaagagataccccttagtggaaggaggagtgcttagtgtaacctcttgaggaaagggttagcaaagacccggctcttagtgagctcctcaacggagagtagaatcccctgaaggatttgaactccgggaacaactccgtgaacttcatcgttggtgatatctcttcatcctctctttagctttgcttaattgtgctgctatagatctagtcgttgtttgcgctatactcttgtttgtgtgctagatctgcttgttgtgattgtttagtggatcagacaaactgatccaacatcagactatctaatattttcggatagtctgactgtggatcagactttccgaccttaactcaattttagtttccgcataaagttttaaattagcctattcatccctcctctaggcctaattgaccctttcaataaccttctaaacctaggacattataattagagggccaactgggctttcacattgtccaccatgtgtcatgtggtgggccaggtgaatcccggcctcaccaaatggcgccacggctctcttcttgcccagttggccgaattgggtgttgccaggcatgtacgacatgtgtccagactcgcatcgtccctaatgactcagcgctactgtcttttccacgtcttttcagtcccatcggtttggaatctttttcctaaatttgtttcatttatggatgtgatcgttgggttatagctggcgggggggggggggggaggggtcagggccttgactttttcaagtcttcggccttgcccctgtgccccttagcagggagattgagtgtttttaggctagcttctcgaagatgtctttgatgaacaaatgtataatatgtagatcttgtaagcatccccggtccttttcagaaagaacgtgttagtgtcaaggaaccaaggggggccgggtcccagaccagatcgggacctaggctccatccagtccataattttaatatgtagatcttgtacgtttccacgctcatctcaagnaggtatgtgtaacctacaaggacagtgtggggcaaaagtctgccgcaaagacttatggtatcttagagtttgttagagataagtgtcgtgtccgatatggacatagtttgtaattctcgggtataaatagaccccggatcccatataatcaatgaacacacgttcaatacaatctcggtgcatcgccaccctttttactttcgttttgtttcgacgagttcttgctttcgggttgagctgcatcgatttcgatcttcaacaagaggtaaaacttgttatggcggcttgcattctcgggattagtgcttccatctttatgatactctaatcttgtttatgtaatttgtcgagttatcatatatcttacataatctctagcaatatcgctatctaacctacaatcggctaacatctgtcggtagagggcagccgattaggttagacatcgatgttgacttagattatataggatatccaccactctatgaaacttccaatggcttgattgtctagatattgtccttcttttcatacttatagctgcatcagttgagtttgatcttataagtcgtgattagaatctcaatcttagcctgcttcttggttgccgattagggtagtatcggggtttcaaccgatcttatctgatttaactatatttactccgtatgcttcgttgatatgttaaatctgccctttatgttaagatcttgttgcatttaagtatattaggcctttgtttgatatattttacttgctttaatatcttaatatagagtggtatcggagtattagctgatacatgctagatctatctgatcggctttgctatgaacatatatagtcccgttattaatatatattttgatctaagtgatttatactgtctcggcatggcgaccgatctatcccaatcacttgatttaagtatatatcgatataaggagtatatattgttaatatctacagccgatcgagtagatttagttccttcttatttattcatgaccgccgatcgatacatatatgacatcggcccaaagataaatgatatgtcatcggcactcagccgatcggctatcgtttataggtttaaccgcggtttctttgtctttgtttcttgttgattgtaggatcaaatcaactggcacgcttgcatacccgaaggcgagttttggacctgcactggagttaagcagatatcccaggcctcgtgttttatgtcaacacgcttttggtacgcctggtgggacagatcagaagtcagaatcacaacaacagtttttcccatggccgagaaaccgccagcatcgccgtcctcggctggtgaacctggctatgttaaagccaagatccacaagctgggtctatctgaggttgatgaagccaacattgtgcccgtcactatggataaattgacacccgagcagcaaaaggatcttgaggcaatgatgtagcaagcacggaatcagttcttgagctcattcacggagacccgcaagggaacacttgttcaaaagtacaaagtaaaagtaattggtgatgttcctgggacaggttcttctaaggatggagaagtgaaacaagctctagatgacgcggctcaaccgagtaataaaggtgctgcagatggctttcaaggagatcaaggtgatggctctcaaggagttcagggtgttggctctcaaggaattcaaggtgatggtgttcagggagttcaaggtggaggtcttaatcaagatggcaatgcaacacagttacagtttaacaacttccaggatcaggttgactatgctatgcaccatgctttgatcaatcaatctggaatattagtcaacactttgtcaaacatggtgaagataatggttgatggttcaatggctgaatatcaggctacatgaccggtttatctaccaggaggggtattcctgaattatcggccattagtcactgataatcagccagctgttcaatcaattcctcttaatgcaccatcggctcagccgacggcaccagtatcggctcctgcacctgctgcaccgtcatcagcaccaggtcaattagtgaatcctcgattgttggtgagagagaaaccacagcatagtggatagaatgtgaatcggctaacgcaggatcatgttgcagctatgttcttatctcctcaacctactgttgatccaacccagcagcagccgattcagcaaataccaccaaggcagcaggttgtacagccgattcaacaaacaccaccaatccaacaggttgtgcaaccaattcagcagacgccacctaggcggcaggttttgcaaccaattcagcagacgccattaaggcaacaaattattcagccgattcaacagcaaggcttgatgaatgcatcggctgggtttgcaacacctgacaatcagccaaggcagcatgctgcgaatcaagttgtttcagagcacttggttcatcatgtacagccagatcagacggtaatacctcaagttgtccccgagcatttggtgcacaatattcagccaaattttcaaaattaccaagggggcaatttgaattatcagtatcagcctccttcaccgcaagttcaatatcagcagggaggatcggctcaaccccagtttgttcctcaatacaatcaattcgagctcatgccacaataacctcaaggattaccaaagcaacgaccatgggccgatatgattgcggatgtgatgaaagagtagtttgggctcaggccgaaagacgctagaaatttgtatcggtatccttaccctgaatggtttgagagggttcctcttcctaaccgattcaaagttccagacttttcaaaattctcagggcaggatagtgtgtcaacttatgaacacgttagccgacttttagctcagtgtggtgaagcatcggctgtggaagccttgagggttacgttgttccggttgtctttgtctagatcggctttcacttggtttacttctctaccatgtggattaatcaacagttggcctgatttggagaagcaatttcatagttatttctacagtgggattcatgagatgaaactgtccgatttaacagtgatcaagtagagacatgatgagtctgtgcatgagtatattcagagattcagagagatgaggaataagtgctacagcttgagtttaactgatgcccagttagccgatttggcttttcagggtatgattgctccgatcagggagaaattctcgtttcaagactttgatagcttgtcacatcttgcacagaaggtaaccttgcatgaacagaggtttgcagaagccaggaagaacttcaaaagggttaatcatgtctgtccttacatatatggatcggatgatgatgatgatgacgactccgagatagcagcagccgaatgggtgaaaagcaaaaaggttatatcatgccaatgggtaaagaattctggaaaagaggagagatatgactttgatattacccaagctgacaagatttttgatttgctactccgagagaaacagattcaacttcctgctggccatacaatcccattggctgaagaattgggcaagaggagatattataagtggcataattttgggtctcattccaccaatgtttgcaaggtcttcaggcagcagatccaagcagctattgagggaggcaaaatcaaatttgatgattctaagaggccgatgaaggttgatggcaatccttttcctgtcaatgtggtgcatacagctggccgaatagccgatgggggacacgcaagaggtttttaggtgaattcggctaaaattatcgacaagtatcagaagaggtatgacaaacaacaggagaggcattacgaggaaggtgatgacggttttgatcctcattggggctgcgagttctttagattttgctggaacgagggtatgaggctgtcatctatcgaagactgtcctggatgtggtaatattgcagaaagctcaagccgatcgtataatagaggcaatcggctaaagcaaacaagggttcctgttcatcaaaggttagtcccggtgaaccaagattgtaaccaagagggcaatgaagacaggaagactcaatggtgtccttctggtatctttataaagaatcagaagagaagggttcaaagattgaggaacagggagcacttttaggaggtcgaacaggaaatcaatcatcggctaaagaaaatgaagccgaagcaggagtggcgagttaagaatcaagctcctatagccgatgaggccgcagccgatgaagcaaagagattggctaaagggaaaagtgttgtaactgcatcggttaacatggttttcacgttgcctgctgaatttggggtcaagcaagccgatgtcgatgaagttgaagaagaatcagctaaattgattttgtcaccagagcaagcaatcttcgaaaagccggaaggaacagagaatcggcatcttaaaccattgtatataaatggctatgtcaatgggaagccgatgtccaagatgatggtcgatggtggggctgcagtgaatttgatgccttatgctacattcaggaagttgggcagaaacgctaaagatctcatcaagacaaacatggtgctcaaggattttggtggcaatccatcagaaaccaaaggagttttaaatgtggaattgaccgtcggcagcaaaactatctctacaacgttctttgagcatcgatgggaagggttcctacagcttgttgcttggaagggattggattcatgccaattgttgtattcctccaaccatgcattaatgcttgattcagtggcaaggcgacaagattgaaattgtgccagccgacaggtcagtcaatgttactagtgccgatttagctctttgggagatggatggtcttgattgtttatctggaaaagtttaggatggagattttctaaaagtgtccgattctgatatacaaccaattgaagatggagaacctaagctattattttgagggcgtcgtggatgatctcgatgacaaacaaggacagggtttcatgtcggccgatgatttggaagaaattgacataggtccaggtgatcgaccaaggccgacatttattagtaagaatttatcttcggaattcagaaccaagttgatagagctgttaaaggagttcagagattgcttcgcttgggagtattatgagatacccggactcagccgatcgattgttgaacatcggctacctatcaaaccaggggttagaccacatcaacaacctcgagaagatgcaaagccgatatgctcgaacctgtcaaggctgggattaaacgtttatatggtgctggttttattcgtccatgccgatatgccgagctggtttccagtatagttctgttataagaagaacgacaaagtgagggtgtgcattgacttcagggatttaaataaagctaccccaatggacgagtatccaatgccagtagccgatcagctggttgatgctgcctcaggacacaagattttaagttttatggatggtaatgcaggattcaatcaaatctttatggctgaagaagatatccataagacagcttttaggtgtcctggtgcaatcgacttgtttgagtgagctgtcatgactttcggcttgaaaagtgctggggctacatatcaaagagccatgaattatatatatcatgatctgatcggctagttggttgaagtctacattgatgatgtggttgttaaatctaaagagatataagaccacatagtcgatttgaggaaggtttttgagagaaccaggaaatatggcttgaaaatgaacccaacaaagtgtgctttcggcgtatcggctggccagtttttgggatttcttgttcatgagaggggaattgagattacccaaagaagtgttaatgcaatcaagaagattcagcctccagagaacaagacagagttgcaggagatgatctgcaagataaattttgttagaaggtttatttctaatttttctggaaggttagagccttttacaccattattaagattgaaagccgatcaacagtttacttggggggcaaagcaacagaaagctttggataatattaaggaatatcttagctctcctccagttttgattcctccacagaaggggataccttttaggttatatctgtcggccggtgagaagtcaatcggctcggtcttgattcaggagctagaagggaaagaaagagttgtattctacttgagccgtcagctcttggatgcagaaactagatattcccctgtagagaagttgtgcttgtgcttatatttttcatgtacaaggttaaggcattatctattgtccaacgaatttactgtagtatgctaagccgatgttattaaatacatgttatcggctccaatcttgaaagggagggttggaaaatggatatgttccttaactaagtttgatcttcgatatgagtcaccgaaggcggtcaaagggcaagctatagccgattttattgttgaacatcgtgatgattcagtcggctcggttgagattgtgccatggactttgttctttgatggattagtatgtactcatggttgtggtatcggcttagttataatttcccctcgggggggggcaagttttgagtttgcttatactattaaaccttatgcaacctacaatctagctgagtatgaggtagttcttaaagcattgcagttactcaaggaagttgaagccgatgctatcgaaattatgggggattctttgctagtaatcagtcaattggcaggagaatatgagtgcaataatgatacattaatagtttataatgagaagtgccaagaactaatgaaagaatttcggctggttactttgaggcatgtatctcgagagcaaaatattgaatctaatgatttggcccaaggggcatcagggtataagctgatgatcaaagatgttaaggttgaagttgctacattaacggccgatgattggagatatgatgtgcattaatatttacagaatccatctcaatcgacttctcataaattaagatataaagcgttgaagtatactttattggatgatgaactctattatcggacgattgatggggtgttgcttaagtgtttgagtgccgatcaggctaaggttgcaatcggcgaggttcatgaagggatttgtggcactcatcaattggctcataagatgaagtgattgcttcgacgtgcagggtatttttggccgacaatgctggaggattgtttcaaatattacaaagggtgtcaagattgtcagaaatttgaagcaattcagagggcaccggcgtcggctatgaatcctatcattaagccatggccatttagaggttgggggaattgatatgatcagcatgattaatccaccatcgagtaaaggacataagtttatattggtggcgaccgattattttaccaagtgggtaaaggcgattcctttaaagaaagttgattctgggaatgctatacagtttgttcaagagcatataatctatcgatttggtattcctcaaaccattacaaccgattaaggttcaattttcgtgtccgatgagtttgttcagtttgccgatagaatgggtatcaaattgttgaattcttcaccatattatgcacaagctaatgggcaggccgaggcatctaacaagagcttgctcaaattaattaagagaaagatttttgattatcctcggcaatggcatactcgattggccgaagcattgtggtcttatcggatggcttgtcatggatcgatccaagtccctccttataagcttgtttatggacatgaggctgttttaccatgggaggttagaatcggctcaaggagaacggagttgcgaaatgatttaacagccgacgagtattataacctcatggccgatgaaagggaagacttggttcagtctagattgcgagcccttgcaaaggtgttgacagaaaacacgaggcctgggagatctgcttaactccagtgcaggtccaaagctcgccttcgggtgtgctagtgtgccagttgatttgatcctgtaatcaacaagaaataaaggcaaagaaaccacggttaaatctataaatgatagccgatcggctaggtaccgatgacatattatttatctttgagccgatgtcatatgtgaatcgatcggcagttgtaaatagacaataaagaactaaatctattcgatcggctgtagatatttccaatatatagttcttatatcgatatatacttaaatcaagtgattgggatagatcggtcgtcatgccgagacagtataaatcacttaaatcgaaatatatattaataacagggctatatatatgtttatagcatacccgatcagatagatttagcatgtatcggctaatactccgatactactctatatcagaatattaaaataggtataatatatcaaacaaagacctaatatacctagatacagcaatatctcgacataaagagcacatttaacatgtcaataaagcatacagagcaaatatagttaaaccagataaggtcggctgaaactccgacgctaccctaatcggcaaccagaaggcaggctagagattgatattctaagcacgacttaatagatcaaactcaactgatgcatcattaagtatgaaaagaagaacaatatctagacaatcaagccgctagaagtttcctagagtggtagataccttatacaatctaagtcaacattgatatataatctaatcggctgccctctacagacagatgttggacgattgtagattagattatgtaagacatatgataacttgacgaattacatagacaagattagagtgtcgtaaagatggaagcactaatcccgagaacacaatccatcataacaagttttacctcttgttgaagatcgaaaccgatgtagctcaacccgaaagcaagaactcgtcaaaataaaactaaagcaaaagggtggcgatgcgccgagattgtattgaacgtgtgttattaaaattacatagggcttgagtctatttatacccgagaattacaagatatgtccataacggacacgactactatctctaacaaactctaagatactataagtctttgcggcagacttttgcccaatcatatctccaaggagattacataaaacaccctaattaatagatgcaattgccttctcaggactctatccatgtgcggcaatcaccttgaagcacctcaatccaacccgatatcatatatcaagctgcattgtcggaatcggctgtatcggcttacctagtccgactcagacccatccgatcctaatcgtagccgatttggactccagctgattcctgccctgtttccgaacttgatctccgcctccgattttgcttcgatctaatcttctttcctgatgctaatgttaccaaattcggttgttaacaaaaggttaccaaggataaggaacgagttgctcggcattacaacaagaaagtggtgcccaaagcttttttggaaggtgaacttgtatggaagttgattttgccgattgggactcgggatagcaaattcggcaagtggtcgccgaattgggaaggaccgttccaaatctatagagttgtctctaagggggcttacatgttgcaaggcctcgatggagaagtttatggacgagcactaaatggcaagtacttgaagaaatattacccaagtgtttgggttaacacatgatcggctgatgttgccgatacatgatagccgatgtgtttgcatcgccttgagatggtcgatattgttatatcacccttagttgttttcatattgtaatcggttgtgatttgccgatgtacaatggccgatattgttatatcacccttagttgttttcacattgtaatcggttgtgatttgccgatgtacaatggtcgatattgttatatcgcccttagttgttcttataattttatcaatgcttttgtcattgtaaaattaggggggcacatatatgaaaattgcagatttttgagcaaaatatggagttctattgaatcggcataaaagttatcaagataagttcgataaagagccaaagtttcttagccgattacaaaaaatttctaagacctattacacaagatatcactgagacaaatgttgctggatagccgaaatagccctttgcctgatttgttctacttcttcaatggcttgggcatcttgagcgtcgattctagggatgacttttaaagacttggtgagatcagcaacattcttgatagccaattttagtcttgtcttttgttcttcgacagattttgggagatcggctagctttttatgttccatatccagctcggcgttgcattcttcaagttgtgccaagagttcaatcttacgagcttcgagccgatcaatgttagatttaatcgggccctcagatagttgatcaagtttggccttctcttcatgaacaagctatcaattggcctggattgtggcctcgatatccttgcgctcccgacgtttagctaatctcagcttggctttctccagcttgaattgatgctgctcaagatagacggctggagtacggacatcggctagctcatctgggattagagcttgaacctcgtgtagctgagtcctaattgagccacaatcaaccactaagctgtctaacgatgatgcctctagccgctgagagatatcttcaagaattttcttcacatcatcggataaaagggctaaagctttgcttctggtatcctcttctgtctcatcaagatagtctctaatgtcaaaagagaaaagatcagctaagacctgcaataattatttaaagagagttagagctaaatagacctagccaatctaaattcttgtctcaaaaggaaacttactaggatagcaggagcagttggttgttcttcttcttcaatatgatggctctctatagccgatggagtttggtcactcgatgattgttgtataggagaaggaggaggaggaggaggctataaaaaagacaagtgttagataaaatcggctgagatcaactagtggaagagttaagaatatcttactcatggagctggtttgagaattgttattgccgatttcttcttcacagcagttttttcttctgcaactataaaatatgtgagtaatcggccataaaatgaagtgattacaaaaggaatcaagggaagttgtttactcttgaaaaatgggctggggcagaaggagttggaggagtttgcttaggtgaagccgatggagttctttcagtatcgcttatttcatctgcggcttgatcaacatcctcgccgatttcttcttcatccagagcttgttcaatggatggatctagggcaggcagatcatcagttggcttcgttttctttgacttgactttcttctttggagcttgagccgatagatccgcagtcgatgacctggtttttctctttttaccggtatcggctggttctctgatgaacccttggagaagagttgaagtcctgggggcacgataaccaatgacatggggagatggcccgcctccattaggaatcagacctggagcatattcgatatttctaccactattgctctgatgaggaggagagaattctgtcgtctgcaagtcaaaaagaaaattagtcaagttatgaatcggctaagcaattattcagacaaagttaaatcggggcatacctgagggataacatctggaaagaggtatgtcatgtacatggaagccgattgatagaataggtgcagtttccattcaccccaccatctgttaaagtttttgctcctgaacattgccagctctatattctcaatgctgcccagaggaggtccttgaaggttgagcagccgatccatcatcaaggttgatgaaattaaccttgagctcccatcggactttaggtttgaggacattaatcatgaaagataccaaaagtccagggaagttttctcagctgcaatcagcccatgcatccttcctgtcggcatccatcaggaagaaatatccaagtctcttatgagttctatcatccaatgagctcagctagacaacttggaatgggccaactcccaatcggcttattctttgccgataagatccagtgccgagtggaacttacctcagcgtactcggctgacagcgcggcagacgggctatcggaggacgacatcgccgtgggcagagatttggccaaaaatgaagtctcctggggatctccttgtgcgtcggagaaatcgccggagagagagaagacagagttggcttcggcggtgaaaacggaagaagacggtgtgagatttctcgggggtaacggttagtatttaaagcgatggaataacagtcgaaaaacggcaagagcgaatttcgctcggagttgatatatggcaaatccgaaacattgctaaatattccggacttggggggcatgtgttaacgaccaaatttggtaatatcagcattggagatggagattagatcgaggcagaatcaaagatgaagatcgtttaggaaacagagtaaaattggctggagtccaaatcggctacgaccaggatcagctgagtccgagtcagactgtgtgagccgatatagcccattccgacaatacaactcggtatacgtcctcgggttgagttggtatgcttcaagatgattgccatgcatggatagagtcctgagaaggcaattgtatctattaattaggatattttatgtaatttccttagagatatatttgggcaaaagtctgccgcaaagacttatggtatcttagggtttgttagagataagtgtcgtgtccgatatggacatagtttgtaatctcgggtataaatagaccccggaccccttataatcaatgaacacacgttcaatacaatctcggtgcatcgccaccctttttactttcgttttgtttcgacgagttcttgctttcgggttgagctgcatcgatttcgatcttcaacaagaggtaaaacttgttatggcggcttgcattctcgggattagtgcttccatctttatgatactctaatcttgtttatgtaatttgtcgagttatcatatatcttacataatctctagcaatatcgctatctaacctacaatcggctaacatctgtcggtagagggcagccgattaggttagacatcgatgttgacttagattatataggatatccaccactctatgaaacttccaatggcttgattgtctagatattgtccttcttttcatacttatagctgcatcagttgagtttgatcttataagtcatgattagaatctcaatcttagcctgcttcttggttgccgattagggtagtatcggggtttcagctgatcttacctgatttaactatatttactccgtatgcttcgttgatatgttaaatctgccctttatgttaagatcttgttgcatttaagtatattagccctttgttgaatatatttacttcgctttaatatcttaatatagagtggtatcggagtattagctgatacatgctagatctatctgatcggctatgctatgaacatatatagtcccgttattaatatatattttaatctaagtgatttatactgtctcggcatggcgaccgatctatcccaatcatttgatttaagtatatatcgatataaggagtatatattgttaatatctacagccgatcgagtagatttagttccttcttatttattcatgaccgccgattgatacatatatgacatcggctcaaagataaatgatatgtcatcggcactcagctgatcggctatcgtttctaggtttaaccgcggtttctttgtctttgtttcttgttgattataggatcaaatcaactggcacgcttgcatacccgaaggtgagttttggacctgcactggagttaagcagatatcccaggcctcgtgttttacgtcaacacttctcaaggaggaatatgttacttacaagggtaatgaggggccgggcccttcataacctacaccttttaagatataaaccttataggcttgtacactcttctctgcgaagaacataagccctaaggatagatggggactcaggatcctaggccaagttgggctcctggtcccttcctacttgtaatcttaagatgggagccccctgtcccaagtcaacttgagctctcgggcttccttcatgaggcgggggcgtcggggcctgtctcgaaagtgggtcccatgcccgctatcgttaacgtgcacttaacttaatggtggtttaaatatggtttgttattttagttaacaaggaatatgtgttaagttcccgggaaagggtaccccaattcccgtttcaccaataactgtagaactgatctttcgtcatggtacctaaaaacacatactccgtatttctcagatccactaccaaccggcactaaatattatttttagtaccggttggttttaccaaccggtattggtattaaagattaacactttcgtatcggttgttgtcaccaaccggtgctaaagcttgtcacctttttatatgccttattcttcctccagcccaagccattgctgtcaagaggaggaggaagagaggtcataccaaaattttttgctaaagtattttggtgatattacacaaataaaaaatatccaaaaggttagcaacttcatcctctatttcagtcaaaaaaaaaacttcatcctctattgatgtatggttaacatattacatttctagctatgttttcatacgtcattctctcaaaaacgtttacagaaaaagaggagacaataaatttgacgagaaaataagagcaataattttagagacattggatgaaaatgtaaaacaagaatatcaaaggataggaaatgaagggaaaaaaagaaaactaagtccatttaaaaacactaaaatagttagaaataagaagaatacattaaaagtatgtttataattttttaaaaagatttaaaaaataaaataaagataattcatgaaaaaattatttaaaattttttaaaacttgaaaaagtatgaagtccatttaaaactcattgaaatagttagaaataagaagaattcattaaaaatatgtttataattataaaaaagatagagcatgaaaaaatatacttacaattgcgttgttttaaattattaaatgattattatttatttattttcactttcgttgacttcctttaaatttcattgtttctgttaacaacggaattttgcatcagactcggagaagaagagaaaagatcgaggcagatttggttcggaatcgagttgaattcagagtcggactgcgcatcaactgcaattgtatcggctgaaaacagggcaggggcttgacttagccgatatggcaagtagccaatacaatattacttgggctcaatttgtgcctagattggactaactgtcattgccaattagagatagagcttgattaaggcaattgtatctattaattgggatatttaaatcggtttgtcagagatttggcaagagaccgccatgtgatcttgtttgtatctaatctttaggaaagtttgagtcgtgtccataatgtactaagtttgcactcggggtataaacatgtaaacagcctctccaaaagacatgcgtgcatgatcatcttcatcttcatcaagggaaggtaatatggaattttgaagatactactggttgatggcattaactgcatagatattcagccgtagctggatgaaccaccaagggcccccatgtttgacagataagcccattaacaatctagtcgatgtctggctcaaagtttaatagactgctcctagaagatattttcccaagggaatcggtttcttctcatgaatggcttgggctagatgctgaaggatggctgtgggaccacaagttgtgccgcagaatacaaatctctctaaccacaggttgagaaaggcgatgtgttcttgatctgtcactgggccagtacccatgttattggttgcatatcctaaccagccaccaccaaccttggtctttatcttatattcactcttgattttcaacctgatggggttggctgatgaagtgatatctaaaccagttagcatcttgatgtatagaacggttggtgtcattggcccttgaccaaatatgaaggagttcagagtatcagaccagaaataggtcgcaactgataacatggactcattttttggcatatcggctagggatagtgacagacacttagctattcccatctttttccacaaggattgcttagaagctgagattctcctgtaccattccttccattcatctaatttagatggccgagacccgaagactgtgggccaatgggctagttctggctttgtttctctaaaagggatcctattggtctcaacgttaatgaagtaagttgggtttgagtcacccattggaccaaggaaatagtgtgttgggtcatgcagaacaggaatcacaatttgccctctaagatgttgaatcaagagatttgaaagggcaaaccctaagtgacggaatgaagcaattggaaaacaaaggatgataaagaatgaagaatttacctcaggaacatcggaagtggtcgccattgcattttgcgcagaaccgcttgagaacggagggattcaccgccaagagccatgtcgccagagacagaggggatccttgaagtaggagcacttgtggaggacttagccggaaaaggagattttgaagcagtgggcactacttataagcttaacagtcagaacagaaaaccctaaaatttcgtgggtttgatgagagcaaattccactgcattatataatacatcggaattggggggcatgtgttaacaacggaattttgcatcagacttggagaagaaagagaaagatcgaggtggatttggtgtggaattgagttgaattcagagtcggactgtgcatcggctggcatcgtatcggctggaaacagggcaggggcttgacttagccgatatggcaagtagtcgatacaatatgacttgggctcggtttgggcctagattggaataaccgtcatagccaattagagataaagctcaattaaggcaattgtatctattaattaggatatttaagtttgtttgttagagatttggcaggagaccgccatgtagtcttgtttgtatcttatttttaggaaagtttgagttgtgtccataagagcaggtacaatagcagactattagctagctataaatatattttaatgagataaaagatgagagagaagagcagtgggctatagatctgtagccagctgcagcacggactccaagacgcaatgtgtgtatagcatgtgggaccatatattaatagtatagcaagcaactattgtatgaattggctattacattggctatagatgaattgaagttagtagtaggctatactattaaacttgctctaatggactaagtttgtactcgtgggtataaatataaaccccaaaccattgtaataatagagacaatccaatacaacttcagcgcatcgtcaccctttttgttcttcttttcgacgagttctcttgataagaggtaatccgtttcgatggcttgtgctattggggctattatgtcggtttagatgttttagtccttttatcataaccatctgctatcatatgctcaatttagctctatcggctggttcttgttttagggttcttgccggtatcggctaaattgtcttactagattagattaactaaggcatctaccatcttgaaaaatatttaattccttgattgtttatactttaggtttctttacctactttaagatgcatcacccctactcttgtctagaatcctaaaaactaacctagaattaattataattagagatagtattggagtttaaaccaatcttacctaatatacatgcttcttcattagttttatgtatatttgccacttatatagacatatcactccatataaatatatcaaatctagatcagtatcggccgggttgccaagcttggtagttgatcgttatttgatatatttctatggattaatttgtttatataagtttgtactagagtattagctagtacattatatttatttacctatcttactctaaataccgttccatcagctattttcatgatatcgtctaaaatctattttatcaaactaagcagatcatattacagccgatgcggcatatttagggttttatattctttgatctactcagtctatagccgatttggtctaactacatcggctgagaccatcaacgatacgtcatcggcctatcggctaactcgctttcttttttgttccttgctggtagcaggatcaaaccagctggcacgcccttagcgcactcgaggcaaccttggatctgcactggagttaagcagatctcccaagctgccgtgttttccgtcaacaatttcatatagatgaatcggtaatggatgtacaccgtggaccgatggtcgaaggagtttattgatggcatgcattatttttttagtgtggccaatgcccataagcctaagggttttatatattgcccatgtaaaaaatgcaaaaactagaaggagcactctacatcgagaccgcttcgtgtccacttgttggagtcaagattcatgcctagttataattattggacctcgcacggagagttaggggttgcaatgaaagaagatgaagaagaagacaacaatattccagactgggctcaatacgatggatttgcagaaaatccaacaggcgaggtggatggagctgttgcagaaaatgatggtgcagatgatctcgatcatatgttgtgtgatgtaaagaaatactgaaagtgaaaaggacgtctagaaattggagcgtatcttagcagaccacaaaacatccttgtacccaagttacgaacatgggcataaaaggttgggaaccacactgaaatatctttttgatgttaatgttcttgtatatgtttcttaacatggattttccaatggtttgtattagtttgtaagtctttcgattaggactttattgtaaagtctttgggataataagtagttggtttgtatatgcttttcaaatatcttgcattggttttatatttcataacatatgttgtgataacgtgcattgcgcgtccacgattactattaatatcaaaagcaggacaagccgattaaggttttgttaggatcttcatttgggatttggttaaccgtgagcatgcttcctaaactattaaccgatatattttactaaaatctttagtaaaatgtttcctaaaataaatctaacaaatttatttttcaaatttatagtaattaatacttaattaatcattcgttaattgtctactccgttgtctgcaccacttactaacccagtcaaaccatacttatgaatgcaacctaagggtgtgttcttttgtgcaggttcccaacttctttccaaggatcaaacccccctcccccaccctccctagggcccaaaacccccctcccacctcggtcaaagcatcctcctgctggtcaaacccgcccaccactttgctgttctcgtcttgcaggaatcatgcagtaataggacggtcatcgtgcagtaacatgacaactttctcacagtaacaacgtcaaaaaacagtcatgatggatatagttttgttaagcgtttttttatgaacgtcatggtgcaaacggattagaaaaacaagatatgatgtgagagatattgctctctaaagattgagatttatctctttttagtccttgtctcactggaacgtcgtagtaacgcaacggccaatgtgtagtaacacgactgctttctgcagtaatgacgttgaaaagtagttatgatagttctagtttcgttaagcatttttttttacgaacgccatgatgcaaataggttagaaaaataagacatgacgtatacgttactactctctaaagatttagatttaaaatattttagctttacaaactatagtatagtaccactgttactatgcatattcttcgagtaaagtataccggcggtccataaacttgcaggagtgtgtcatctaggtctttaaactctcaaaatgcatatccaagtcccaaaacatgtcatagtgtgtcatttaggtcccaattcaccataaccccttcaggatcctacttggcgttgatgtggtatgccacatggatatgacgtggtattattttgactgacaaatggaacccatttatttttttttcctttttttctctttttcctcttcattctcctttctatgtgaactgagcaaagaaaggaaaaaaaagaagaatgagaagaaaccggaaaagaaaaagaaaaataaaagaagaaaaaaagaaaaggacacgtcacgtccatgtggtatgccacatcagcgccacgcaggatcctagaggggatgtgtcgatttaggacctagatgatacactttgacaagttctgggatctggatatgtattttgagagtttagggacttatataacacaaccctacaagattaagattaaggactgccaatacactttactccatattcttctgttactacaaaattcgccatgttgttagtgccaaacaacctataaattttgcagtaacgtatcgtgttattatccttctattgtaatgttactgccaaatcatagtaaaaaggtatgattcttgcaataacataactaaataatttgttatcataaaatttggacattcatacaaagcaagcaaacaattatttttaatcacagtgtcataggaaaaattggctaggagagattgctatgaaacatgggatcatgggttcaaatcttgtttgtcattttaattattagttttctttccaaggtgcagcaaagggagagaagagaaaaaaaacaaaaaagaaaaacgaaaaaagagggatcgggagggagagaatagaaaaaaaaaagaaaaaagaaaaaagaaaagaaaaaaagaaaaaaaaagagggatcgggagaagggatcaggaggcggcggcgacgggaagaaaaatgaaaaaagagggggatcgggaggaggggaagggatcggcgacgggaagaaaaacgaaaaaaagagggatcgggaggaggcggcgatgggattgggcgcaagaaggaggagggaggcgcgtcgcgcgggatgggaaagggaggtgggttcgcttgggggagggggtgtagaa

SEQ ID NO: 5616 - DNA, 4989 bp, Oryza sativa
agcggagcagggtgagtccttcgctggctggagttcgtgaatcgcgctaaatttttgcatctcttgtgttcccctgttgaattgaatgaatgatccgatgttttattggttcatcgcctaaatccgtggttaaggattttgttttctggtctccctgataaattagcattttgccagagctgcatataatttataattgagatctctggaaactattttcttgatgtggtctgtctataaattttgcaagtcactaatgcattatttttgtcacaggcacaagattgggataacgaaagccccaagtcagatgagcaacatatgcagtgttccacaccaagtgaagatacgcaagaagaaaatggcagtgacggtgtcaacccaacctcatttactgatgctgggctacttcatctcattgagggatatttaagttttaatgtcttgagggttgcaaagggcttgaaaagctgactctaaactggtttttgcacatttctgaaaaggggctaggtgggaattgcaaatcattgccggaatctgcaatcgttagtgctttcggtaatttcttgttagttgtacttgttctgttttctttcgtgcattcaatattgtttcacatgtagcatgatctgctttcatttccaaggcgggaaaatctttcaaactatgaagaaattaatgcttccttatggtgaatggtgatcatagatgcctcttttattttaactattttttcgaatgaaacttgaggatcatattgtagcaatagtgagttccgttgtggtaatggtctcctttttgaggtttatcattgttcaagccagcagttcatgttgtaaactttgcattgaggtttcatttcatgctgatatttagtgttgtattcccccgagtttcattgtttattgacaacatttcttacaaggtggttatgttcaaaaccatgggttgattactctggcagagggttgcaatcttagtgaattaaagctgtgtggtgttcaagagttgacggacgaaggactggttgaatttgtaaagatacatagtaaattattggtctctcttgatatttctttctgcaatggttgcattacagacagatccctgtatgctattggaacctactgccataacttggaagtcctatccgtggagtccaagcatgttaatgaaaacaaaggaataatctctgttgcaaaggatgccaatatttggaatccttaaagatggtatggcttggtgtcggcgacgaagctttagaagctattggttcatcttgctctgcattagaaaatctgtcacttgacaaccttaataagtgctcagacaggtaataggtccaattattaaatctactgttgcatttttacagggatggaagtatcggtgtctcatttctcttagaaatttgatatagcttatactgatactgcattgtgatgcttatagacttgaagagtagaaatgctgaaccatttgttaacaattgttttatattttttttatattgatttgaacacatgctcttttcttaatttcagtagtgagccacctgagtataagttctaaataatatggttctggtaattgacatcgatggtgtatcttaaatattctgccaccgatagtgacaagttattgaattttagcaacatttctcatatcttcagtaatcaacagtacttcctccatttttttatgtggagttggttagtttaaaattgaactggtagaaaaaaaatctaatgcagtaagcacaatgattgatggaataaatgaacagatgtgccaattgcggtctctgaatgaatgtaatttacctctgaatgaatatttcatgtgttgtttctgctattaggttgaacaacggtttcttttttatgagtattattttcaacgtaatctggttattgatctaccaatggttcacatgtatggtgttggcttgggggtccagtctcctgcctgtgatgtgtgccaagatagactactgcagaatacagcttataaatactggactgccgacataattggacaatccgttgcttcccttaatgtaacttctggaagaagctggacctataacttatggatggcaagaagtggcagtgctcggaggaggctgccctggactcccaagtactgtgagcactacatgcccgttagatctggggtgattgttcatttctttttttttttctcaaatgccatatttcagtaacctgctatatactctttgattatttgaaaaagtgcaattgtctaactgattggtgtcatatgtatgcagtaatgcctttttacatttttgtgattggttaattattgtgttccatttgtttgcatcagtggcaatcaaaccagcactccatgttgtgtactcctacattggtttgattctgcaaaaatttgatttctaaatcatctatgtgatcctaatccatgtgaggattagaacaaaataattgattgctcctgaactgatcttcggaaatactgtaatattaggtgttatgtttgaaatgaccaaattcgtacatgttttttttttttttaagattttgtgggagtaagggtattacactatcagtagaattttccaaatttgctatggggctttcaatgaaagtagcgaaccactcccgtctgatatgagacttcctgattagggctaaatttatttattatcatgcacggaataataaatcttcctgattaggtttaaacttttgtacaaaatctataagtaacagaattgttctgattccaaacagtcctctggtttagagcatgatcagtgagttacaaaaacattatagaatacgtgagtactgacattgttttaagctcaagcacactccagatatggttgaaaactctgatcagtcatgtttgaattatatctcctctttatgcagataatttcaattgttatggtcctgttggtgtacaggttcagagtttttgttcctgagaatcatcttccattgtatgagcagcctattccaggcagctcgataaattaaattgtgtacttcatgaacaattaaaataactttattattattatttttaacaattcatatcatccatatataataataaatttgacaatatttgttactataaattctatctcattatatgcttggcaaaacatatcttattttggttatttgatttgtattactaaatatttccgtagcgttagcacgggtagattactagttatagtagtttaacttatataaattacgctacaaatttacatatctaaatttaagatcttaccaattagttgatcgcaaatgtctagatgtgcatgacaagtgaatcggaaacacatgcgatcatgtcttcgtcagtttgtccaactatcataacaactgaattaacctagcataggaccatacatcaatacacgacaaaaactaacacatcagatatattacaaattaacagataaattcacaatgttacaaaatttgtgctcatttggtgatggcgaattagcaatgatgtgccatgtattggtgttgcactcaacagaatacctgatcagacagacatcagtattcagtgaccgcgcgtcctcctcatccagtactcgagggcagctggcgcggccagcaagaagcagcggaaaccagccgcggaggcgcgcagcgcagaattgcgtcggcggctcggcgccggcgcgacacgcgccgatgcgggctgccatggattcacgcgatttcgccgtgagaagaagaggacgtgggcggcaggcggcggcaatctcgcgtttgttctgttcgcctttcacgcatcggccgatcggcgtatgtgttctgctcaccttccgtgcatgcgttctgtgacgactattgctacttcctccgtttcacaatgtaagtcattctaacatttcccacattcatattgatgttaatgaatctagacatatatatttatctagattcattaatatcaatataaatgtgagaaatgctagaatgacttacattatgaaacgaaggaagtattatttttcattgcccgctcggcgtatcaaccatttcaccatcaagatattttgaaagtgaatatagaatatgattcctatgaattatatttcaagaacatagcctacggatgtgtcatgtgtcgcaaccgtaagctatctttctaatctgctaaacggtttgtgtatttttttattaaaaaactgtggagtattaaagtttcttagaagaatcaaataaattcaatttttaagtgtgtcaaagctcatacttaattaatcacaccttacccactcgtctcgttttatgtgtaggtcgctttattccgtgtacaggtgttacacttgcacaagacgaaaatttagcagaggctgcaaaaagtttttttagataaaagtcacgagagcagatacaatagtaggctataagacagctataaatatattttaaagagataaaagaagagagagaaaagcagcgggctacagaactgtagccagctgtagcacggactccaaaatgtaatgtgtatgataggtgggaccagatattaatagtatagtaagtaactattgtataaattggctattacattggttatagatgattagaaactagtagtgggttgtattattaaacttgcactgtgtttacacccaaatttggcacctaggattaaaataggaaagattgccaaaatttgaaagtctaccggtttcctccaagtgggccggtctgaccgccgtgtgttggcggtcagaccgtcggttgagggccggtcagaccggcggtgtgtggccggtctaaccggcaggtccgagtccgactgcgtttcgtcgggtttcgaggtttctttgctcgggaaggcatgtttcgggtttcctttagtttctaccccgagttggacatggaggagggcctgtagaaggcaagaccaacccctatataagggacatggccgattcattgtaaaaaa

SEQ ID NO: 5617 - DNA, 2281 bp, Oryza sativa
atccaagacggaggtggagccatctaatgtgatacctatcacattggatgatttcgaaggggaagaccgcaagtccatggaggagtacatcaaggagatcacacaggaggcgctgatgagagcatgctctaggactcgtcaaggcgtgatcatcaagcgcaggccacgtcctaagctcgcttctgatttggtaagcaatgaagaggtaacacaatctatccaacagcaagtagcatctacaatagattcatctatgactgtttttaaagataagttggatgcaacttttgagggtaaatttgatgagtttttaagatttaaattcggccctcttatggccgattacatgtcaaaagataaagcctctaccactgctaaccaagctcctatagatcaagggtttgttggaaccatgccaccctaattttgcaaaatttaagatatgccacccgtatctcaatgacatgtacgacccacatgagtcaatgacatgtgggtcagggtggcatatcacaaattttgcaaaatttgtgtggcatggttcaaattttcccatagattagatgggttcgagtagcgggaccaatggagcggcgcatgcggccggtccgaccgggcctgatggctggtcagaccgcgacttcgccttcggtccaaccggccaagcggccggtccgaccgggtattatcccggcggtcagaccgggactcaggccggtctgaccgcgcctctggatgtcggtcagaccgggccctggaccggtcagaccggcgcaattataccgatacaggggatagatccaatgactaatgctagttatttgtatcatcttagaacatttgatgctcctgtatctactgctgcaaatagtccccaagttcccccacatgttcctaatgcttataatgatgttgctagggggtatcctcccgatactaggcaaggccaatataatcatattgcgccacaaacacaacctattaggccaccaaatccactgccaaatcaacataggcctgataatatgaaggaaataattagtgagattattagggataaattcgggattgaaactaggaatcgtgccagggtttacaaaaagctgtatcctgactattatgataatgtgccgtttccccgtaattatagagttcccgaatttaccaagtttagtggtgaagatggtagtaccacatgggagcatgtaggtcaatttttagcgcaatgtggtgaggctaatagtgatacttttaaattacgcttgttttctttatctttatccggtaccgcttttacatggtttacttttttaccggcaaattctattcatacttgggctcaattagaggtgagatttcatgattatttttatactggagaaactaagcttaggttatgtgatttaacatcggttaagcaaaaatataatgagcctgtcattgattatattaagagatttagggatgttagaaaccgatgttatagcttgaatataactgatagagatttggctggtcttgcttttaatgatttaattgctccacttagagaaagactagatggccagcaatttcttgatgttagtcaacttatgcaaagggctctggctaaagaaagccgggttaaggataataaaaaaattgttagaccatatgagaaaaagcctaatgttaatgtggttaattaccctgaggctagtgatagtgaagatgagggtgatcatgatatgtatgttgctgaatggtcatggactaacaaaaacaagccttttgtttgttctaatctaatgccgtctcctcataaagatcggcaaagtgaggttaaatatagttttgatgtggccaagtgtgataaaatctttgattatcttttacaagaaaaacaaattagattacctaaaggccatgtcataccatctcaagaagaattgaaacgtcgagcttattgtaaatggcatgattctcattctcattctactaatgattgcaatgtgtttcgacgacaggttcaatcgcccatagatgaaggacgatttgaagttcactgatggcttcaagatgaagcttgatcatgatccttttccggtgaatacaattaatttcaatgataagaaggtgttgattcggccggagcaagccaaatctactaagagaaaaggagtggtcattggcgaaccaagacctaagatgatagtgccaaagaagccggaggttggcgtttggaaggagaataagagtgaagtttcaacttttaaagcccctaggaagaccaaagtgactt

SEQ ID NO: 5618 - DNA, 908 bp, Oryza sativa
atgtaaagccagctagtgtagcacggctaagccatataaatttgtataatgagtaaagaggctaatttagagtggttacaaaagagggtgcaagaatatcggtctacaaagaacgatattggtgaaactattgaagattttgatgaagtggagaagcttggacaagggtttacatcggccgatccattggaggaagtagacataggtgatggaatcaaaccaaggccgacttttgtaaacaaaaatatgagagcagattataaggttaagataatagagatacttaaagagtatgttgattgttttgcatgggagtataatgagatgccgggtcttagccgtgagcttgttgagcatcggcttccaattaaaccgggttttaggccttataaacaaccacctcgtcgttttaatcatttgctatatgaccgagtcaaagaggagattgatcggttgttgaaggcggggtttattaggccatgtcgttatgcggagtgggtttctagcatagtcccggtggagaagaaggggagtggtaagattagagtttgcatagattttagagatttaaataaagccactcccaaagatgaatatcctatgcctatagccgacatgatgatcaatgatgcttcgggtcataaggtgattagctttttagatggtaatgccggctacaatcaaatctttatggcgaaggaagatatgtacaaaacggcttttaggtgcccgggatttgttggtttgtttgagtgggttgtcatgacttttggattgaagaatgccggtacaacatatcaaagggcaatgaatttgatctttcatgatttgctaggtattatcttagagatctacattgatgatattgttgtcaaatcggatggtatggaaggacgcatagccgattt

SEQ ID NO: 5619 - DNA, 9478 bp, Oryza sativa
aaaaggaggccgattttacttggggggcaaaacaacaagatgcgtttgaggagttgaaaaagtatttgtctactccacccgttgtgcgggcgcctaaaaccggaaaaccttttcgggtatattttgcctccgaagacaaagtcattggtgccgttttgacgcaagaggaagatggcaaggaatatatcattacatatttgagccgccgtcttttggatgccgagacgaggtatgtctttatagagatactttgtttgtgcttatagtatgcttgtaccaaattgaagcattatttgttatctattacatgcatagttgcttgtcaaactgatgttattaaacacatgttgcaaaggccaattctaagtgggagaattggcaagtgggcgtatgttttgatagaatatgatttggcttatgaaccattgaaatctatgaaaggccaaatcatatgtgattttatagtggaccatcatgtatatattgcttatgaggaagagatttgcctagttgaagttataccttggaggatttattttgatggttcttcttacaaagaaggtctaaggcataggggtagttttgttttcacttaatggcgtgtgttatgaagcatcggttcgtttggaatattattgtacaaataatcaagccgaatacaatgctttgttattcggcttacaagtcatggagatggttggagctaagtacgtggaagcttttggtgattcggaattggtggtgcaacaagtcgccggagtttacaaatacttggatggatcactaaataggtaccttaattcatgtttggatattattgccaattttgataattttgctattagacatattgctaggcatgataattctagagcaaatgacttggcacaacaagcatctggttataatgtgaagaaaggattatttctgatattagaagagccggtgcttgattttaaatctttgtgcgaaattggcaaaactggagaccaggagcggtctgaccggcattgcacggccggtctgaccggtgaccaggggcggtctgaccggccacatgccgtcggtcagaccggcgaccccgagcggtctgatcagttctgggcagagcgctggggggcacttttcaatcaatttaaaggccgaattaattgtgaattcggacatttgtgcccaagaaacagaagaagattggaagattcctttgattcgatatttgaaagatcccacgcttaaggttgatcggaaaattcggcggcaagcattcaagtacacattgcttgatgaagatttatatcgctgaaatatagatggtgtcttgttaaagtgcttagatgaagatcaatctaaagtggctatgagagaggtacatgaaggaatttgtgggactcatcaatcggcccacaagatgaattggttgcttaggagagcggggttttattggccgacgattattgatgattgcttcaaatattatagaggatgtgaagcttgtcaacggttcggcaatgttcaattggcgcccgccgccgtgttgaatcctataatcaaaccatggccgttccgaggttgggctttagatttcattggtcaaatttatcttccgtcatcaaaggggcatagattcgtgctagttgctacggattacttcaccaagtgggccgaagctgtgccgttgaagaatatgactcatacggaggtaattgactttattttgaagcatattatccatagattcgatattccacaaacattaactacggatcaatgtgcttcttttatatctaaggaagtgaagaattttgccgaatcttatggtattaaattgttgagttcttctccttactacgctcaggctaatggacaagccgagtcgagtaataagacattgttgaaattagtgaaaaagaagattgaggaacacccaaagaggtggcatgaagtgctttccgaagcattgtgggcgcataggatatctaaacatggtgccactaaattcactccttttgagttggtttatggtcaagaagccgttttaccggttgaggtaaatcttggttctcttcgttacatcaggcaagatgatttgtcaagtgaagattacaagacattgatgggagacaaccttgatgaagtcatcgacaagcgcttgaaggctttggaagaaatagaaaaagaaaagaagagggtggccaaggcgtacaacaagatggtgaaagcaaagttgtttcaagttggagacttggtttggaagacaattttgcctttgggtactcgatccagggagttcggtaagtggtcacctagttgggagggtccttatcgagtatgcggcattgttcaaggaaatgcatatttcttggagacacttcaaggggagcgttttcagcgagcaatcaatgggaaatacttgaagaaatacttcccgagtgtgtggcaagacgcttaggaggtactatggccggtaattggattatagtcctaagaccaaaacatgttctatgcttttagattcacgttgttcatcaaaaaggcaggggggcatgtgtttacacccaaatttggcacctaggattaaaataggaaagattgccaaaatttggaagtctaccggtttcctccgagtgggccggtctgaccgccgtgtgttgggcggtcagaccgtcggttgagggccggtcagaccgtcggttgagggccggtcagaccgacggtgtgtggccggtctgaccggcaggtccgagtccgactgcgtttcgtcgggtttcatggtttccttgctcgggaaggcatgtttcgggtttcctttagtttctaccccgagttggatgtggaggagggcctgtagaggacaagaccaacccctatataagggacatggctggttcattgtaaaaaaccaatctacaatcaatcaatcaaatcgtttttcatattgctttcagttttctcttagtttgtccatctttgtcggtttgcaccgtaaactgtccgccgccgttgcgagagtgcgacatttctttgtaggtttgtcctgaaaaccttccgttttgcccacgaaacgagaagttatcttaaatcggctccactagccggtttatttgtcaaaacccatctagatttagctctttgctagatcgaggtggttggcgactctaggatcaccgcaaggcataaggtgctgcaatcgttgttgtcaacttgtcacaaaaaattgccaacacactgatgccctgctttatagagaaaacgaacggtctgctggggtagagcaagctttaccgagtttagctcagacttaaggctgcagaaagggtaagaagagggagaagagcgttgattgcaatcctacgtagaaggaagccagggagggagtccatggcatggagtaatcggacaaggaggcgaatgcccctgcagttcccatgatgatttctcatggcagcccgtccgactgcgagggcggggaatgagtggctaaggcccttcacagtgcaacaccgtggatcggtgctatgatgcaccacgtcggaatcgagcttgcgtggcgctaggttccgcgcctcagaagagacactcgctcccacggagagaagcgctatagagcgcgttgccccgcgcccccgcccgctcgtgacctcgcgccacccgtggaagtgttttccccaaattcgcccaccaaattcgcggcaacaaatcaaggaacacgcccaccaaaatagtggcaacaaatcaaggaacacaaatcgcggcaacaaaatcaccgcttgccgctcggccccgaggagatttggaaaaatcgctaacatcgcggcaacacaaatcaaggtcgacgccaagctccgccgctcatccctgatgccgccgccgctgccgctcatccccgaggccgctgcgctcctctgcatcgatgcgccgacggatggggaggagggagaaacggcgcggcggctggggagcttgttaactcgccgcccagggatgagaggggagaggcggcgtcgtcgagccggcgccggcggagggaggaggggcgctggcggaggggcaatgggagagctggtggagttgggggaggtgagggcgtcgcaatctctcatgccactgagcctcgccttcgctcgattgggggaggggaaaaaacgctcgaaggcggcgcaaaggagcgatgcggcgtggctgagctgaggagcgattcggcgggcggagaaggcgcggttgtgcggatagagatggcgagtcgcgagagatggcaagaagcctcgagaagtaaaaaaaaaaagaagaaaaggagatgcgggtgtagttgaggaaagtttagggtaatttatttctttctgctgtttggtacactcaatcaaggatacaccactgtgggctaaaattttttgggctctatttgaggtcacgtgcactcgtgcagtgtggaggttgtttctttcaacggtgctaggcctagctggcgtacggggtaactcaatatcgggtgcctgcactgctatcgccctaaacgatctccctctccagagcacgattggcgtggtgtcgcgatggattcccctgtgattatggatccgcagctgctgatggctgcacgatctggtgcgtgcaaggcgcttgagaatcttctcgtcaaccatgaggaggcggctgctgaatcccatctcgtcatccgcatgccggaggagggagcttcaaatactagtagtactagtagtgatctagctcaacaaggtcaacctgcaaatcgtccagcagcagcgtcgcctctcctggaagggttgactcttgattcggaccaggattcggccctccatgtggtggccacctccggcgacggcgagcagtacgtgcagtgcgcggagatgatccacggcagggcgaggcacctgctaggcgcgaccaacaacagaggcgacacgcctctgcactgcgccgccagagccgggcaccatgccatggtctgccgtctcatctcgttggccgcgcacgagggcggcgccgccaacggacggatcctgagcaccaggaacaagctcggggagacggcgctacacggcgcgatccgcggcggcaacaggatggtggtggagaggctcgtgtcggaggatccggagctggccaggattccggaggatcgtggcatcggcgcctcgccgctgtacctcgccgtttcgctggggcgcttggagattgcacgggacctgcttgatagaagtcctacaacattgtcatactctgggcctgaaggccaaaacgtgctgcatatctcggtataccgcggcgaaggtatgtatggccaactccttgtttattttccattcataatatattccggccattgaaactctgcaatcaatcctgttatgtgccgcactgagacccattgagactacaggatttctcaagatacctttggttctccttggacatctgtaccaagtaaaacatccaaagtaaccagccataagaagaatgtgcaaacgaaacaaaaaaaaacacaagtaaattaatactagctagtatcatagtctctcaagacagtgaaagaaatgctgcctaatatcaaagagtatacttttttagagtattcaaagtatgcacagcatttataaagtactcctaaaagggttttacacatacgagtagtctggccataagagatggatacataatatttgtttatggcattacaaaatttgaatttggaattcaaatatcattaattgctagctctggcactaatatcacttccttcttttataaagtgctggtaattcaaaaactagtggtgatgccagttatgtactggcgttgattgggtattactattatgagccttattttccctttggacttgcttaaccgacgacaccgaattgcagcgctgtctatactgttagacaagtgcaaggatgttaaggtcaacattgatcagggaggccggtataggagtatgcctgttctcttacaccttactagtcaaggcgacaaaaatgggagcactccgcttcacttcgctgcatcgctgaaaactagtaccacaggtttgtcaagatggtctgaatatttccatccgaaaccaagtccaaccacgctgctgcttgatgccaatgaatctgctatgtaccaaccggataacggaggatcatatcctatacatgttgctgcctccaatgggacgctcaaggctgtcataaccttgctcggaaggtcccctggctgcatcgcattgcggaacatgcaaggaaagactttcctccacgttgctgtggagaagaagaggcatagtattgttgcatttgtgtgcaaaaggcccgaacttgcatctgtgttaaatgtgcaggacaaccagggggataccgcgctgcaccttgctgtcaaagctggacttgtctcaattttcaacctcttgtttcggaatagggaggtgagcttgaatttaccaaacaaagacgggctgacacctcgtgatctttcatggattatgattcctgcaagattctactataaaaaggtagtaatcgttttttttttctggcttttgtgtcaatttatcctagctacatatatgaagttgtctgattctgtccccactatatacgatacgttaacctgcagaattcacgaggtatgatacaccaatcattagcacttgccagagctccagttggtcacagtcgccaggaccacttctatgagaagcattcaaagaggagggatgaagaaatcgattcagagtacttgacgaacgcaacttcagttctcggcatttcatctgttctgattgcaacggtgacatttgcagcagctttcacgttacctgggggatacagagcagacgaccacgcgaacggcgggacaccgacgcttgctgggagctactccttcaacgcattcatcaccgcaaacacgctagcattcagttgctctctgctagctaccgtcagcctgctctactctgggatgccgtcgcgggagatctccatccgctacgtataccagtccctatcgttggtcatgatgcggagctcagctacaagcctggtcgccgccttcgccttgggcatgtacgtcgtgctagctcccgttgctctcaccatggcaaagtctgtctgcgccatcacttttctctccttcttgtctgcatgtatggaggtccggaggccccttatcgtggcaaactcggtgcgtattagagttggaatctgggcagcgaggtatcaagcagcgccagtcctaaaattcatcgggaaaagattctggtcctatgtaattatctttggcttgccggcggtgttgaagattcgtggaacccaatgactttgtgtaattatcttatctgctaataagattatctttcgccgggctctgcctctgttaatgagactagatgagataaaggcatttttgcaaaatagaagcatatgcaagatacaatatgtccaaaacattgtattcacatgttaaacaaaatatataatgggctgagggaaaaagttgcagcaatcatcaacgtaagctatcaaagacttctcctacgaccaatacatttgctttcaaatttgccgacagcagataatgccatatgtgaagctggcattggacagttagataggaacaccatagttcacaatcatcaagagggtgttagtatatcttcttctttacctgagaagctaggccagatatctgcaatagaaaaataaccttgctataaattaacattacagaactccaatcttcaaaatactatcttatcttaatgtaaaaattggtttatgataaaataatgtaatgctgcaattatgagatacgaagccgtgaaaaataatttctgcacactaattataatatcgttgccgacaatgactgaataaaacttatataccctttcctatcgaaaaaaaaatagccaacagatatgcatatggggaaaaacaaattgcagtgacaggttcaacatcacctaattgtttcagtaaacatcatagtgttcagaattcagataccagaaaatatgctgacccctgatcaaaacccagatacatgggaatctgatcgagaatgctcgtgagacctgataggattcaggcacacatctaatatatgacaaattcaagatgaggcaatttccattctcaaattccatttggcatagaaaaaggcaataacgcaagatactattacacaactactgatttcttttcagtatcacctatttgtttcagctcacttcgaatggcattcccttcttccctgaagcaagtagacagtaagtccaacattgtattagagaagggaagaccaaaataaatggtaaaaggcttttaaaaataggattgcctgagtgtattccaacctttctgaaatagttttacagcagttgcagatctatcctggaatgcatatgcgataaattggacatgaagaatatctgaacttaaaattgccctgataacagatggtttaaagaaatatatcagcaacttttggctttcattctaaagaaaatcaaccctgcattttgttttttctatgaatgaaggtagcatgcatgaacttcatgaaattctttttttatgctagtttaggacgaatttgcgtttcactctgtttcagaacaaagaattacatcacaacatgtccatgacagtaataataagcactaaagcattatgtccaatagggtgtgaactgcgaagctagtcagcgagtaataaggaggtgacagtctgtaaacaggatggtgtatacaactttcgagacatggaggtaggcaggtagcaagtagcaatgtcaagaattcataaaaaaattatagctagacagacagtccatgcttacctccttgcttacaaatatgcgcgccctgcaacgaatttagtcatactaaagttagtgatatataagaaaaggtccagcattttaatttcttgaacaatcatagatcaaacttccattgcatcaacatccttctcacatcagatgctaggcagctagatatacagtgtacaggccaataatttggaactgaacatcacactcttatagaattaatgaaatccaattatcaaaataatatgatgattataataaaaacaggttgaactgaatctgctcgtgatgtctaagttggatctaattaattagctcaaggagatatcaatatattccaatcaactgtaagtagcatgataagaaatcaattccagtaccatgttgttgttacggaaaatatcaaggaaaccaacctgtgttatataaaagtattccgtgtatttttaacatatggtactggcagctacctcttcatgtcatgcaaagcgtatcatatctaaagcatttcgaaagcacgtattcttttgtgaatgtaataaacaagaagcaatccagcaagttaaagcatcaagtgtggatacaacagaagataaattgtagtccaaagcataattaatcctgcatatatgagacaaca

SEQ ID NO: 5620 - DNA, 8073 bp, Oryza sativa
  unsure (1)..(8073): unsure at all n locations
gaaggacggtcaatggtgcagccagcggttatggtgtcacgccagagtattcgtcatcaggctcaggcgcgggaggaaggatcaaatcaagtgggccatcagctaccgctcggcccagacgggagaggcgtgacaacccgcacgtgaaggggaaggattgggtccagtagcttcgggcaaggtctataaatagattacccttgtactgaaatagttgaactgtattgaacaaacatattctgaataccaatcctttccccctctccaagtctgtattcttctctgttccttctaaattccagattctatctctaattcttcttgctgagatctcgggtcgtaacatcttagtatcagagctcgtttccatcctggagaagccaaggttccaaacgcggctacagcttcaagtcgatgccatggagaaacaagcgggaggattcgagaagatgcttgagggaatccagaacgccatcggcgccgttgcggtgaagcaggatgaaacacaagcggtggtgctccagatggataaagcgatggctagctggcgacctcaagtggatgcagcagtcaagggacttcaatctgagatgggtgagctgaagaaacaagtggagattctggagaagcttcgtggcgagttgggcaattcgtcgaacatgttgcaggtaggtgccatctccacgcggaagcaaggcgacgacaacgatcaacgtccaccgctacttcccacgccggagtcgttcgttgcttcgacgtcggcgggagattctggctcaaatggccaccgcgttgcaatcaacaaccgggggaaggcaacaggagtgattattcctcctgtgccacctcctgtcacgggtacgactaattctccatttccccatcactttgcttgtgattcattgcatcgggatgaagttgggggttctgaggatcgaggctataatcaccggattccgaaattggattttccacagtttgatggggtagatccacaaaattggcgtatgagatgtgagcattactttggggtttatggtactcatccaatactttgggtcagggtggctaccatttactttacgggaagagcagcctcgtggttacgctcgtcgaaggctcatttgcggttttctgagtggtcggatttttgcttagcagtggataggaaatttgatcgagataggcatcagatgttgattcgtcagatagagcagattaagcaaaccgggacggtggaggagttttatgagcgttttgatgatgttatgaatcaattgcttgcttatgatcctatgtacaatcagctcatgattgtgcataggttcactgaagggttgcgttttgacattcgtcatgctgttatgatgcaacgtcctcgcgacctagagactactctggctattgcttgtttacaggaggaatggatggagactcagaagcccaaggaatttcgtaaattgggtgatcatgttccgcggattaaaggagcttatcctcttcctcttcctcctaccaaggtgtcggaatctagtgcaggggctagcaagtcttcatctgaacctgtcaagactactgctattgcggatagaatgcgagctctcaaggctcatcggcgagcccaaggtctctgttatatttgtgcagagaaatggtcaccatctcacaagtgttcaggttctgtgcaattgaatgctgttcaggaggtatttgctctactgcaacaaaatgacagtgattctggtaattcttcgggagaggatactgagcctcattctctgttctctttgtcagtccatgctattcagggtacaactactgctcaaactatgcgtttgcaagggattattcagggctatgatattctaattttagtagactctggtagttcctgcagtttcatcagttcttcagtgatgcctcagttgtcgaatctgatacagttacctgtttcttttcaagttaaggtggctaatggacaaatgttgtcttgtgaaactgaattggctaatgtttcttggtcagttcagggacatcatttttgttctgctttgaaggtgttaccacttcagagttatgatatgattttaggaatggattggttggagcggtatagccctatggatattgactggcagcagaaaacaattcggtttacattggatggtcagctgattactttatgtggggtggttccatcagtacctgctaatcctgtcttatcggtcctggaattacatcaattatatcagtccggttctattgaaggtctagttcagttatacacccttgattctgagtctagttctgatttgccaattccggacaatattcagcaattgttacagagctttgcggatgtgtttcaagaaccacaaggacttcctcctgttcgcgaatgtgatcacaccattccgttaattcctggtgcgcaaccagttaatgttcgcccttatcgttatacaccattgcagaaggatgaaattgaatgccaagttgttgatatgttggacagaggtatcatcaaaccctgctcaagtcctttctcttctctggttcttttggtcaaaaagaaagatggttcttggcggttttgcgttgattatcgccatcttaatgcgattactgtcaaaaacaaatatcctttgcctatcattgatgaactcttggatgaattagcgggtgcttgtcggttctctaaattggatttgcgttccggctatcatcaaatacgcatgcatccagatgatgagcataagactgcctttaagacgtatcatggggattttgagtttcgtgtgcttccttttgggttgactagcgctccagcaacatttcagagtattatgaactcagttctagctccatatctgcgtcgcagtgtattggtgtttgtcgatgacatccttgtttacagtcactctttggcagagcatgaagtgcatttgcgccaagttttgcagatcttatctgataatcacttgaaggttaagcaatcaaaatgttcttttcctcagccccagttggcttatttgggtcatgtgattagtgccaatggagtagctactgatgaggacaaaatcgtggctgttcggaattggattactcctacatcagtcaaagaattgcgcagttttcttgggttatcaggctattaccgcaagtttgtgcgcaattatgggattatttgtaaaccattgactaacttgttgaggaagggacagttgtttgtctggacatctgttcatgaggaggcttttgttactctgaaatctgccttgatctcagctcctgttttggccatgccagactttcagaaataatttgttgtcgaaacagatgcatctgacaaaggaattggtgctatcttaatgcagtcagatcaccctattgctttcctcagtaaagcattaggacctcgcactcaaggtctctctacttatgagaaggaaagtttggcaattattttggctatggagcattggagatcatatctgcaacatgctgaatttgtaatacggactgaccaccatagtttggccttcttagataatcaacgattgtccaccacttggcaacagaaagctcttaccaagttattggggttgcgttatcgcattgtctataaaaagggtttggaaaatggagctgctgatgcgttatctcgacaatctcctgttgatatggtggagatttcggcgctatctgtcagtattcctgcttggctgcaggaggtacctctgggatatgctactgattctgacactcagtggattcttacttctctgcttaataatggaaagcatcatgcacattatgaattgcaatctaatatcttgtattttaagaaaaggatttggattggtaacaataaatctttgcaacagcaaattctggccaatttgcatactgcaactgtgggtggacactctggtaatttggctacttatcatcgagtgaagcaactttttgcttggccaggtttaaggcaatctgtgcacaattttgttcaggcttgtgatgtttgtcaacgagctaagtctgagcatatcaagttacctgggctattacaacctttggaagtacctgatcatgcttagcaagtcatttcaatggatttcattgagggtttaccattatcagaccattgcaatgttattttggtcattgtggataaattttcgaagttgctcattttttggctcttcgacatccttacacagctttgtctgtagctcaactttttatggatcacatacattgcattcatggtctgccttgtgccatcatttctgaccgagatcgggtatttactaacactttgtggaaggagttatttttaagagctggcactcaattgcgaatgagttcttcttatcatccgcaaactgatggacaaacagagagggttaatcaatgtttagagacatttcttcgttgttttgtgcactcttgccccaaacagtggaagcattggttgggaatggctcagttttggtacaactcttcttaccattcaaccattgctatgactccttttgaagcattgtttggtcataaaccatcctatttcggattaactattactgccgttgatgctcctgtgagtttggcttcctagttgactgatcgcaataacatgagtgctttgattcatcatcatttgctgcgggctcagcaacgcatgaaacatcaagcagatttacatcgatcggagtgtgtctttacagtgggtgattgggtgttccttaagctccaaccatatgtgcagcaatctgtcatgaccagggccaatcggaaattatctttcaaattttatggaccttttcaagtcttgcaacgagtgggcagtgtggcttataagttggatttgccgtctacaagtatgatccatcctgttgtgcatgtctctcaattgaagaaggcattggcaccagctgaacaagttcaggcttctcttcccacactagattctgaaattggtccgttagctgttcatcatcgtattttggaacgccaccttcgtcaacggggtgccaaactaattgaacaagttcaggttgaatggaagggtacttcttctccagctattacatgggagaatcttgaggaacttcgtcacaagtttccagctgcaccagcttggggtcaagctggttctcaaggagggaggaatgtcacaccagagtattcgtcatcaggctcaggcgcgggaggaaggatcaaatcaagtgggccgtcggctaccgctcggcccagacgggagaggcgtgacaacccgcacgtgaaggggaaggattgggtccagtagcttcgggcaaggtctataaatagattacccttgtactgaaagaggtgaactgtattgaacaaacatattctaaataccaatcctttccccctctccaagtctgtatctgctctgttcttctttgttccttctaaattccagattctatctctaattcttcttgctgagatctcgagtcgtaacatatggctcgctgggacgaggccgggccaacaggacgctgctgctccctggtctgacgggcgctaggagctaggctgttctcaaatcgacggaggaggaggatgaggagctacgggctggttgtagcaacagcctttcctacattactcagctcacatttggagcgatttggtttcatgccgtaacatttggccacttatagttatatcctaccttaattcttttcttctgtcgtcttctgatcaagggaggaggaggcgcacctgctgcggtcgtcaatctagcggaggagggcggaggtgaggaggggaaggaggaagagggtgggaggaggcggtggtggtggcggcagcgaggggcggtggtggcgcacggcagcggggaggccggaaggtggcggcggggggagagtggaagtcggcgtcgcggggagggtagacggcggcggagacagtctatccacgggtggggcggatcaagatagtctgccttcacggggtgactgcaccaagccatccaagtatccgacggctatcgcatgatgcgtatccttaaacagttaagggtgtgtttgattgctcgtatccctctagcctggctcatgggtgtgtttgattgctcgtatccctctagtctggctcatctccctcatccaggctaagtttagcttggtttaggggatacacatgcaggcgtttggttgcttggatgagatgaacctggatatgatgagatgttgtttggttggttgcagcatggggcggatggaatggtagcatgcagaagatgttgtttggttggatagatacatcttgtgtgtaaatacctattcttgtgggtggtgaggttacccataaagtttgtgaaacgagattttttttccaagtccctaatctatttatgtgtgataaatttaatccgtcgtagaggttatagattaaattatgttactctgggtgtgtgcccacctactaatattcctaagctcattcctaaccaatagaaccagcccaccaaaccccacgcagcgtcctcgttgtcgctatagccgccgccgtccacagcggggactcgtccgtcaggatgcgccaccaccagcagccgggaacggacgacgaccccgtgaaggcagacgatcttcctgctaggattggatgcagcaattggaaacaattcagcatgcttgctgtctgtgaaacttgaaaaatatggatgcaccaagatcgagtagtagcagggggtggctagctcgcgcgcacgcgcgaggacgttaagtcgcgtgcacgtggaccttcgctttaagtagcgcttagcgtttttctcgaaagaaaacaacaacgtctgactagtgattaacgaaaatgctacagtaatttatcaataaaaaaataaaaacaattgattttgaaattttgagttaaaattttcaaatattgacttgaaaattttgaaaatacgatttgaaagttttcaaaatatcaacttgaaagttttcaaatatgagttaaaaagtttttgaattttgagttgaaagttttcgattttaatatgaaaagttttcaattttgagttgaaaatttttaaaatttgagttgaaagtttttagatcttgagttgaaagtttcaaacctgagtcgaaagttttcaaatctgagtcaaaagttttcaaatcttgagtcgtaagtttttaaatcggagttgaaagttttcaaatatgagttgaaagttttcaaaatttgacttcaaagtttaaatcttaagtcaaaagttttcaaatgtaacttaaaaattttctatctattagtaaaaaaatctcaaaaaagaaaaaaatctttcattaattattatcattatccttaaacagttacttacattaaacgtgcgctatgaaaaaaaatctcgattagcgctggcagcaccgcgcgtacgggccgtgtgggccggaagtgctcgcccgcggcgcgtacgcgcgaattaggaatcctggtagtagcataacacgattatagttacaccaagcatcaagcaaagctttgcgttctgattcgaccatgtagcaagtaacgcattacgtatgcattcagggcctgtttagactctccaaaatgacaaaagttttcctttttagaccactgtttgggtaaaatggatctaaacacctagttgtaaaattgcaatgccaaatcttttacaaaaaaatttgccgcagcaaattgatctaaacaggccctcaatcaggttttctgcggaatcacaacgagaagaccttgtcatgcttgcctccgactgctactacgctgccgccgctataaacttgtcctcaatggaagatccgctggcggagattgaacacgacgtccagcccggctctcggagcggccaatggtggcgtgtgccactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5621 - DNA, 19209 bp, Oryza sativa
  unsure (1)..(19209): unsure at all n locations
tttatcaaacctgnacctattgtggaaaatgttcgtgttgtcgaagttggtgacgaatttctatacagagtttagctagcccttgttggtctccaccgtccataccaggaaggaatcgataccgccgatcataatggagtgcttgttgctataagcatcgttgcttctggaggttatcctgatagattgtcaagttcaggtgaactaatatacactggttctggaggacagcctactggtaagaagaaaagtgaggatcaaaagctagagaggggaaatcttgccttgaagaattgcatcaagacaaagacacctgtccgagtgatccatggattcaaaggtcaaaatggcaaggatgacagttattcaagggctaaacaaatctcagcatttacttatgacgggttgtatcatgtggtggattactggagagaaggtctaaaaggttctatggtcttcaaatacagactacaaagaattcatgcttatagatgaggtcgatcgtctaaatcttttctagtttgcttattgttaagtcttaacaaatgattcagacggtaaatggtagaatgatattcttttctacaccatggatgcttacgccaatctaaactctcttgcttgttaggtacagaatcaagatgtattttttgtcctgggtggtataattagcttagaaggacgagaagtggcatgggcctggttgaaggtatgttatagttgtggggtaatctaaaggggacattttactgtacccctacttgttatggtagtagtgtagttggaagcagatcttagtcctttacttcgttataaggtggaggggcaatttagtctgttccgattatcccaatcgaagcaaaacaagccttgttggtttgttagatcagcccaagcctcattctacctctcgacgcacgatggccacgccacagcgcgtccatatttttatgcatttttcagagatacctttgggataacaaccatgtaatgttagatacatttgtaaaaaaaagaagtgcatgcattggaatataaccgtttcttgccttgtgcaaaagttaccactttttcctgcagtgtgattggatcatagaatgtgacacattcaaaatgcaccagttttgtttgtagcagtattcagatcaatcatggatcgctgatacgtgagatcaagcaaatagacaagatgccagtaacaagaacatgatatggattggattgtcaatcaccacaacccctgaattcagctgtgcaccacagctgccgtgggttagcccgtataagagtgtgcccaaataacaacagcaagccaatacaactaattttggtaaataacctaatcaaataactataggcctaaaacaggtccacccacactcccacaggatgtcaggattatcatgtgttttagcaatttatcttccagggactgaattggcacaaaactgaacaagaacaaaacatataggatgtgagaattaacatgtgttctgtacttcatttttcaaggacagaacaagtgcaataataaataagaacaccattttttcttctagcttgatgactgataattctcaaaggcaatgcatttttatcttcatgatgataaaccaactgtttcatttgaaaagtgacaaataaattgctttcagcttcatgaactcttctggtcttcctccatatcaccttcaccatacattaaataaaattagagtggacaaactgctaatccaaaagtactgtatatacaagatcctcaaggtcaagtcacactcctgaaagtaaaaatcatttctgttaacaagatgcagtaaaatcatggcaacatcctgaagaaaacttggctagctgatagaagtcattgaacaaaatgtatttcaaaatatattccatcactgatttcaatttcagcagcccaatatttttactaactatttaactgcaggaaagcgtactataaaccactgaaaaaggaaagcattatatgatgacttatctgaattacagaatatgtggcgtagttgtccacttacaaatgaattcatcaactaattgatgaaaaatccatccaaaatacgaattaggacaaaattgaccagaattagcggacatcgaggacaaataataaaaaggaatgcatactctactctcaggagttaggatagttagataacctgctggctgttgtgctggtaacgttggcattttcaccttcatgtaggatcgaatagaaagaactaagccaaccaaagagagtgagtaaatggttagtatacctaaaaacccaaactttttgcggaattaaaagttactctcaaatcgatgtagatcggtctgaccgaagttgatccgccggtctaaccggtgtagatctcccagttggaccgccctgaaatcgcctctgtctcctgaagccgtcgccggtctgaccgccgtatacccgccagtttgaccgccgcgatgccaccggtctgaccgccggtgtctcgccggttagaccgccgaacctgagcaaacacaaatcaaagaattctcgaagtagatgacaactttattacttctctctgtgtttacaaagtgcaacaacagcactcctcacgaaaatcttggctaaattcgaaaccctaactcaactctcaactcaatgctcttaaaagcgataccgggaagcctcacgctccctctctatttatacatgaagtaggcagcctaaagccactaatcaaactcatactagaagtcctaatccacctaaccttcccgtacaagaaacaaactttacaaactccaatcataccaaatttggactccttcaaaattcaactccgtatcccatacgcacacaatatctccattgtatgccatatggaatcttcaccaaccatgtgtattgatctttagcctaagtattccacatgatatctgactgtccggacgtcatcttatctccaagtcgactcccgatccatcaccggcaatactctcctgaggcatcaagtcacctacacatgaatcaaacaaagaaaccatattccaataccaagctatctccaatttgactcattgttagcaaacaacagtattacatacgcatagtatccatctagaagccataaacaagaaacaatcacggatatccaaacaaacaacctgaaaccgaagccgacacagagtcggccggtcagaccgcgggctggctggtctgaccggcaaccactgcccggtctgaccggaccaactatccagcagcacctgtaaatccaatcatctccaaaaccactttgccaataatctccaaatatcaaaaccgataatcacagatgccaattgttcatcacagaataaagaatcaaaaacactttgattttacacttcacatgttaataaataagaataaatgtgaattccgtggagaattgcttgagtacagcgtatactgaatgaagtagggtacatgagtagctgaaaaacccccccccccctccccccctcttctcctcccacgcccattttctgtcgaagtaaatccaccagtggatgtactgtaacctccacaattctaagcacagaattatgccaccacgggtccaaaggtatgatgcaattttagaaatttaatgtggcgcagaatacaataggtctatccaaaatctgtatagaggagggctcataagcagatacatgttaggatagggaattacaatgtatgttgtcatcagaatgcatcagcatggtaactatattatctaccatccccaaagtagcaaacatttatagggatgataacacggatacagtctggatagttcaactttgtgtaatatcttggttagaatattctcaatctcactcttcgtagtgtggttttgaatccgattccctcaggtgaagtttcaattaatcagtcaataagagtagtatatttgattattggctttcacacacatcaaacaaatcaacaataatagagtggcacatcaaataaatcttgtagaagaacagaagattgagggcttcgaagtgttgtgagggcttcgaagttcaatcattccaccaaatgccaatacatattaagtgtccatatcaatatgaataaattatttagaatttacacatagctatgtcaaatcaaatttgttaaagttcatgatttgaatttgaaaaatacatggtatagctctgtgtaaatttcaaataattcactcatattatttaggagaagaacacacccttagctggtagatcctagctttgttccctccctgttcaccttataggatcgaacacaaaaaaaccaagcctaccagagagggatgaatggtacgaatatcaagaacaaaaacttttagcggaaacaaaagtttatcctctaacctgatgaagtccttggcatagccggtctaaccactgtatgcacaccggttagaccgctcatctacgttggttgtctcatgccagcaatagaagcagagtcagctccccctacctatgctattgcctcctcctcgacctccctgcatcatccccacctctcatcccacatgagcatcatcgttttttgtcaagccgagcagcatcgctacctccttgccgagccgaactatgtcgcccgccttctctcttggcctctccttatcaatgccactacctctctatcgagacaagctgctctactgcctataggtctagtcctgatctgcgtacctagtgatctcgagctcagaagattccaaactcaacgtcgtttggcttgacttcattgcattctttctagcaccacatcagttttgacctcgcccacctcctcccaaaactccatgggcagcaacaacagagagagagagaggcaaggagaactgatctttgtagtcagaacaccgtcgaggcaagtcttcgtcactagagaattgaagaaaagccaaggtagtggtggagaagagggcagggcaacgttgtcctagagacactaaaaatcccaagttcacctgtcttgtttaactagggaaggctggaaaggcatatattagagagtcaaaatagaaagtttattggagcacaagaatgagggaatcttttggcatggatggttaaatggagatttggatagccaaatttgatatctcttggagatgatgactgttatctcacttagaagatagtatatgcaatatgttagctctaggtgcaagtaattttattttattcattttaaactactctttttctttccttccctttttttatgcataagtcatcaacctctccttcagtaaaatatatttatctaaaatgttctacacctacaattacgttgataactagccattatgcaactaaaataggggcaactccttacatgtcaccaagcatgtatagttagtttttagtgccttgaaaggaatttatcaaaccatgagtggcaaatcaattgtgctcagaagcctcaataaacttctgctgatctgcactctaggaagctaatggttgatctgtatacttcctgcatttcatccacaacatctgtttggcatgtggtaattaagaaaaacaaataatccaattaggtgcaatcagcacaagtaccaataaaaagaccatatcaagagaacttcaacatccttttgtgctgcagatcacttggacaagatccattcttttcttttcccggtgacgatcaagatctgctgaaaaagctgaattaaaagaaaggcaatcaagcagcacaggaagtaataatttgacactactaagctgaataaagaaaggtaatcagcacacgaagtaataatttgacactattcatttttttcattcattcacacgctctgagcacattatcctcaatcctgctgcctttttcttctctctttcctctttttcatgttcagatctgcattctgatttgatgacatacgaaatgtgaatcttctgacatctagcatatggggtggaatggtaaaacagaatttgaggaaaatatggacgggcacacggcactacgtcaaactggttggcaacttgtgatcatctgaacaattgcaacaagagtacattgcaaaatcatggtctctgctgccattattccattattttgcaatgatctaaatatagacgacaagatgaacccgtatatgccatatccaggtgtgatataaaaggaatataaaaggaagctgtacacatttgctgatactgtactaaaataggcgttctgaattcacactgcacatcaatcagatccagatcaagaaagaccataaagaaaccaaattaaaactggatccttcagctttgcaggagtcagcgtgaccttgtattccttgtttgtttagatcaaacattatttcattaaattcgaattgttacaatactctctagagaaagttcacttgtaaactaattgatacatagcatttgtagaaaaatatgaccgtattgttggagccaaaccgcggaaaaagtagtacagttctcaggagactaataaatctaacttgagaagaagagaaacctcagcatatctcaattatcacatttgattcatgtcagcttgaaaactatgcagaacgagccgtagcttcagacccagtggactcatcaggcctgatgagcacaaaactttggttagtagttgattatatggagaaaaaaaaagcaatgaagaattagggataggtcaaattaaactgaagtcggatgagaaaattagcaagaaccataaagtaaaatcgcaaacaattgatatctaaaagaacatattgctttttttatgggccatcagtttgtttagtgcatctgctgttaaaggacaggaaggtttatagtgcatatgcacagctgcaaaaaattaatcagataaaattaccatccacccccaccaaaacccaaaaaatgctcaatccattgttgctgtgacaaatatattgtacctttgaaactccttcgccaacttccatcctagcaaaattgccaactgtaacttttgagccaacttcctttgacaaatcattcaggacgctctgaaaatgttgacatcaagaagcaaaaccattatgtaccatgaattcacaattcaaactagtactacataattaaaaaaaaggaaaaggttttatcagttcaccttgatgtttgtgctgtcattgacaacatatttttgctccaaaagcacaacttcttcaaaatactttcttagtcggccttccaccattttctccatggccatttgggattttccagagctttcagcctaaaaagtttcagagtagtgtgtcactaaatcttaaataacttgaatgcagttcagtcatattccagatggatgtagcccatgtgtctccagaagatgacaaaagatattgctatttaattcatggaaaaataaacataattggtatcataaacttctaatatacggattcacattgtgttccattgcatagctcatctctgaattctaacagcccagctgtcttgcttacataaacataaaacaatgtgacaggaatactaattgagaaaattctattgtgagtcaacagtttcctttcattttcttttagttataatgagttaggacttatcacaagatatgcatttttctctcaactataggtcattattgcctatgtatgtttttctgttaagataacatcagaacacttggtatggtatgaccttatgatacctgatatctctatgtaaagcacacgcccatttcttcaattgtaagctaatcatatagaattacagtgatgctaaatttttccggtgcaaaggaagtaacatttatcagaataacgtacctgagtccggagtatgtccctctcattttcaacagctgaagcagagaccagttcttttgataaaaacaacggctttgtcgcaacgatgtgcattgcaatagatttcccgactctctgaagagcatcaagaggagcattgctgtcttctgcctctagtgtgatcaagccagcaagacgacccaaaccttatttcagaaaaaaaagaaaaagcttattcattcagtgaacgagaaattgcaccatttaccatatatcaatacaacttcatacttctgaagaacataaaatatggattgctgttaggaatcaaattaataatgcgagcaagcttggccagctcagtgtaagaggcaagtatcactaaagtcgtattactatcaatggttttacaaatgagcttgcatcctactaaataaataaataaataagaagctaaaattcatcactggacaaccctaagagaatagattaactataatttagattaaggaaggtaatgtccagaaagtccaacaaatttagatttctgaacccactgccaccccaccccccggcacaaaaaaaaaaggaaaataaataaaggcaaggacaagtatgatccatgctcagtagtcactagaaaactttcatttggttatgtgcactcaaacttagccaagaagattggaaaacatgcatgctacattcttgataaaagccaaagggcagagatttgtgcatgtacctggctggggacatgtgtgcatataagagcaaacaacaccatgtgcagttgtggacataatgaaacctcttctgaatttgacattctccccaaccatggcagcaacttctgtgacagcactttggactgttgtctccccactaagtttaggatgatcaagattgacattaaggttctgcatgattgagagtttgagacacctttataatatctacttacacatggaaaaaaccaggaaaagaagataaacatatcatatgaagctaaccaaatcatatcatgggaacagcaacagacattactgtgtgcacaggataagaagctgtgccctctgtgcaaagggcacaggaagtgagagagagagagagatcctgggctcgcacatcaacgtggcttttctctgagagcatggctctagtggagggagatagtgcgcaacagttattctaagggggggctgtagaataagcctacccaaactaaatatctgataagcactaaaatcttcatgtagtttaaaaaagcaggatatatatacatatttacaatggctacaatatctacaatgtggttgttaatgctggtattgcaaacatgttcatttgtatcatgatcatctccacatagcatcctctgtaatactagagccaagtcacatttatcatggcatttccagtccactgccatgaagttcttgtgtcacatatgactaaatggttgagccattttaacttgtttccttttatatccaacataaacagtgtgctaaaaatcagctgtaggtagcaattcggtgccaggcggcagcttggcactgcgattagcactttggcggtgagctcggcagctgccccacctcaatagtcatcctcggtccaactcagactagttgtggcagcaagtatgcagtgaagagggcgactagtggcctaggcggctcagtacaggcgaggatataagtacctccccaccctagctgcccaacctaatccccaaattggagcacgtgcaacagcggctagggtttgggagaggcgatggcgattgaggtcgccatagacgttgccgccgccaccgtagttagatccactggcagctcgcctgctctgctgcgactcctactgctccgctgcgacttctactgctccatcgtccctctgttctccccgccaggcactcaccaccatctaccatctccacgccaccagccgcttggacatatgcaccagcacaccagcacagtgcacaattatggccaacactgaggaattgagcaagtaagccatgctctttggcctttgctgtgctacagtctattctctagtatctatatactgctctgttcttgtgtgctctgctactctactctacactatcagatattcttccacaatttgcttgtctttgctgtgtgggtgcggctggtggtggtggtaaattggtgttgcttgctgccttgatggaaagcttgtacttgcttgcttgctttgcttcttgctgcacctgctttctgtggtggactggattcgaaactgctttttcgcggctagtcgtgcgcaccctcccccgcgtcgcgcaaagaggagggcggcagacagccatgcttttccttttttttttccttttcctgtttctttccttttttttctgtttctttttcactttttcgggttttttttttcggtttgttatacaaactatgtatacacatatactaagtttgtatacatgtatattttttccttttttatacatacgtatataaactttgtatacgtatgtatacaaagtttgtatattttgtatacgttgtatacaaactttgtatacatgtatacatattttttatacatcaaaagtgtatgcgtatacatataaaaaatgtagggtatatatacaaagtttacacatattttatcgtctatatacgtatgtatatatacctcatatacatgcgtataaactttgtattgtggtatatatacaaacgtataaatactgagactagatgggtagcgctggtcgcgcgggtgtgccggcgcgcgaccaatcgcgtatcaaccatccccgactggattggcttgggggtggtggtggtcgtggtggtgatttagtcaggtggatggctggatgctcttgcagctgtgtggtgggtgttacataaatatgatcacaagtatcttaatatctctatcagtacagcacactgaatccatactatttgaaaaggtagtgtgtagtgggcttaaatacagatacaccattattgaaaagataacatgagattgatcacagcacctgttaaagtagaattttacatgaaatggaacttaatgaagacttagatcagttggtttcaaatttgtaaaatgacgagtcaatcaattactggtaaaattggtggtgcttctataaattacacaataaatgcgccataacccaaattaatatatggataacttcatacctccaaatagtcaggaccaaaaggaaaaaccaattcaccaggatcccttgctgataaagccaactttgctaaagaagaagcctgcaagtttgatgagatataaaaaaaaatcataaatcaagtttaactaccttgaaaccacgcacaagcacaagctgaacaatcaaggcagttaaataagtatgctgttgtgatgtctaagatagggaaaagaatatcctacaagatacacagctatcaaagaagttcaagagtacaactgcaacagagcataatgtcataatgttgaaatactcaaataaaacctacaaaagaaactgaaagttaaaacatggacaaaatgattctgttcatattttgatatgccacaaccaacaagctatacctacatgctcaaatacactatatgtttagcatgcacaaaaagtaggcatcaggaatggcataaagatactgagataaaaactaaccagatactggaaaacatcatttcttgccacaaaatccgtctcacagttaagctcaaccacagcggcccttttctcatcttgtgcaatagcaagcaaaccttcagctgcagtccgtgaagactttttggcagcaagaaccacccctctcttccttaggtccttctgtgcaacatctgaaagaaatcaacaaactgtcaataggattaacagatacaaacaagtatgccgatgaagtaatgctaatgcaatcagaaataagcacaaaccaatatcccagttgcaactaactaaggaagccttcacatctttgattggagcgctcgtcctctccctcagctgtttgatgagattcatttgctccgacgcaggaacttcggagctgaatctcctgagaagtgtggcgctttgatcgacattgctgctcgaaaggtgagcctggaacgctgaataagagtaaccccgagcagaatgttgttgggcgcgaaacagaagcccaatcatgggctttctagcactctgactcctggccatcctcacattgtcctgcaatgcagagtatgcttacctgagggtaactaaactatcatcaataaacatcagaaaagcgagctccaccgattaggtctcaactaaagaaaagagatatgtcatcccatttctgcaactaggcagcggcggatccaacttggccaaactttttggggaacaaacaacaaactgttacttgtattaaggataaggctctgaaattaagagaggagcttcttccagatctagaagaagagctagggttaacgaacgcaagcaaattccagacaaaagtagtcccggtgggagagagagatgaatcaggatgtggatgctcaccaggatcccctcccctgctctgctcgccagatggagatcggcgcccctcccctgttcagcagagagatgacgcaaggagcggaggagacgagacgggatacctcggcgaggacggagacggagacgcggacgacggcggcggcggcggcggcggcggcggcgacgagtggagcgcacccgcagggacgggacagtgagggagacgagggttttgggttttccgtctcggagggctggtttgtacgtcgatgggccgagcttacgtgggcctattgggttgaagcccatttggtaaaacttcgacacatgtaggaataagtctaatatgcgtccctcaactcatgcatctggttgaaatgcacccctcaaccgcaaaaccaggtataactttcccctcttcatcccacgtggcatcgacatggcgtttacgtgacactaaaataaaaataaaaagaaaattttgggcccacgtgtcacatatgcgtaaccatgtatttgcctgccaccctttagaaagccaagtgcagagcacttgttagttgttagtacaaacctatcaagacggacaccttaaatccccatactgacaaacaactctacggctacttcaccacacccaatctgagcgtatcctttcaccacacccaatctgagcgtatcttgtgataaccgtattccaagtagtggggcgcctgggcctcctgttgggagtgcatgaaacaccaacattgcctcatccatgctgggaagcttttgcatacaagttgatagggactacgtttccctgtatacggcaaaaaaatcacgtatccatatcggatgatacggtatcggatacgctccgatatgtgtcccgtacgtatccatgattttcacaactaacaaataaaacaaagtaaatctggatatttcgtggatacgccttgatacatcgcttgaaatcgctgagcagtacaaatccatggcaaccaccatgtgagctggctcgatcttgttcaccatttgatgcccctacaagcgcatggttcctatgctgccgctgtcggacgccatagctccacctctgctattgggtgtggcactgacggtgtccccgtcgtagccggatgtaatgcttccccctccgcgagtcggttggccgccgttggacgtattacctccaccgctgagcgtggtcccgccgccgctcgggcgctgctgctgcctactgggcgcagtggggcctcctcctcagtggtcaggcgcagcgccatagttgaacacaacccatgcaccgctgggtatttgcttattggtttgttgcttctttgatttgtttccataaagtacaggcgcattcgttttttatgtagggtttgggagtagtaaggtacggctggtaatgttgttgcagcctacaggctcactaacagtattttatgaaacaatcaagcttcatcatatttctttttttttgtcatggacatgtgtggatccatctttatttgtatacgggcgtatcccaaaatttatagtttagaaaataaaatttgtataggtgtatctccgtatccatgttttctgaaaaataccgtatccccgtatctgggtaacataggatagacgtagtcccaacatagacattagcattcaggtccaacttgacgtcaatcccattcacttgcttaccgaataaaacagccttagattgtgtacacgcacgtaggaggcctcccagaaggcagcgaagatggaaatcgtagagtcatcgcgcccgtgctgtgtgtacatggagatgaccgagccccaggaggcaggagacaaggttccgatggtgcattagagcaactccagtgtacgagtaaaatcgaaccatacttgaaaaaccgaatacaacacactacagcaaccaactgttatatgttagagcaaaaatcgaccacagaaggagagacgaactcggcgatgaaaaggtaatttgcagtcgttggctggctgcacgagagagggatggacgcatgtgattagagattctttttctacgtgggtccatgatcaatgtcacacattgcagccaacgaatcaaaattttgctcgaccatgcttattcaacatttgaactatgactaaggtgccttagatcgaacaggtgggtacagactcaccccgtcccattcccctagctatccttatctctctctctctctctctctctctctctctctctatatatatatatatatatatatatatatatatatatatatatatatatatatatcagctattcactttccatttatattacacatagcttgcactaaaagttgattaaactcaaactttatcgatcgctcgagccgtcacttataataaatatgagtaaattgcacccacggtgcaacaacttggtaggtgggtgtaatttggtgtaataacttgaaaaatgagcgttctattacaacaacttggcaagaaggtgcaatttagtataagaactttataagtgatcgtataaatacagcaactttgcaaggtaagtacgattttgatataataaattaagaagttgtgtgacaacttaattatttggagcattttttatataaattcaaatttttaagtatttattttgacaatatactagcgtggatttgtataaacatatttatatttttatcctaataactaataactctaataactaataactgaaagttaattaaactggatgtagaaattattatatttggttgatatttgagaaggtgaagaaaacaaaaaaattcttaaagaaaactgaatgtaaattgtatgtgcaatataattcttaaagattaaattcaatattataagataatatccataggattactatgtattggcatattgatatcggaaaaaactcacctagcatatgcttagccaaattgattcaccaaaatactaaattgtcaagttcttgtattagaacgcacccacttgtcaagttgttgcactcggacattcaattctcaagttcttgcactatatcgcacccacctgccgataggggtggaaacgagccaagccgagccgagctcggcttcgtgaaagcttggtcaagaacaggcttggctcggctcggcttgataaatggaacgagcaaaaagtgcagctcggcttggctcatttaaaagctcgagccggcttgagccagcttgagagggtggccgagcggcactggggagggaggccggaggcagcgcaggggagggaggcggcgccgcggcggcatagggagtgtcgagccattgaccgtcgagtgtcgctggggagggaggccggagccggtgcagccgcacaggggagggaggcggcgcatgggagggcgggccggagggatgtggcgggccggcggcacaggggagggaggcagcgaaccggcggcacataggggtgactggggatgggggagggaagcggcgccgtggtggcgcggggagcgtcgagcgccgctggtgagggaggccggagccacgcagccgcacaggggaaggaggcggcgcagggaggaagcggcgagccggcggcacagaggagcgactggggacgggggaggaaggcggcaagccgatgggtggcggcgcatgggatggagccgaaggtggcggccggcaactcctctcgctagtgacgccggtcgtgcgtgcgtgcggcggcgtgcctgcacctgcgtgggatggggaatggggagggtcggacggagcagttagggtagggttctctgttgttttttatgggccagactgagacaacttgttaatgggctaggctaggtcatgtttttcacaggcttgacgagcctaccgagcggctcgtgagctagctcgggctcggctcgatttgcaaacaagctgtggagggagctcgggctcggctcgtttagtcttcgagccgagccaagctcacgagcctaagttttttgtccacccctacctgccaagttgttgtaccgtgggtgcaatttactctaaacaaaatataaggtaatctacgataataaaaatcagactaagcttaaatacatatttttccctaaaaaatattccgcgacttatctgatttaaataagataattgccaaaaaaaatcatcgcgaactttcaattgtaattacaacatataacaacggtgtaacattatataaatatagagtataaagttacatattttataatatatttacatataaattatattgtattatagtatagttatatttcaaagctttccactcaaaaaacgtgtcgtagtttttaataattcctcaaataacacttcaatttaagcatgttgtcgtctaattctgccatgaacactaacggctcgatcagaaaattatcgacaacggttcctttttaactacaaacacttacacgcacgagtacttttctaacacagttaaaaattcgaaaatgctacacgtacatccgaaatgtcacgccgttgtgcatttgctgttttaccatttagtcgtacgccggtgggacacctagttattggaaccgaccggaccggcggttggatcggaaaaaaccgaaaccggttcctttttaactccaaacacttacatcccgttataacgcacgagtacttttctaacatagttaaaaattcgaaaatgctacacatacatccgaaatgtcacgccgttatgcatttgctgttttgccgtttagtcgtacgccggtctagtccagctaaaagaccggttgtgcaatcagcctggtatataccggttgggccgcccgatctgcattgtgcgtggtcaccttcgcagctggagagggaaaagggtgggattcgatcccaggacctcatgtataaaagtaaaccaaccaaccactagattacgatataccttgtgttttgaagggataaacaatatatttacattagattgaaccgcttcaaaccagtggttcaacactttaaccagttgaaccaataaatcattgaattgagagcatcgctggtttaatgaccggtccggtcttaataattattatgatgtgacaaagaacatcggatgcatagcggggttcttaaaaattactcatgcgtcaacaacgcggttgcaagaaaccgttggctcacgccacccgcgccgcgctgcgacccagcctccgttcgagctgcgtgcgcgtgcaccgccaccgagccgaaccagctgtcgcctgtcgccgggctcggacccgagtcaagcgagtcaagccttccggtgcggctgcggctggcctcgcgtacggccgccacgtggcctcgccgtatcaatcacgagaaggggagaaaagtggggcgttgcccagaaaccccagctgcttgctcgccgcgcgctctcttctcgccgcctcggcctcgccgccgtggccgccggtgcctggacgaggaggaggtgagggcgtacgcttcggccggtccgccggccgcgccgcgccgcgcctctgtttgttctctgcttgggctcgccgtgttggcgtgtggatgtgtaacggctaatttggttcggtttttgtgcttggtggtggtggtgattgcagggctggatcgctgggagatgttgagcagcggcgcgcggtggcagccgcggcgaagcggatgggcggagtggggcggcgacgctcgcccggctcgctctcctcctcctcgtcgtcgtcgtcccgacgtcgctgcgggttggcgaggcgaggggaccagtagagtgcgggggcgcggggagaagggaacgactcatggtggagcggaaggcgagggcgcggtggtggccccgtgagaacagcggacgcggtgccggcgagaaatgcggtggccgtcgccggtggtttggccacgcgcggcgtcgagcgggatgctggccaggtggtggcgagagaggagaagagacatggcggcgagttggggaccaagagaggattggaggagcgggccgcgcgttcgccgccgccgccgccgccgcccaagcggagggcggtgtccgctattcgccagtttcccccaggttgcggaagggacgctgctgctccagtcgcccgcggccgcggttgtgatggtggtgttcgtctgttggatgaggcaaccgctgctcctctcgctggcagcaaagatgattctgctgttccgggtgtggtggagaaggtggcgtctgtagatggtggcgattcaatggcgaatgcgcatcatcatcatcatgctatgatggacacggtcttgatgaaatcttcacatgtttcggatgagaatcaggtcgctcgcaaagttggttcactggaaaatggcgcagaagggtcagcgaggggaaagggaggacacggcggtgaattgctgggaaggaaggaagtgttggctcaagccgcgaatttgcttcccaagaggaggattgtatctgcgacgcgccgcttccctcctgggtgtgggagggacgctgtggctccacttgctcacagagaagagagtaaggtaggttcaagtttggaagccatgcctgttgatgctggttggggtgtgtcaaaggaggtggtgactacggatggccgtaataattcggttaaccagtgtgcctcgaacattgtcggaacagtaaagtgccaggaattggaggagggtgaggtagctgctgaggcatgctgtgatgtggagtcacaaaaagttgctggtcatggagaaaaacttgaaagtgctgttcctgtaacttctgctgttactgaagttttgacaaggtgtggttctgatgagatggaagggtgtagttatgctgcggaggcaactgaaaaacacttgtcaatgggtggtaaatgttcaattggtggtcctttcaatgaaattgtccacggcaagagagtgttggggagtgatg

SEQ ID NO: 5622 - DNA, 12226 bp, Oryza sativa
  unsure (1)..(12226): unsure at all n locations
agacgatatatgcatctgcagctgctgacgttgttaaggtgatgaataaatgcaaagggaccaaatccaaagctgcggctgtaccttgggctgaaggtccttccaaagaacacttcaaggctaagagggagtgtgaaaaagatgggatgaaaaaatcatccatgaatgttccaacagaagtatttcgtgatggtatcatgagaactaagttactattgacagctagaaaagcagtcaagccaccactgaatactctgcatatacccttctccatgggaaaagaggagtctgttgtaacaaatagtgcatcatttggtcctaagaagaaggtgaaggtgaaaagcccgcatgaaagtaaaggtattcctatgaagattgtctctacatctggattggcgggcaaggacaaccttatcaatgaaaaggctttgagcttggaagatgatgatattttgaaggcactagctgttcataatggaaagctagagttgtatctcaatgttccctcatgcgttgagcgtcacaggcaacatggaagtgagaatggcaatgataggagcaaaatcaggatgctatgcaggaggtttcaatttatatgcaacgctcttctacatgctgttgaacaaggctcattgatggttcgacgaattgaccttgaagctgataaaatcatcaggaaattgccgggctttactaaacatggacctactgtgggaaatgttcgtggagtcgaagtcggtgacgaatttctgtacagagttgagctagctcttgttggtcttcatcgcccataccagggaggaattgataccaccgatcataatggagtgcttgttgcaataagcatcgttgcttctggaggttatcccgatgaattgtcaagctcaggtgaactgatatatactggttctggaggaaagcctgctggtaaggagaaacacgaggatcaaaagctagggagggggaaccttgccttgaaaaattgcatcaagacaaagacacctgtccgagtgattcatggattcaaaggtcaaaatagagaggacgtcagtcattcaagagctaaacaaatcttaacatttacttatgatgggttgtatcttgtgttggattgctggagagaaggtctaaaaggttcaagggtcttgaaatacaaattacaaaagattcctggacaaccaaaacttcctctgcacatagctaaatatcagaacactaggctgggatcccaaggatggtgagaaccatcttgatgtagtgcttagatcattgctcttgattgcccttgtcgaactcggacatgaagagactataaatgagggagttaggcggttccatatcttcttaaaagacagcaaaactaaccttcttccaccagacactagaaaagttcagattttttcttaacataccgctatagtgtcacgtctttggtatctagtgtactaatatatgtattgatctgcaggcttcatatctttctatgatgcagactgttactacctccagcagaggtggtaatggtgctctccttaaaatctacagagaaactgctgaagcactggagaagtcagtcaagtcacgcattttaagactgtgcgttctgactgtctagcttaagtgacacagcagggattttatgatgagttgtgttgtcctgaaaagtaatatttcttctattgtaggtacattgtcttcatgcccagctaaagatattgttcttgaggcaccaaacttcatggtcactgatgagtgatgaggttaagctctaaatttctgaacaaacgatgattcaagacagtaaatggtggaatgagattctattctacaccatggatacataagccagtctagtctctctcttgcttgccaggtacggaatcaagatgcattttatgtccatggtggtagtatattagaagtttgagaagttgcatgggctgattgaaggtatgctatagtttcagggtacctaaagtgggttatttatgttgctatctgataaacaacgcacagatttctgatatttatgaacgaaaaaactataagcactgttgtgatgctcaatatttttactgttatgaggggttcaaagttcaagttccaccaaatgccaatacatgttaggtgtatatatcaatacgagaatcaaatttagattttacacagagctatgccaaatcaaattatggtccttgagaaggtaccatgaggtatcactttttctattgtaaatttggtacctaggtactatgaggtatcatgaggtaacaaaaaaaataatgtaaaatttggtacctcattgtacctccttaaggaccgtaaaattgctctaaagtttatggtttgaaactaaaatagtcaaaataattatgaaatagggaagctggattatcaaaattcctttctaccgttcacgccaatatcgaagttagtgcaattgtgtgtatgttaccctccctggttgcataattaggtctctttacccaaaactggtgcaatcatttgttttgctcaatactactatcattcagtcctgctcttttagaaaaccagagaacaaatccaaaaggttttcccaagtaactctgtgatagttcagaacaaaagaaacacagtacttcatagaaaacgtgggaatcaacgttctaacagatgaagtgaagctgtttatgcagttgcaccaaataggagtatgctaatgagctttgtgtacctaccagtgcagcggttgtgactgagttatttcattatctaaaagagattagatcatcacctcggtgagatgaaagctccaaccccattcatgacgctgaatagctctgcaatttaagggaaatccagcatatcaaaatgaacgcgacatatttccacttacagaaaagatgccacctgaataatgcacatcttagaatgagcaaatcaaagaagttacagtaataagttctgttatttttaacaggcctgattctggagttcagagcaagttggatatctgtgaccatgagtccccatctatgcatgatgcaggaaaaccggttcatgtcttgaagacctggccatcaaattcactactatcagacttcgtcaatttctcgggtaagcgaagttacccccttttctctccattgctcttccttctcaggcactaaattcactccttcccttttatgtttctatttgttttctgcatgatcaggtcaccacggaggagaaagctactgaattttccgagttcttcgccggtgaannnnnnnnnnnnnnnnnnnnnnnnnnnnnnnagcaaagcctggagagggtccggatcagcccgagatggatcgagagcatcaggccttgctcgtacagtgcatgagctgcagcagcaggaaatgtaactttctgggctaagctagaagattttacacgcatggaagttcgtacaaaaatgttcttggaaaggttgtgcggttgggccaggtgtggccactactaaaaaaaacctagataggtgctcaaccggcacctagcaagcaggcggcacatatgagagaaatgaaaggaccggcacctttgaggtcccaaaaattcagaaaaaaaacagctgtcgagccaatgcatcgaggcatcgagctctcaatcatccatgagatccccatccaagaatacaagcacacaatcacgactaaaacaaacatccgcagacaaaatccattaacaaaatcaacgagaagccatcgccaccggggagagtggatatccgccgtgggagcctctgccactagatccacctttctggcagcgacgacggggatggcttctcctccgtcttcacccttatatcccatcgatataagggtgataccttacaatatcaggtatggtacacaagtatctatctatctatcttctattatatactaaaagtccattaaacattttataaacgctctcaaaccgccacgtggcactactacaaacgctcctaagtcgccacatggcactatctaatctcaccgttgattttcacttaaattgatggatccgttattttacacaattagattagatctattattagaaaataataacatcctcatgtttataacatacaagcgtacttataagtttgtacgttacaaatgccactgctgtactttccgtacgtacaaacgtatatgattgaaaacaaaactttcctaatctttgctagaagaaaaacaaatacacatatacataaaaaagacataaaaacatacattcataaaaatcaacggtatttaaaatatgactttctacaatataaagataaaatatattacttcacaaatataaatatattcagttaaattaagatctataataaatatccaatcaatattctttcaaagcatcttctaaatctatctattatatactaaaagtacattagactttctacaaacgcttttacaccgctacgtggctctctaataatttagagaaatcataaaaatctattatatactaaaagtctactaaatgtcctgcaaacactcctacattacattatcatgtgacgctctaataaaataagagaaatcctagaaatttagagtaaaaaaagaaaaccatccaaccttcaattttcacttaaattagtggaccagttattttaaacattggattagagctttaaagaaacggacggatttctcaaaaaaaagggattatgctactaatctctatcccggtaaaaaaaaagtggcgtgcttaagtcgtacgatcgtctccttcccaagaaaaaaacaaaatttaaatacctacaccatatatgatcgaaaaaagataaagaaaaaaataaaaagaaagcacgcacacgtacatagtagtatcggcaagaaatattgataaaatcatcagttcagcactaatttgttgtcaacaacctttaatctacgattttattaaaaataatactacatagatatgcacagttaaacttaatcgtaaacttgttgtagtgataaatatatcatggcaaatgataccaacatgtaatagttaatgcgataataatgtttcaaataatttcatatgatattttatggtttcaaatatcacttgacaaatatataacgttaatttgaatctacatatgtaaaaaattaaaataacaaaacctagaattgttttttaagtacatctatttaggtttatttaattttgggagaaattgagattctcaaagtatttggaatttttcaaaacttttcttatttgaggtgtcagaagcacaattaatagattgatgagaaaattaaattaaattttagcgagtggtaataaaacaacataattgagctttggtttttaagtggatctttttaggtttattttgggtgagattgagattctaaaactatctgaaatttttcaaaacttttttattgctatttgaggagtgagaagcatacatgatagatagatgtgaaaaaaaaataaataaataagattttagacaatcgttttgctagaatacaacccttaattcatcacaagaattatgtattttctttgccaagtagtattggcaaaacatgaataatccaataaaatacgcatcaaactacttatgatatttttttatagttgatagaaattctaatataccaggtataattgatggacgaatgttatacaccactgaacccatctataagtgcactctagcaaattagttagtgtaaataagtttgtgaaataagtacattcttagaattagtaaatgagtctcgtatagttataagcaacatatggtggaaacaaatttggcgctaaagtataaatctttatcaaaatataaataatgatatggtgttttgcagattttcgtggtggtacgtctctttagttatagttttttttaagtagtgtcgaatgattaaccccagtcatttgagaaacataatattgtatgtattccattaaaatttgagaagtacttattactaacttcatatacatattttatctattctctaccacaatcgactcaaaacttaaaaaaattattttcatcacctccttctttctgtccctctttgtccttcaatgcagggtgcaatacctgctatgccatcataaatttgcatgggcatgtacatggttgagttaaggtggtgtccatgaaaggctatcataggcaatgtaactaaagtgatgtacttacaaatataatcaattgtgagtgtaccaatagtgaactaagtattaaaattgtactctacgatggtttttaggggcatggctatatcaatgcgagacctgtatgttttaaggcattacatatggaagccttggttggcagatacagctgacttcatacattagagaggcattcatgtttatttttaatggtgttatcgtattattcggtagatatggtatatttagcttatttatacatatacgtaaaaataagtgatgaacgacaggttatgtagtgtagatgaattttttaatgtattaataatgtatcgtttgttttagtggtactaatacaatttcatttattaaaagtgcacctaactcttaaaacaatgatagtaagtagtgatgacaaacaaccagtttatatatgaccagaataaagggatttttatttaaatctaagagacactcttatcacattagtagtatattaaaatctatcatctattttagggtaaacatatttcttttttattgtaggataatctaaattctcttacagtatatatatacatagtgatatatgattccttttagcactcctttttttaataaaaaaaaagatgcatgtgcatctgtacgaaatttctttccgatttatattctggaatgttgtacagtgtttgaaacacaaactataatatatgcccgcgcgaatgcgcgggttaccttcctagttgacttcataatatttacaaaataaaaggtcttatatacaaaatatcgtaaatatttactgtgccagaaatagctatgttttaaaacggagatagtattaaggtatatatctccattccccattgtgtgaaatctgatttcatcaacttatcgttccttcctttatggcttcctctctcggcgatggcagtggtctcccctcgacgattatagcgctggtgctccaccgtcctcccttgacatcactggcgccgccggtgatgttctcctctcgacagtgacggcgacagtgctccctcgtcctcccttgacatcgtcggcaccggcagtggttgcggcttcccatgtcctcccaaccattatagcggcgtcagtgacccttgcctatgcatagcattttctctgcagtaacgcagagaaagggactgttttgaacagtaattgactttgtgtggacggtgagcgcagcaatacctatagcaggccaaacgggcggcccggcccagcacgacacggcacgccgacggcacggcccactagggcacggcccgttaggcacggctcctatagcgggccgtgccgtgccggcccacgtgccaaggccacggcccaagcacggcccaagaaggtgctgggccgtgccgggccggcacggctactgtagtggcacgtgggctggtagccggcccactagtacatgtggcccataaaaattgaaatttgaggggaaaaaaagaaaaaaggcagaaaaaacataatataaaggaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgagccgtgccatgcctgggccgtgccgtgccggtacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttggcacggcccatttggccaggtttagcaataccttaggaaaaaagcactgttgtatagtgatgaatttactgttccagaagtaagtattggtgttacagatagtgcatacctcctatacatgagtttatgacatacaaaaatacacatatctaatattatacaaaaagtatataaagcgagtaagaaaggaaactgcttttgcaggaatagaagacgtaaaagtttggcccagaagaggcaaggtttcctttgcctatatcctaacagggttcttcgagttctacttggagaaaaatgtatctagccgtataaatatacccctcccaagaggaaagagcattgaattgcaagcccaagccagagccacactaaaagatagccaggaggaagataagccctagtgcggacatcatctcgtcgagaattactcgacggatcctagttgatgggttagaatagctaacttgctcttcgattgtaactagtgtggtacttttccagagatatacatatgaaccggagtagtgttattactcatcttgatgacccaaactagcataaaagtcattgtccccgtcttcttactacaatctcgtgtataccttggtaccgatgacttccatactctacaaataccattctcgggtatagcccgtcgatagtgttgtgcagattcaactatagctatagtgatgaggatattactagcttggatatgaccatgattaccttatatattcataaaccaagtgcatgctttctatgtgggatttaagtgtcatatatttgaacaaacattattgcactatgagttttgcgtgttctcattttcaaagatatttgcttgggtaaaggaaaagagaccgagtgcgagagccgtgtcttgtcttgcacatactcggctcggtgaatggttcatcttcgattggcatggagcaagaaaacggattgaagcagagccagcacacctcagtgaatatcattatttaggacaagcacgaagaggaagagctttgtccttcggccttgaatcagcataaagcccctcgccgagccacttctttgacattacgttcgatttcaacttcatgttcctgagttgcagagaacaatccaaattgaggcaatctttccggatttgctccgccttacagccttgcttcccattgtcattnnnnnnnnnnnnnnnnnnnnnnnnnnnnnnnnnnnnnnnnncggactcgagcggggcccaccttagaaatacatggatgatcaaattaagaagctgattgggaccaaaccaagaccttccctaagtctactcccatgttaccacgtcacttttggtccatagaaagcaaaagaagaagttatacacgttttggattcggattcggtctcttgataacatcatttcaaacgggcctagctgttgatctagaaggaatctcggggcgcatgagtacttgttggaaagcttatggaatctactttttcagatggttttggtcctacatcaaaattcctatcgaggtgttgggagtctgcaaaacaagttacgtaccttatacagtccgagtttgatttgagccttataattatgtcatgggctaagcgcaaggaggtggagttctagggcaaactcggacatcacttatcatatttattcaatagccatcatagtttagaatggggttttgcttagattatttatgccattacagttttgctgcttgctcagtttgtagaactccaaattgaagcgcttaatcattcatatgcaattaagttgcaatctaccttattcttgcttgtgttcttcgattcgcatgtacggattgtttgaggtcaaccgggcagtgcacggttgataaccagaggagacgtggtgctacaattacagggttcggatcgtgtcgatcgaaagctgaatcgtgtgtgtcaagtttccgccaaatcgagagttatcactacctattggaagatcgggaccagtacctcatcatatagttacttagcatctgaatatctaatctaagaatcaggatcctctgaattgatctacaatacccaacattagagggaatggagactgtttgatcagatggattagatcgtgcgctacaataaatatgctacaatactcatcaatgtttgacagtattttcgttaatggatcgacattgtttgatgcattgatttattgtgctactaacatgaatagtgcacctatgcattactgcagaggatccggatccctgatctagcccatcattttaaatcgagggtggataggatgggccattgtgcaaatgatataacttgcatcaataatattccaatgtagtttaaaaaaagagataatattctaatgcggagtatcccgatccgtactgctcctgctactaagcgaatgagcaattaagcatgatgtgtacagtagaaaagggtgagataaaaagtgtggatgatcttgtgtagatcattgatgtgaagggcgcgataatttatagaattactatcttcgtgttaaaatataataaattttaattataaatatgaatatataattgtttaaatttttagctaaacatatttatattttgagatggatattaccaaacttagccgaagctgttaaatagatacgctttcctgctgtgtgattgtcctttggatagtgcttatgaataaatcagcggcgctgcaaggaggacccaccggtaagtgacatgtttgagtaaccgacatacaccgttcagggggcgcaccaaagtctgtgtgtttgctgttggttttggatgattaatggggagtaaagattacgaagtatagttacggagtaacttgcatggtgtggctgatgtctaccagaatgtgaatgatcagtgggacccgtctctcatggtaaaaaaatagctgaattcagctatactcatgcgttgtatagctgaattttgctagactgacacgagtgtcaatgacaagtaggtccaaaataattatatttcttagcaaaataatgaaataaatacttagcaagagttttaaatataattgtgtccatttttaattaactggttcctcacactttaaccattaataatttcttaaatgttttgttttaagaaaaatacacgtatgtagatttgccttaaaactatcattaaatatcataaacttaacagtaaaaaaagacatcataaagttattcgatgtcataaatgtattctaatactaaaattatggttgaagtttaaaatttgaccaaacctcatcttaaacataaaatatttgtgattggagggagtagataatatgggattagccgtgtgaaaatcataattataaacttattatggaaaatatcttcacctagccgtttcaccattgtagagtagaatcaatgccgcaataacaaccatctaaaattgtatttacgccccccagtaaatgcactacagtaatggagtactagtaccgcggcgtcaccgactcagcgtcaccgcctataaaaagagaagcgaaggttgctgagacccccaactagggctatcaaaaaagctcgaggctcgcgagctgcttgagctcggctcgctgtagactcggctcgagctcgattcgtcaacaattcgagccgaactcaagcctagctccaagcttgcgagcttgacgagccgagctcgaatagctcgtcgagcccagatttccctctgtcaagttcttaaattttcaatgcaacagctagtactactcttactcccaatgaaaagcagtatagaaacacagagcgtgcagagctgtaccgtgcaggcactagcctactagtactacattactctgcagcactagcctattagtactactagcatgcatgcagctctatttaatagtactactagttgtcatattatgcttgaaaaagctactagtactagtagtactcgacaagcatgcatgcagcctcctttcatctgtattggttatttgagggcacacgagttaggctcgagaaagctcgagactcgagcgagccgaactcgagcccatttctaagcttgtagtttaaacaggctcgactcgagctcggctcgagttggtgccgagctcgagcctatataggtaagctcgctcgggctcggctcgttgacggccctacccccaaccgttttctcaccccactcgtttgcttgcgttgcgtgcacagcgaccgagccagtc

SEQ ID NO: 5623 - DNA, 745 bp, Oryza sativa
ccgtcgccggtgatttggccacgcacggcggcgagcgggttgctggccccttggtggcgaaggagaagaaaaatggcggcggtgagttggggacgaagagggggctagagaagcgggccccgcttccgccgcccaagcgcagggtggtgtccgctaagcgccagtttccaccagatttcggtagggactctgctgttccactcggccgcggccggggccgtggtggtggtgttcgtccgtcggatggggcgcctgcccgtgctgttctgggtgagaaggtggcgtctgcgggtaatggtgattcaatggcgaatgtgcatcatcatgctgtgatggacacggtcttgatgaaatcttcacatgcttcggatgagaatctggttgctttcaaagttggttcaccagagaatggtgcagaaggggcagcaaggggaaagggagcacacaatggtgaattgctgggaaagagggaagtgttggctcaagctgtgaatttgcttcccatgaggaggactgtatctgcgacgcaccgcttcactgctgggtgtgggagggacgctgcagctccacttgctcgcagagaagagggtaaggtgggttcaggtttggaagtcatgcctgttgatgttggtgggggtgtgtcaaaggaggtgatggctacggatggcagtaaacattcggttaaccagtgtacggcgaacattgttggagctgtcggtgttttggatggaacagtacgggctgc

SEQ ID NO: 5624 - DNA, 490 bp, Oryza sativa
tccattttctataaaagcagtcaaaaacctaaaatcttacgtaatccataaaagtttccccgacagtaccaccttcatcttcctcacgctcaacatcaactgcaacttgcttgaagatagctacagttagaaccccagtataatagcaagaaggcagtggcattggttcttgagtgaaaatgcgctaaaacaactgaatgtttatgacagaatgttatggaatactcaagacttcacgtgcaccaatgatactccctccaaacaaaaatataaggtttattttttcatgcttgcatatagacaaaaaaaaattgaaaatgatgagacaaatacctaaataataattcagcccattgtcttcagtatggaaagcgtatagaaactgggtgtgggccaaactgtatgggcagtgcccaaacaacagtatcaaagggtaaaaacaggttcaccattcacatggaatcgtgagaagccacacttatgggctgca

SEQ ID NO: 5625 - DNA, 358 bp, Oryza sativa
cagacggtctgaccgggccatcaggccggtctgaccgccgacccgacagcagtccgaccgacgccttaagctggtctgaccgtgcaccaaatgtcggtctgaccagtgctctacgtccggtctgaccgggctccagcgccggtttgataggaggtttgcaaggagtaatgcatgggtttcatcgtcttcaaacaagattaatagggggcattatttacctcctggaacagagccgagtcctaggtggatgcctaaggatttaacgactactcaaaagagaaggttgcaacggctcaagagataagagagaaaaaagccgaagagcaaagagataaaaggttcaatgagttgcgaccac

SEQ ID NO: 5626 - DNA, 21109 bp, Oryza sativa
  unsure (1)..(21109): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgatataacgcattgttttcaaatatcttgggtatccacttgaatacctatgaaccatggggggttcacacctactagatgaggtccgaagctgctattcgttgttatgagtaactaggcttcgagcagtgacttgatggaaactgcaagtgtgtgtttggaagcaatcaatagcattggcacatgaactttaacaacaagggctaggtgtaccggttcaaaaattgttgccatgcttgatgtgctaagacaatggatagtatctatatcttatttggtaatgtcctagaaagtgactaagatctcaggatctttaggatgtgagcttgaatctacaatcttatcttataatgatcgaccatccactctttgttaatcctgaaacactcttcattaaacttattgaaccatttgtgtctgcctaggatcctgatcttgtcttcaaaacacacactatacgctattggtagagtatgctgctctccatactaccataacaccatccataactcgcagcctagcacccactgttcaccaggccctatagagcattagcatatgtatatccatcttaataatgtagttttgattatgatttttttggcatgttgtaatattatagggcttggatagcaaacatagtttttgggatatttatttccatttttatttgaaattgccacaatttgatgtaactagtaccttcctgtgctatataccatttgtaagtcttagttactcctgtcctgtctttgtgtcaccaagattcatgattggagtgtgatgtataaatactgtatatattatccaggacctccatgtttggattttatcttcatttttgtaacaaagctgtatacattacataatcagtgtagtttggagtgcaccggttgtactttctttatatccttgtgatctgtttttaatgcattgtgggtggtgtttccgtgtttgattgcagcaagtatgagtacaagggggagtcaagaaatatggcagttacacagttcgaagctgctgatgcaagacgatgttttccatgctgggatgaacctgcatttaaggtgtttaacatgctacaatgttgtttccctaggagtgttttgatgtaattcagacaggaaaatattgtaatgaaagaaaaattcagtttgcacttctagtttttacacaggtcttaactaatattttcatggtccttggctccttgctctgtagaatttggaaggttggatcaattatctaaaataacattacctcttgtctggttatttctggtttaggctaagttcaagctaacactggaagttccatcagagttggtagcactgtccaacatgccagtaattaaggagacagttcatggacctctcaagaccgtctattatcaggaatcgccacttatgtcaacttatctagtggctatagttgttggtttatttgattacatagagggctcaacattagaaggtagaatttcagtttctgtctccattgtttgctctctttcattcaaactatatgatatgtcccttctttgcctggtctttacacattttttcattggcttttgttaatttaatgtaggcaccaaagttcgtgtgtatactcaagttggcaagagtaaccaaggaaagtttgcactagatgttgcagtgaagtcactggatttattcaaagagtaagcttccaacatagtcttgcttctaagctttatttctaaagatgaggcagaataccatggatggtgcctatttcactacaataactaataatgttcttttatcagttattttgccactccttacccgctaccgaagttggatatggttgctattcctgattttgctgctggagctatggagaactatgggttggtcacttaccgagaaacagctttactttatgatgagctgttatcctcagcatccaataaacaacaggttatgcctatatttatctttatcaatttcatttgtttcatttactattggagagttagtctcgcacttgaatcctcatgtgtagttttggccaggtaaactgctatttttaaaaaagaaagaaagaaagaaaaattaacatctgttctctttaggttgcaatcactgttgcacatgaattggctcatcaatggtttggcaatcttgtaaccatggagtggtggactcacttgtggctaaatgagggttttgcttcctgggtattcaatctgaaaactattgtttgagaaattagaaatattgtccaattgttgtgtatcttaccggctaattattccatatgtttcaacaggtgagttatttggctgtggaagcattatttccagaatggaataactggacacaatttcttgatgagacgacctctggtctcagactggatgcacttgcagagtctcatcctattgaggtaatcttcttcagtatgctttggcgaagtcactgatggataagaaacataatattttgatgctgcacaaatatgcattacagatatggaagtacatgaaagcagtaagataagtgaattaacaaggatacaaattgtgcatgcatactgactagggatgaaaacagagcggatatggacagataatgctcataccatattcgttttcatatttttttgctggatacggaaacgaatacggatagctcgaatacagaaacaaatacggattatctcgaatacgaataagaatcgaacatgatcggacacaaatacggaaacaaattttttctcggaacacgtaagccaactcaacttctaatagaaacaaatatcaacatatataattagctcattttatataaaatgtagtataatttataaatatttttaaaaatttaaataatattaatagtgtggactagtgttaagagatgaactactcttaaaatctaaaaagataaagaaacggggtatgcctcatggcttctgcggatatctgaattattatccgtatccgatagaaactccgataccatattcgtattcgtatctgtatccgaactatccaagaattatccgatccgaaaggtatccgtattcgtttttctccggagcggacgggaactatctgctctgttttcatccctaatactgactagtcatacaatacaaccaatttttgatatttttataaatctttgcttaatttattcaggtgttgatgcttagaaattagatttttttttgggtagaaactcaaatatgtcaatatgctgccatgcattttttactatttctgtcttcacagagttagcacctttgtcccagttgttaatctggctatttggtatgttcgttcaggttgacataaaccatgcctctgaaattgatgcaatttttgattccataagctatgataagggcgcttccgtcattcgcatgctgcaaagttaccttggtgcagagcgttttcaggttaaatcctgttcttctttctccttgaatgaatttaccaaaatcttgttttctgcaatggtccagcctccagcatctcctgctgctagtatatcagcgctcttgaattgacactcttatccacgcatgttatatttatattcttcataaacaactcagcgctagatggctctacagaagtccagattgcatttaactcagattgattaagaaaattttgttgaccaaaaataataaagggcatcgtaattgtttgctttgactttgtttctggtcattttgcaaatctgtggtgaatctgctgaagaatatcttgagtttggatttttcttttttagtttttgtttattctttccagtaaagaaggtgatatcatagaatgcatgcggtcaacaagtcatatcaacttttaccaaaggctgtagaatatatagttgagatatataaacaatggtgtgagtgattttttcatgaaagatactcataagtttttagaccaaagtatgaagattgatccagctttactatacccaagataagagtctctttacaggaaaaataaataaagaaaagatattcataattttacaattacatcatttcttttgaatactcggtaacaacgtttagaattttagtacccatattagcatattgttgtctttctatgagattgtgtcatgttattgactttgtatttattatcacaatttattagtcttcggcaggtgctgattttgtgaattttttactctttcagaaagctttggcatcatatataaagaagtatgcttactcgaatgccaaaacagaagatctatgggctgttcttgaggaggaatctggggaacctgttaaggatttgatgactacatggactaagcaacaaggataccctgttatttatgcaaaactagatggacatgatttgcacctttaacaggttttctggcagatttctcattctcatgttataccaacatacatgaagaactgaatatatgtatccatcggccttgccttattccattgccttatgcttcgtccaatctgaaatctaagtctttttggccttattcccaagaactaaggaagtagcaaaatggtgttgttcccttcatttattccattaaaaacacgatccatttattcataatagtagtagctttcaagtagaaagagaatggagggaaaaaagagaaaactgcctcaaaaattctacagtaacttgcacttagagagattgaaaagagtaaaagactaaaatgacttttatttggatttgaggtggtatatgtctaagttttagctgtactagtcacttgttcaggatcgcttctttccagaacctctacttttattcatacatctaatcttatattagtttggttcttttgtttttaacttctcatagttgtctagaggacctcacctttcctcatacacacttttaggacaacatgcatgtcaccttgatcagaaactcagaaccataataactggagatgagaatatcatagtgtgctttgtgtttcatgttatctttcgttattcatgtatggtctgctgatgtctttattcacaagtgtatggttgtattttttttctcaaatgcatccaataactggcaaaattatagatttcgaagtattggaactagaaaatttcgttcttctggcccatatcagtgctttcatattgcaaaaagaggagcttactgaagtctgttctattacaggcacagtttctatcggacggatcctctggtccaggcttgtggattgttcctataacatcatgttgtggctcatatgatgcacagaaaaagtttctcttgaagggcaagactgataaggtccatatagacctcactgcctcccaaaatgccggaggagagaagggtgaaaactgttggatcaaattgaacgttgaccaaactggattttatagagtgaagtatgatgatgaacttgcagctggacttgaaaaggcaatcaaagccaataagctctctttaatggataagattggtaatgacaagatgaattttcaatactactcgtataatatatccttgtcaagattttgacaacagaaacacaatattttgctgcaggtattgtggaagattcatactccctttctgtggctcgcaagcaaacactgacatccttgcttcgcctgctgaatgcttatcgcaatgagtctgattacactgtgctttcacatgtaacctctgtaagtaaacctttcgccacctccaatgaaatcatataccttgtatctttgattgattctatggtatcaactattgttctcaatattaaatacatgcatcctttttgacaggtatgcttaggcattgataaaatatcagttgatgctactcctgaattgtccagagatatcaaacagcttttgatcaatcttcttctatcagctgccaagtatgctaacaaacttaatgttttaccattttcatcatcatgtttatctggatttcacgaatctggatattatcatttatgtgcatttgtatatttacttctgagttggcgcatgccactggtgaatttgtttctgttaataaacttctgtctactatattcctgctgttttctttctatgatcatattgaaatccttcttgtacttctaaatatcagaacactaggctgggatcccaaggagggcgagagccatcttgatgtaatgcttagatcattgctcttgattgcccttgtcaaacttggacatgatgagactataaatgagggagttaggcggttccatatcttcataaaagaccgcaaaactaacattcttcccccagacactagaaaggttcaggcttttgcttaacatactactgcagtgttacctctatgatatctagcatactgatatgcattggtctgcaggcttcatatcttgctgtgatgcggactgttactacctccagcagagctggttatgatgccctcctgaaaatctacagagaaacagctgaagctcaggagaagtcacgcatcttaggtttgtgcattccaaccgtctagcttaagcgacagcaggaattttctgatgagttgtcctggaaagtaacgtttcttctgttttaggttcattgtcttcatgcctggataaggatattgttcttgaggcactaaacttcatgcttaccgatgaggttaaccctctgaatcatttatattttacttattctgaacaaatgattccagatagtaaatggtagaatgagaaccattatacaccattggtacagaagccaatctaatctctctcttgcttgttaggtacggaatcaagatgcattttatgtccttggtggtatcagcttaaaaggacgagaagttgcatgggcctggttgaaggtatgttattatagttgcagggtacctaaagtggattattatagttatctgataaacaacgcacacatttctgatatttttgaaagaaaaaacataagcactgtatgtggtgctcaatatatatatatttttactgttgtgaggggttcaaagttcaattgttctgccaaatgccaatgcatgctaggtgtctatctcaatacaagaacaaataatttgttaaaagttaacgatggaactaaaacagatgaaatagggaagatgaaattatcaaaacttcctttgcaccgaccgtgccaatatccaagttactgcattgaatgatgttccctccctgttcacactttgcacgattaggtctcttcacccaaaactggcgcaatcaatctattttaccaaatatcattggtcctgctcttttagccaaccagaaaacaaaaaagcaaaaggttttactgagatacacagtacatcataggaaagctgttctgacagatgaactgaagccgtttatgcagttgcaccaaataggagtatgctgctaatgagctttgtgcccttaccaatggctgggaaacttattccattatctaaaaaaatttcgatgatcacctccatgagatttaaatctccaaacccattcacgagtccacaattctgcatagctctctgctattcgagggaaatccaagcttgtagcgtatgaataacaatagaacacatttttccactttatagaagagatgctgcctgcataacacactatttgatactacctccgcccccaaaataattgtaattctaggttgtttagcatatattaaggtttaagaagaaagactatgataccccttattaaatggtatataggtaagagtgggagggtagttgaaggtaaaatagagagaaatttgaataagaaatgattaatgagaccattagtattctgttgtgataactatttttggacaaattcaaatcctataaatacaattattatgggacagaggcagtaataatgagctaaacgaagaagttacattaataagttctgttatttttagcaagtctgattaggagttcagagtaagttgtacttttatgaccatgagcccatctgtgcatgatgcaggaaaactgggatcatgtcttgaagacctggccatcaagttcactcatatcggacttcgtcaaatctactgtttcacgggtacgcgaagtcaccgaccactttttgcttcattgttctccttgctctgctgctaaattcgccgttttctctgcatgatcagttcaccacagaggagaaggctgctgaagtttccgagttcttcgccggtaaaaccaaaccatcgttcgagcgtgcactgaagcagagcctcgagagggtccgtatcagcgcgagatggatcgagagcatcaggagcgagcctaaccttgctcagacagtgaacgagctgctgcagcacgacatgtagccttccttttgggctaaagctatttgtacgctcatggaggatcgtacaacacaaatgttcttcgaaaggttgtgccgggtgtggctgttctaacgatcatattttaaagtttgtttagttctatctctatcttttgcttgggcaatcgaaaagacatgtttggtcctcgcagcgaggtgtgcttggttcagcttttgtcaggactggcaatgaaaatcacaaatcttgtacagaactgtttcatttctacagccatatcagaagggttacaaaaataacaccacacctggtgttgataacatatacaaatacaatacattacctctatacagtaaaagaaaaaaaaaagattgcacaacatacaggacagcaccagctcgtgaattccaaagtttatatttctaccaggtacagtttatacacaacatgttctactactagatcgaatatgctagtctcatgtaaagccgtgacagctcttaacggcatgtggcatgcatctcagtcactgatgatgttcatggagaacttcgataacaagtttggaattccagctatgattgagccatatacctgcaaaaaaaaaaagagtcagctgaagcagctgagcttaaaaaaagatggtaaaatcccttgtgttggatggtgataaccaaactgacctgagcattgtcatgaatctgggatagaggcacagctagcagcttcatgttccttggcacgacaaattggcgagacaccggcagtttaatcaagaacagttttatgcattccttcatgacaggcaacaataaaatgattcactcaggttataagcacattaatattatttgaggaaaccacatggttcatggatgaaccggagtgtatgtcaagctctttacctttggtgcacgggcatttggaagtagatatggaaatggagcagcatcaaactcagatctccaccacatcccaatgcactctccaatctatagccgataatcaacgtgaaaaggatgaataatttgctggatcatactggtggtctcactcccaacattactgaacatctctgttcactccagttacctgccattcgtcgtccccgtcgccgtcttcgtcatcctgatgtccagctaccgataacttggttgaaagtttgcgcttgagcccttggacatctgaagcagagataccaggcaacacacgtgtcatccaaattgcaagtgtaccggtgcactagcattatctcccacgaggagaaaatcacatcctactcggcagtagacacttgcacatggcaagaattcaatagtaggttcaattcaatccattcctaaaatttttacgggaaaacttgggaaattgcagcaatgatgattgatgagcaccttgttcccctggtctcaagcggccaccggggaggaggaaggaggagttcctgacttgcaggagcagcacgtgcggatgatcaaagagctcaaccagcaggacgccatggacgctggtccggagcccgtgcgccgcgaagctgcacagatcaatcaaaccacacacacaaaattacatgatcgtcacgcatttgatcgagcaggtggcgggtagtgcgcgcgcgcgtgcgtacttggccttgaggcggagggcgcggtcggcggcggtctccaaccccgcacccgcgccaccagcggcaacatccctggcgccgaagtagtagcggcagagcgggtaaatctcgacacgcgccgccgccgcagcgggcgaaggcgcagcagcagcctcgtccgtcatgatctccagccccatgccggtgcagccgcccgccgatcaccgcaacttatatataggcagccgcgcgcgcggggatcagaaggcgacggagatcgacgggcagagcgagggtttgggaagcttctgccttggcctatacgagcctatacagggtttggtttggttatttgggggaggagaggagaagagaagaggagaagggtagagaaaggtcaggagcgggaagaatggcgacgtggcggggaggggagtggggtggttgggcggtgtgggtgtgggcccggactgtggtcgctagtcatgggcccgtacgggctgccgaacttcgataggccgtgatgatgtattgggccgtccaccaaggcaaacggatcggataaactatttaccgtaaccgtaatggaagatcactttgactccctcaactgaccaccgaatctaaatcgtatccctcaaccgcaataccagaaatcttgaacccccaacttacaaaatcggtacgatttgactcccttggtggttttggagagtggttttgctgatgtggcatatacgtggcagcgttgatttggtctttgtcccacgtggcattgacgtggcgcttacatggcattaaaatttaaaatatatgtgggtccatttgtcattcacacaaaaataattgtaggccccgctgacatgtgggtcccacgtgtcatcctctctttatcccttcttcctcctccctctcctcccttctctatctctccctctttctctttgtgcgtggggagcggcgtccgaatcggcggtggcgacggcctagatccagagctccgaatggcggtggcggacgggccgctggacccatcaaaccgggaagccatggcgaccacgccgcccgcctcgtcccagccgccgccgccgctgcctcgcgcgcttccttctccaccttctaccctcccgcgatctccctatccctctcccgctccgccgccgccagctgccgcggccgcctcgccctcgcggctccaagtccaagggcgcaagagcggaggagaacaagaaggggcaagagcaggagcagcaggaggcgtccatgacggtggtggacggcgcagaggaggccgggaaggaggaggaggggagaagagccccgagacggtggcggcggagctgaaggaggccgagaccgcggccatcagcagcgggtggtgggtcggcgtcgcgcaggagatgtcgaagatcgagtggccggtgcccgggaaggtggtgggcaccacaggcgtcgtgctcggtgtcatcgcgggctccaccgccgcgctgctctccgtcaacgcgctcctcgccgagctctccgaccgcaccgccgctcgagcccccacctgccgccggctcatgtcaaggggagagagagaaataagggagagaggaggaaaaagaagggtggtgagagagaggatgacatgtaggaaccacatgtcagtggggcccacaattatttttgtgtgaatgacaattgggcttcgcatatattttttaattttaatgcagcataagtgtcacgtcaacgccacgtgggacgaagaccaagtcaacaatgccacgtgtgcgctacatcagcaaaaccactctccaaaaccaccaaaagagtcaaattgtaccggttttgtaagttgggggttcaaaatttctagtattgcggttgagggatatgatttagatttggtggtcagttgaggaagtcaaagtgatcttattccaaccgtaatactctacatccttcctataaaataagattaacgagattatttttatctatcagtatcggcaagtactataagcatctaagcacgagcccacgagctcctagataacacataagcttaaatgataaggtagagaagagaaaagaggagagagaggatgaacgacccctcatgtaaaaagcaaccttttcacaatgtcccctagtaaattagttgatgatatggataatattagatgtgactataaaacttgtcatctaatatcaactattctttctcgttttccgcacgcaggtttcccaaaatgctaaatagtttattttttgtaaaaattttctatagcaaagttgctttaaaaacatattaatctattttttaaaaaatatagctaatacttaattaattatgtgctaataagtcgctctgtgttttgcatgcgcaagagattagttcccaactcaatgtatcgaacatgcacagccttaggcacaaccgaactacatttgataagtagttatgcttatgcacctataactccactctgcgtctccaccaacatatcgacggtggtttcaatatttgatgcctagcttgatcactgcagggagatatcaaaccataagatatagaaaatcactacaccacatcagtgccggttaggaaccccacatagttaccgattttctcaaccagcaccatagaagcggcacatatatgaatattggttagagtatatggtagttagagtcatattagaatataattgatatgtgtgaattccttcctatttgtaatccttccttacactaccgaagaaaccttttgtagtcccgattggtaaccccctgtagtcccggttttataactgggactatgaatccggaccagttgaaataaccggatctttagtctcggttggtgttactttttttctcttttttttttcattgttgttttgttgtttatatctcgagcacaatcacacaaaaatcacacacataaatcatccaagaaaaccattcacaaatcatacacaatcatccactatacatgcccttccgcaatccaccaatcatccccaaatcaacaaacaaatctacacatcaattcacaaaataaaaaaaaaagctccttagtgtcaggagccaagatctgaactcgctcctaacaattgaacttacccggcctcacacttagggaggccagtcaccgccggcctcatccagcgtgggccgccgccgccaccgcccggccacctgccacgcagccagctcgctcagccgccgccgcccgaccggctgccacatggccgccgccacccgtccgctgcacagccgcctgccgcgcggccggctcgctccgccgccgccgcccggccgccgcggagaggggaaggaggaggaggaggcggggagggggatcagaggagaggggaaggtggaagaaggggaaaggaaggggaagaggcctctctgatcgatcgatctgttcgggataccgagtcttaatgaaggagagaacgaaaggggaggggataccgagaagataagatcggcacgcgactcggctgtttatttttgtcccggttgatataaacaaccggtattaaaaatagatctttagtcccggttgtttataccaatcgtcccggttgtttataccaatcaggactaaaagataattggggcctgactcagacccgccaacttctttgaactaagactaaaaataatctttaataatttttagtcccgattcctattcaaactaggactattatgtttttggacgaccgacgaaagatggtaacgtgtctaatattcgcagtatatctctcgtctactatcaatatggtatccaagcgggtgatgtagggtcgccgccgctcgcgcttctgctcgtcgccccggggagcatttcgatctcacgggggcgggcaccattttttgttttccttttttttttgggttcgtcgtcatggtggttgcccgtgagggatcgatctcgatcttctccagtgaccctcgtcggcgtcatggtggtttgagtcaagcatcagccgcagtaacgcatggatctaccggtcgtcgcgtcgcgagttctcgtcatcgagccatccccgccgccgccgggtggacggtcgcttcttcctcaccgcgtcgaggtgcacgccggtgtcaccaagccccgaccgcccccggcctggcgcgctctgccggcaccaccccgtcgacctctccacccggccgccggactccttccgcaccgcctccgtcttgatgcgccgacgccctccgtcagcatctctggctggacagtcgttggccgagcgccctgtgaccactttatgcagtgcctccttttgaccctgttgactagccatcgtctctgctgtgatctcgtgcgttgctgccaagtgagaggagagagaatgattggtgtggagatatctaggcttgttgacttcgttgacgtcatggtgaccagacctgcatgagttgcgttgaagggctgtggtgtggtgtggactgctgctactgtgttgttgcttgtatctttcttctttctcccgaccagagatcaggtttgtgtcgcataccgccttcgttaacatctacgtgtctccgacatcggcatcaacttcggcttcgacttcattgttccgttgtgtgcaacttcggtctgatcacctgatcaagcacacatacatgatgacttctgcaactgatcgtctgcgagcatatctactacgccatcaagctttgggttgccgctgcgtcgccctctcgggccgcagtgttgccgcctgtggtccacggagagacgtcctcctcactgtggcctcaccgccgctggatttcacgtcgctgcatcaacatggagctacacctgtatcaccccttcgggtcatagtgtcgcccgtctcgtcgtcttcatcgtcgttcgtgcatcgacaacctcgtcatccgcactggtcatcgtcagccactcgagtcttctttgtctacttcgagcatcgccgccgtgtctccaagctgccactgtcgccgttctaggccagtggtctagctacctctacatagctaccgatgtcgctgtccaggccgttggtcctactttgccttcttcttcgtccagcatgtttcatcgccagcgtcgtcgtatctttcttgactacacttcgctcttcttcagcaactgcgcgctgctccggaattctccctctacgtcattctcacgccacgactgtcccggaggcattatttgctagtctcctccgacatttgcgtatgattcacggtggtcccttgccttgccggcacgatattggcaacactgttgcgcgtgtttgtcccgagttgttcccgagtctggcaaacccggcgtgacatctcttctttacagttcgactacatcggctctttggcatcatcttcctcaatgactgccgcgatcgggtcaccgtcatcgtctccagtgcatcctcacgcaccttggtccatgacgccctcctgtgcgtccacgaccactctacggcgccccatgcgcgctctgcggcttgggtacctcgacatcagcttcccgacttcggctacatcgaccatggctactttacgcacggcttcgtcgcccacgggtccttcgcatccttcgctttggctacatcgacatggcacaaagggcaatcattcgtcttgagcactcttgctggtttcttctccaatccaagtgtccgctttgctcacgcatggactacggggggatgttagagtatatggtagttagagtcatattaggataggattgatatgtgtggattccttccttatctcctccccttgtactcctatatataccggccccctgaggctcaatacaacgtgtctaatattcacagtatatctctctcttctactatccaacaatattcaaatgtgccggtttaggaaccggcacctttttggtcccaagaatccaaaaaaaagggggggggggtctcgatgcatcgagccgttccccatcacctcgagaccccatcgatccaaagcaaatcacagaagtttcacacactgtcaccatcgatccatccaagacatatccctcaaagcaccatctttgatccatccaatgatagatccctcaaagcacaaatcataaaagtttcacacaaatcacatgtgaaagaagctcaaatcacagatccctcaacaatttcatagaaacaaaatcaaatttatagtacaaatcaccgttgccgatacgtcgccggattcgtcgcgggagccgccgccgccaccgctccacccgcgggagaaacctccgccgccgacgccgaccccggatgcggccccggctaccgttgaggctagatccgtcgtgggagccgccaccgccgccaccactccgtccttgggagaagcctctgccgccgacgccgacctcgactgcggctccacccgccgttgccaccccggccgccgtcgaggccgcctcgcccaccgccgcatctgtcgtgggagagaagccaccaccgccgacaccgtatgtggggagaaggaggagggggcgagagcgagcgagcgagagagtgagagagagaggggcaagagagagatcgagaagcgagcgaacctcttatcccctcggccttatctcgtcgtggtggggcctgccggctcggctcgatttctgtgggtgtcagcttttaattaaccgatatctataatatattaaaggtaccattttttttaaaaaaaagggggcacctatagaataggtgtcggttcttatttagaaccggtacctataattgcttaaaggtatcgtttttttttgcgatttcaacctgcgaaagtggaaaaagacctataggtaccggttttagcacttccggcacctatagtaccgatatctatttgatgttttgtagtagtgaatttacattgcaaaatatagtagagtacttgtttagactgcagcagctacattacacggtaaaaaatgtgtagctccggctgtgcagcgcagccggctacatctgtaatgcagcattaccaaacagaaccagtaccactattttcttccgtatagtaataaaaaggacattctgtgttactatcttgctagctaaaccccagaggcggagccaatgcctcgcccaacaaactagcttatgttttataccaacccactaatcacataattatttaaattatacagtgtattagatcagctccaataccaaacattagcatatgcatggccagtcgtctttggccatggtgtttcagctggctgcttggctttggatgcaacaccacaaatccttccagatgtgttttgattattgctccaattttgattgatcattgttactctctcagtgctagatctacttctgcggcgttgtacatatttctatcttcacttgagcattagaatcctgccttgcttgcttgacccagttcaccacggatctgcgtgctgcatagttgcagtgcacccaggaggcaggagccgatgatactgatagccagtttcttcatgagcatgttatggtcagtatctattgcttagaattttgcagggtgatgtcttactgaatttgttatctttatatttatgatatagttggtaactctagtaaaattatcagtatatttatgatatactccctcattccttaaatgtttgacaccgttgactttttaaaatatgtttgaccgttcgttttattcaaaaacttttgcgatatgtgtaaaattatatgtatacataaaagtatatttaacaataaatcaaatgatagaaaaagaattaacaattacttaaattttttgaataagacgaacggtcaaacatttttaaaaaagtcaacggcgtcaaatattttgggatggaggtagtagttgataaccataaggctaaattgactttgctaaaaatatgtatttttctctccctattttataccaccatttgcgaaatattgtgggggtgtgtttttattttgtatgttccactaggtaaaccatcactactacataacacgtttttgcatacgggtgaaactgatttttgcatgcggttgctgcagccacatgcgtgaaaaggtatgtgaaaatcggtatttttgcatgcagctagcacaaccagcgggcgcttaagccgaccgcatgtaaaaagaaaaaaatcacaaaaatataaaattccaaaagaaaaaccctagccccactgccgcccgagctcccgtcatcgccgtcgccactgccgcgcctgacgcattgatagccggaacatagaaaagcagtacgtactaacatttagacctaacaatttctcctagcctacatagatcaaagtatagacttagacagttttccgactcttagcacaaaccaaaattttccttcgtgcaatgtacaacctagctataccaattaatagttttccattttttatcgaagggtaggtaggtgcaaccagtaaagcactaggttgcttgtggtttataattttcacatttctcgttttcttttaagtagatcaatcgatatatatatatcatcacaccactacacataaatacatacatgatggcaagatattggcatatggtttccaataattaagacacctcgacctcgatcgattccgttgcaaaagatatgcttaccctctctttcttcgtgttttccggggaacttaatggaataatggatgccgttttgggcatgtatccgttttctactggtactactttctagaggtgcaggtaggatgcttgcctcattttgtgcaagatgaccaaacagtccatgtgatttgtgctatatatgattgtttgatggcttgacacacggtatggaaatttggagtcaagtaaaccatcaaagctaaattggtgggaaaccactatccttccataacaaacaaaccatatctctctctggatgaagaaaatcaagtttttacatatggttgtggagccgtatatataaatcctactaatttttaccaacatctagtttcgggtggatgccctaaccatttatgaaaagaaattcgcgcacggatgctctaccacccgtatggacccttggtatgtggcggagcttatgactgccaacaataacctattttggttgctacaaaatatgtttttcgtagttgtgcgtgaaaagaaattctagccgcctaggaaacccttcttggtagtagtggacatatgattccgttgcaaaagataagctttgccctctttcttcctgtttcccgggaaacttcagtgagtacccttaccgtttctggcatgtgtaccttcaaggagtacaggtagattgcctgcctcgttccgtgctagatgaccccatgtggtttgtgttctcagttctgaactgtggacggcttgatccagcgtgtggaaaattggagtcaagtaaacccgtcgtgactgaattattccatggtaagaactagggtaaaatggggtcatgtagggttggatcacggcattttttatcctaacctatatttttcctttaatttaaaaccatgtacagatatagtgttagattagataacatatcactcatcccgtatcctatctcatattatttcctcggaatcagattcatacacggaaatctatttctatgtgcaattcatgcatattaaatatagatggacaattaaagtattaaaagagataaattaagaaaaaaatatacaatattacctatgatcttgtaaaatagtgattaatcaatattttatcatgtttgtagccttgtaggtggacttataatatatttccatatgtgtttaataacatgggaaatacaagcatatcttttcacggattcggattctaattcggataatattgaatatccattttatgtcctgtattcttcctacgagcctcgagtcacatgggcggttggaaaatgcccatctcgtttttaccccagtaagaactaggaaaaagtttgaattaacccctctaaacttttgccaccgttagaaattaaatacactcataaactatataaaatagatattatacaccccagatattctaactcaatctaaaaaaaaatagtgggctccagtggcacgtctccctcctcgctttcttccactaaacgactaatgatatcatgaagtgcctgttcactctgatgaaaaaaaaaaccttatcaaattttgctaaaattttggtaggatttcttatatagttactaaaatttagcagcaaactaaatatagccactttttttagcaactttactaaaatttgataaaataaaaaatgacattaaaatgaataggcccaaaatgaaacggcaggagtagcagcagtcgtttcagcatcaaccatcgtagaacaatatcattacagcaataacgtcccactaaccagtccagtaaaaatttacgccgcagtaaatactcctacagtacaaacctcaccagtataaaacgagaagctagcgaaccacctgcaggaggcgccaggcgggttgcaagcaaacacacaacccacccgtcgttgggtcagccacgtgcaccgcgaccgagccggaccagtttggtctcggacagtcggacccgagtcaatccttcagcctcaggtgcggcgtccgcccgccacgtgtcctcgcctcaccaatcatcacccatccttctcttctcggccccaccaactctgtctctctctctctctctctctctcgctgctcgcgcaaaaaccccaactgcgtcgccgtgctcgccggctcgccgcctcggcctcgccgcgcgctctctcgccgccggtgtctggacgacgaggaggtgagtccgtacgcctcgcctctgtgttgttcttcgtgttcgctgcttcggttcgtcgtgttgtgatgtgatggcgtgttggatgatgtgtgtaacagctatttggtgcgggttttt

SEQ ID NO: 5627 - DNA, 7145 bp, Oryza sativa
cctctgtttctgttcgtcacgtcctctgcttgggtttcgtcgaatgcctgggatgcgtgactgttaatttggtcctctttgtgtgttcagtggtggtgattgtatcagggcggcgatcggtgggcgagccgacgctggacgtctctgagatgctgctccaggcggcgcaggcatggagaagccggcgcacgcagcgggaagctcgcccggacgcgcttccacctcgccatcctcctcgtcccgtcgccgcggatgggcgcgggggctcaggcgaggggaccagtagagcgcgggggcgcggcgaggaggggacggctcgtggcggagatggcgagatgatggcgctggtgagaacagtggatgtggccgtggccggtggtttggccacgctcacgcacggcggcgagcgggatgctggcgcggcggtggcgacggaggagaagagaaatggcggcgaggtggggacgaagagggggatggaggagcgggccgcgcgttcgccgccgccgcccaagcggagcgcggtgtcctccgttcgccagcttcctccaggttgcggaagggacgccgctcttccactcgggcgccgccacggccgcggccgcgatggcgacggtggtgttcctcctctcgctggcaacagaactgatttgccgttggaagctgtggtggatggtggtgatccaattgcaaatgtgcatcaaatcttcagcaaatcttcgcatgctacggatgagaatcaggtcgcttgcaaagttggttcactggaggatgttgtacaagaaggggcagcaaatagtggtgaattgctggggtggaagcaagtgttagctcaagccgcgaatgtgcttcccaagaggaggatggtatccgcgacgcgccgcttccctcctggatgtgggagggacgttaagactggttcaggtttggaattcatggctgttgatgcttcttgtggtggtgtgtcaaaggaggtggtggcttcggatggcggtgatagtttggttagccaggaattggaggagggtgaggtggctgatgaggcatactctgatgtagattcacaaaatgttgctgtggatgattccatggctgcagctactgaagatgttaaggtgatgaacaaatgcaaagggaccttacccagagccgctgctgaaccttgtgctgagggtccttccaaagaacattttaagggtacgagggagtgtgaaaatgataggatgggaaaatcatccatgaatgttgcaacagaagtatttggtgattgtatgatgagaagtaagataccattgatagctagaaaagcagtcaagtcaccactgaacattctgcatagacgtcccttctctaagggaaaagaggagtgtgttgtaacaaatagtgctccatgtggtcctaagaagaagtttaaggtaaaaggtgcatatcaaactaaagatattcctatcaagattgtctctacacctggattagggggcaaggacaaccttgtcgacaaagaggctttgatcttggaagatgatgatattttgaaggcactagctgttcatgatggaacacttaagttgtatctcaatgcttcctcatctgtgcagcatcacgggcaacatggaagtgggaatgctgatgataggaggaaaaccatgatgctgtgcaggaggtttcagtttatacgccaggctcttgtacaagctgtcaaacagggctcgttgaaggttctaagagctgaccttgaagctgataaaatcgttcggaaattgccgggctttatcaaacctggacctattgtgggaaatgttcgtgttgtcgaagttggtgacgaatttctatacagagttgagctagcccttgttggtctccaccgtccataccagggaggaatcgataccgccgatcataatggagtgcttgttgctataagcatcgttgcttctggaggttatcccgatagattgtcaagttcaggtgaactcatatacactggttctggaggacagcctgctggtaagaagaaaagtgaggatcaaaagctagagaggggaaatcttgccttgaagaattgcatcaagacaaagacacctgtccgagtgattcatggattcaaaggccaaaatggcaaggatgacagttattcaagggctaaacaaatctcagcatttacttatgatgggttgtatcgtgtggtggattactggagagaaggtctaaaaggttctatggtcttcaaatacagactacaaagaattcatgctggtcgatgaggttgatcatctaaatcttttctagtaagcttattatttagtcttaacaaatgattcaggcagtaaatggtacaatgagattcttttctacaccatggatacttacgccaatctaaactctcttgcttgttaggtacagaatcaagatgtattttttttgtcctgggtgatataattagcttagaaggacaagaagttacatgggcctggttgaaggtatgttatagttgcagggtatctaaaggggacattttactgtacccctattggttatggtagtagtgtagtaggaagcagatcatctaaagctatggctattttagtcatgtacttcgttaaggtgaaggggcaatttagtcttccgattatcccaatcgaagcaaaacaggactcgttggtttgttagatcggcccaagcctcattctgcatctcgacgcacgacggccaaaccacagcgccgtccatatttgtatgcattttccagaggtatctttgcgataacaaccatgcaatcttagatatatttgtgaaaagaaaaaagtgcatgcattggaatataaccgtttcttgccttgtgcaaaagctaccacttctccttcagtgtgtacttggatcatagaaggtgacaccttcaaaatgcaccagacaagatgccagtaacaagaacatgagtatgtggattggattgtcaatcaccaaaacccctgaattcagctgtgcaccacagctgccgtgggttagctcgtataagagtgtgcccaaatatgaaaatcacactcatgaaaatcaaaatcatttctattaacaagatgcagtaaaatcatgacaacatcctgaagaaaatttggttagctgatagaagtcatagaacaaaatgtatttcaaaatatattccatcactgatttcaatttcaggagcccaatttttgtactaactatttaactgtaggaaagcttactataaaccaatgaaaaaaagaaagcattatatgatgacttgtctgaattacagaatatgtggcgtagttgtccacttacaaatgaattcatcaactaattgatctcaaggttattccagattgtagataggagcacatctcaagcttcaattaaaaatccatccaaaatacgaattgaaggacaaaagtgaccagaattaggaatgcatactctaatactctattctcaggagtcaggacagttagataacctgctggctgttgtgctggtagccttggcattttcaccttcacgtgtcaataaaaaagagtaaatatgactttcgtggagaattgcttgagtacagtgtacactggatgggatcacctatacatttgtcgacaaattctcttctaaaaatttgacaaatgaaattataggacaattgtgatgtaggctgtgtttagtttacaccaaaattggaagtttggttgaaattggaacgatgtgacgaaaaagttagaagtttgtgtgtgtaaagttttgatgtgatagaaaagttggaagtttgaagaattattttggaactaaacacggtggtaatttcactgtaactattataacttgtatgtaacttttaaaagtttcttcgtagtatactatttcggtgaaacggaagtcgtgggaacgaatcctctgacatatgtgtgtgttatttttttccttcctcacttgcacaaatcttgaaacaaatctaacggtccaaaattatgtgaaagttatgtataagttagactgtagttacatgcaagttacagtataattacatgtaagttacattataattacattacgattgttctgtattacatctgccaaatttttaggagaaaatttatcgacaaatgtatagcaaaattgttttgtaatatattgattagaaaattctcaatctcactcttcatagtatggttttgaatctcaagggtgatgttttccggtggcgaaaatgggcgtgaagtgtcgctcgaactcctggaaggggtgagagtcgaagcactagaacacatgcgcaagtacacggaaggcacttcggcaacctataacaagaaggttcgaccgatagaactccggcccggccatctcgtactatcctaacctatatttttccttcaaatttaaaatcgggtataggtagtgccggatcggataacatgtcacttgtgccgtatcacattccatattaatttctcgaaatcggatacatgaaagatttctatgtgcaattcatgcatattaaatatagaggggcaattaaagtaccaaaagagataaagcaagaaaacatttatgtaatattacctatgatattataaactagtgtaatcaatattttatcatgtttgtaggtgaacttataacagattttcatatatgtataataataatatgggaatacgagtggacacaacttttcccttattaaaacatatcttttacgaatttggattcgaacttggatagtatcgaatatccattttctctcccatgttcttgtgagcctcaggccaggcaggtggtcggaaaatgcccgtcccattttcgcccgtagtaagaactagaaaaaaaaatctgaatttacccctgaactattgacaccatccgagtaaccccataaattacaaaaccagacatatctacgcccctaaacttttcaaaccagacaacaaaacccctaactcaatccgaagcggtttggattttaggtgacatacatgtgttagtccaaacaacaaaaagtaataaaaaaatagtgggctcggtcagtctccctcctcgctttcgtccacttccatctctctctctctacccccaagtcctaacagaaaggagggaggtggcggaagctcagctgccggaggaagaccgtggcaaaggaggcgtcctcgggcatcgaggtgcatcatgacctcccgtggaggcggcggaggcgctagctagcacagagcacttgacgactttggtcttgcatcgatgcctcgacgcacgcgcgactgcttctaggatagatggtgatgtgctcgaaaatggctcaccaaagccatgatcttgatcacttggtggatctggaaggagcacattgtgcgtatcttcggcagagttcagcgccatggtgttgcagacctagtctagtgtgtggcggtagctattagcggtttaagaaccttgaggcggtcttgctttaagcggtatgagatggtcttaccttggcaaaactagtttcctgagattttatattctaaaatccttttaaaatctaacaaaatttagacggcgtccttcgaccgctcagtgaaaaaaactaaaaattatggtcgaagttttagaattggaccaaaattatctaaaacataaccaagtgagtacaaaatctattaggaaaacaagaggagtgttactatccctaaatagtatggtctccgtttcatattataagttgtttttattttttttctagtcaaacacttttggtttgatcaactttatagaaaaatatagtaacatctgcaacactaatttagtttaactaaatataatattaaatatattttggtaatatgtttgtcttgcgtaaactggatcaaacttaaacgactaagagcaggtacaataacagactataagccagctataaatatattttaaggagataaaagaggaaagataagagcagcgggctacagatttatagctagctacaacacagactccaagacacatgtgtgtatgatagatgagaccatatattgattgtgtagtatatgtttatatgtacttcctccgtttcaggttataagatattttgattttggccaaagtcaaatagctttaagtttaaccaaatttgtagaaaaaggtagtaacatttttaacacaagacaaatttattatgaaaatatattcaattattgatttgatgaaactaatttaatattataaatattattatattttctataaacttaatgaaacttaaaataatttgactttaaccaaagttaaaacgttttataatctaaaacggagggattaactattgtataaattggctattaagttaattattaatgatttagagccaatagtttactataccattaaacttgcactaatgatatcatgaaatgaaacggcgggagtagcagcagccgtttcagcagctaccatcgtagaacagcatcattgccacaataatgcccactaccagtctactaatttacgccgcagtaaatactcctactccaatgcaaacctcaccggtactatataaaacgagaaggcgccaggcgggttgcaagcaaacacacgacccacccgtcgttgggtcagccacgtgcaccgcgaccgagccggaccagtttggtctcggacagtcggacccgagtcaaccttcagcctctggtgcggcgtccgcccgccacgtgtcctcgcctcaccaatcatcacccatccttctcttctcggccccaccaactctctctctctctctctctctcgctgctcgcgcaaaaaccccaactgcgtcgccgtgctcgccgcctcgccgcctcggcctcgccgcgcgctctctcgccgcggtgtctggacgacgaggaggtgagtccgtacgcctcgcctctgtgttgttcttcgtgttcgctgcttcggttcgtcgtgttgtgatgtgatggcgtgttggatgatgtgtgtaacggctaatttggtgcgggttttttgggcttggtggtggtggtggtggtgatttgcagggcgggtggcggcggcggatggatcgctgggaggcgttgatcgccgccgccgcgcggcggagcgagccgcctagaaacgggtgggcggagtggggccggggcgggggcggcgacactcgcgcgacggcgatt

SEQ ID NO: 5628 - DNA, 831 bp, Oryza sativa
ggtggggaggaggggacgtggaagagtcatggtggagggggacgaggtgcggagcgcgcgggcgcggtggtggcgccgccgagggcagcggacgcggcggggacggggacggggacggggaggaacgcggtggccgtcaacggtggtgcggcggaggatggtaggaggacgcctctgtttctgttcgtcacctcctctgcttgggtttcgtcgaatgcctgggatgcgtgactgttaatttggtcctctttgtgttcagtggtggtgattgcatcagggcggcgatcggtgggcgagccgacgctggacgtctcggagatgctgctccaggcggcggagacatggagaagccggcgcacgcagcgcgaagcccgcccggacgcgcttccacctcgtcccgtcgccgcggatgggcgaggcggctcaggcgaggggaccagtagagcgcgggggcgcggcgaggaggggatgactcaagtggccgtggccggtggtttggccacgctcacgcacggcggcgagcgggatcctggcgcggcggtggcgacggaggagaagagaaatggcggcgaggtggggacgaagaaggggttggaggagcgggccgcgcgttcgccgccgccgctgccgccgcccaagcggagggcggtgtcggccgttcgccagtttcctccaggttgcggaagggacgccgctgttccactcgggcgccgccacggccgcggccgcaatgccgacggtggtgttcgtccgttggatcaggcgactgctcctcctctcgctggcagcaaaactgatttgccgttggaagctgtggtggatggtggtgat

SEQ ID NO: 5629 - DNA, 23122 bp, Oryza sativa
  unsure (1)..(23122): unsure at all n locations
aatatgaactggttatttcataaaagagtgtatacatcaattttatcagcattgggcagaaaaaaacctaactaattactttggcccaatcaaaaacctcaggatgagatgaaagagcaatctgcaatattatggtaacttggacgtataatttgacaaaaaaaattatattagagcaattacccataaaccataatagtcttctgaacattaaatcacaacatgaggtacaaaatagcctgaactgtggtttgcattcaggaaagaccaattaatgttatgaattaggaaataaatatacaaatctataatgctaacatcaagtaatgtaaatcttaattgatcatgatggtagaaaaactgaaaaaccatgctccgaaggtttaccttagtataagtagaagggtgaaggtcccttgcaaacagtacaaagtgcaaatttgacatcccctgcaactgaatttttaagaagaacttccatctacactgcagaaagccacaaactcatatattttggagtgcaaaatatctatatcattatctattttgaacaaatattgggcccgtaatattgctcttacctttacaaagaatcctcctgctagcatgaatgccatgattcatgactgtaactgaaggtacagtttttgccttttttttatatccaagagggtagctccaattgccaatcctaaattcctaatccctgcatattacttcctgggtcacagatttctaatttccaggtaatatataaatttaaagatgaactaaactaattgccagacaatataatatttgcatattaccttagctatatgatgtagaagctgaattatcctgagagtcgtcgttgaatccggcctagacgttggctcatcaacaatggtagattatgaaaactacctttcaaggcgaaatatttcatatatgatatggctcagcgaggatgacacgcaaggagtggggtgtgaccctcgtcgcgttccacctcgtcgccaaccacagaccacctcgcgaacatagaatatacaatgaaagattagcacttcatcgaactgctatttaaataaaaattagtgtaaatattagtttataacttaatgcaaagcttatttaaatgaaaattattctgttttacatactaaccttgcatcacatatctgtaatgttctttttaaactttcagcattcattgaccttgggcgcgcaatagctgtggaactgatctcagtaatgatgcccataatatttgcttgcatatgaaagtagaatagatcacagtcttataaggcaatgtacaaatagataaaatgaaaatattatagtaatatatcataccaacatagaatatgttttttatcaacaagagaggggatttcatggaaaggcgtcaatgaaaatgttatggcaggggaaatcaggtgggatgtcaatgcattcttctaaggttgtccatttactgaataaattcatgaagtcgtttgaaactggtttgtaagtcttgtttgcatctttaacaatgaacgactctatgtattagaccttcccttcatggatgagaggtttcagaacctcaattgcaactcggtatatctgaacatgaatgctattgccctacatatttttaataggatatactatattagtaatatgtttggtatactaatgtacacatacaataagaggcatatgagtagtgatttgataagtaccacttcatcaagtaagacaaggtctgcaggatgtttgtatcatcattgatcacgaaaatgccaaagtttagaaacccttgcgagaatctttttgtctgaatccccagggtaaagctgtgaaatgagcatgtgtgcaaaaagcataaacattttttttcgccaggagcataaacatttcagtatctaaatggagtaatgctatgcgatgaaaagcgatgataaaaagaacattacttacaattataagagccttatattgcaggaaatatatactatacaatactgtctaggtatctatttattataaaatgtatgtataaaagcattggggggggggggggtcttgttgacgaaaaacactacgtatcaagctgcgaagcctgcaacaacagtatatttgcattattatagtagctttggtaggaaaaaatgaaacacagtatgcagcaatgttgagagcagcaccgttgtcaacgtagcaggtagtatctcagtgtaaacaacctatagccctagattataatgaggggtattttttaccttgcaccataatcctttatctctcttaaataacttcctatatccctaattatattatggaatggagggaatattaaaatctgtggagactgttggaaacatagaagctcattgcatgagactgtcatatctgtactatgttcataagcttctcgtgtgaagtattttttacgacaaagcttacttttagagaatgataaaaagtttcatatttattttataaaagtttactaagaagagtacatgtagcatattttcgtatgctacatataacatattttccacatgttatatatattatctaaaaggaattctatacaaaattaattgttatctttaccgtcttcagatacatactatttttaatatattttaattttcccatgcataatattttctcatatgacaaagttataaacattagttatagttgcacaacaaattactatattatcaatggtagatattccacaccttccatgcccacgtgtaaattcaaccttccacaccaattaaacggtcacttgacgaaaaggatatatttggaagggaaatttttttcaaaattcagggtatgcaagtgagtgaataaaactcggagcatggaagtgatagcatatgatcttaagggaatacaatgatttttctttaaactgaaactgaccaccattaacatgattacggttacgagaagtgcttctatgctcctcgaaaaaaaacctgcacgaaaattaaatcacatcaatggctcagattaaaaggtgattactaggataaaccatcattagcaaggggcaattttgtcctggaagtaaaagcccacatccagcccaggccgatcgctccatcgatctgggaggttgacatggcaacagggctgggtggtgaagatcaccagatcggccggccatgtgcgaggaacgggaggggcgacgagctgtgcgggctgttgtcgttgcgctcggctttgagacgggttataggacgatgagatagaggaccagttctcgaagggtagtgtggaagcgacataccagatggagcatggccgcatccgctacggcggccgtccatgatgacacaaactcccggcgaaatactcgcttcttgtacctagcgaaaccttgatagaaatcccaacgattcaactgttttttgatttagtggttttcgtccttttcaaaagctgaaccttttggccgcttgacatgggtgttgcagatcttatcagaatatcattccaggtgcattgcgagggaatcgccatcgtgaatcgatcgatgagaggcggctgggtacgggatgggtatggatatgaacttttgcttcctggacgaaattgcccctcgctagtgaggtttatcctgttaatcactttttaatccagaccattgatgtgctttaatttttgtgcagttttttttattgagcatagaagcacttcttgttacgaagaaacatgcttatgtgatcttcagatgacatgcaatagttcttagattgaagaaatctgagagaattccatgtgagtatctttgaactgtgatgtatatataggagtacataccttttgcttgtacatttgaaacttagcctcggtgttctgctcctatttgtatcaagtcatatccacttctcgttacgaagcagaaactggtgctcttttatcaacttgtgaaggttaatatatcgctacaacggctagcatgttccaacagacattttgacccaaattaaatccattttcttttgttctgaaaattgatgttcagattgatgcctaacatgcagtggagatttcaattttactggtattctacctgtttaaatcttgcttatcccaaacagttcctctacgagagattttgattcactgttatcttccgtgacaaacaattacaggtgtacttacataacaagctgttctgaagcaggtcctgaagcatctctctgctgaattcgtgttgtttgcatatacggaactaaatgaaattccagatatgtttctgcatactatgctccacgaactaggaatccttaccacttcctctgaatgctttgatatataaaaaaaactgcatactttgatattcacttgattgtgcatcacacctgacactttacaacagcacaagtgatgaaagtaatgtttttcagaactgatacacctcaaactccctcagaagcactgtttaccaacctgaacttttacatgccaacacaaaggaattcagagctggtgcaacacaattttgttcttggcatcgagcatcgttcaacgatggtgaactgaacgtggcacacatcacagggcatccaatatgtaggagaatacttagcagtaacacaaagagaagtgacatgcatatgtataaatataaatcaaacacggggctttagacacggaaaacaaccaaattacacataatatacgcagatccaaagagagcagtgcaaagttactgaaacattggccccagagagtgaggttacagagtgcactcaaacacctaaaacaacatagcacgtcgctgctgctcttattgacttcctagctaaccccattgtcatgattaagggtaacaaactgaccattgccctatgcaagtaagatgatcaatgtccatctgccagtgaatctgagtacaagggaacatagggaagataatgcagtgtggaaacaactccaagctcacctatataatgcacttccctgctatccatttcataggatatcaatattccttcatttggcaaaacaaagaaaatgatattccgttccgggtgaatcgagacaacttagtagtcatgtccaaaatcttttctccttcttccaaatagatgtaaatggctgacagtgtgcttcaaggtccactgatcactgctgtagtcctgaagaacccatactgataagctgttatacagatcgtagcgatcggtatttacgaaatacagtcgaccttgagacagatctacgaacccgtcatcgacattgcagtcaggatcatcaagagtttgtggcattggaatggtcctccaagaattcccctccacatccaccactgcaaccacataccccatggtgatcaaatgcagcatcccgttgaagaacacgctcctccaatcatcaagcaccccgatttgatggccccaaccaatgtccttgtgactccacactccagtttcagatgaatagatctccagcgcgttgatagttgcatcaagttcaccatcatctgcttccccatccgcgttcgcgggattcttttccaccaactcgaacacatggaaatgggaggaggagaccgccggatcgaaccccaagtaggcaatctgtctcttgtcagaccttgcggattcaggcaggacgacccattgccgagtggcgtgattaaccactaggtaatcgaatctccgccggtaatcggaaatcctccagcagcggcagaggaggccgttgcaggaatcgaggaggtcgagggcgcggcaccggggaaggaagtggagcgaggggtcgaggaagagggggcggcgtagtggtcgaagaatccggcgatggcgccgtggaggtggtagcgagggaggcggtggtcggagtcggggtgggagatgacgcggcgccaccgccagcagacgcacttgaggccgcagagcgtcttgtagggcacgcgcgagaggacctcgacgaggaggtcgtcggtgaggttgtcgtccggcggcgggatcccctccctgcgcgcctccttggggggggggggggggggggcgcaagcgcgcgctcagggaacgaggttgttcatggggttggggcgcgtacgcgcgcgcgcgtcagtggggccccatgtccccatccccgcgcgcccccttttttttttcttttcctgttcgtactttttttttcgattttttcgcctccggacgcgtttttcctttttttttggccctttttttcgattatttttcaatcttttgcacatttctttataaatgtagaattgaaagtttataattttgactcttgacttgaaagttttcaaatttgagatgaaagtttcaaatctaatgttttaaatttgtgttgaaagtttcaaatttgagataaaaagttaaaagtttttaaatttttacttcaaaaattcaaatttaaggcaaaagttttcaaattttgacttcacgtatagatttatttttaattttttatttaaaaaatcttaaaaaaaatcttatcttaattatcgtcatatctaacactaatcggattagttattttattgtacgcgtttctggaaaaaaatcgcaaaaaagaaaaaaaactcacggtgcccaccaaactcacgcgcatgtaacgagggcccgccacgtggcacgcgcgcgacttctctaagtcgcaaagtcgcatgtacgcactaattagcaaaaccgagacatgacagttgcaatgttctcccaaatctaaacaattttgctctatattttatcggtaaattttctcccaaaatttattaaatgtaaatgtagtataattataatgaatttttttaagaaacaatacaaacgcgggcgaccacaatatgcgtgcactcaccgctatgagcacacgcacaccctaccctattaacctaaagttttctaattagcacgtagctaaaaatctggcgcgcaatttttgatgaggctgtttttttttttttttgcgctagcaatgacgtgcgccggattagaagaaaaaatcggataatcacggttttaattaatctttcattccttttaggaggtttgtttcttttttccttacaaaataaaaatctatacgtgaaatttaaaactttctatagaagaaaattaaatcacacctgtaatttaaaacgtccaactcaaaattttgaattttcaactcaaatttgaaaactttcaactcaaaatttaaactttcaagttaattttaaaaacgttcaactcgaatttgaaaactttcgatccaaatttttaaaactatcaactcgaattttgaaaacttttaagtaaaattgaaaactttcaagtaaaaatttgaaaacttccaactaaaatttggaaactttcaactcaatttggaaaactttcaactcaaattcaaaaaaactttcaacttaaaatttgaaaactttcaattcagatttgaaaactttcttggtcaagattttaaaacttttaatttgtgtgctggagattaaaaattttggaataaacgaaaaggaaaaaaagaaaacacgtcaggaaaagggagcgcaaaaaatggaaaaaaatatcaccaaaaaactacaagaaaacaagtcaagagaggggagcacaaaaaccacgtaaaaacatgtggacgcgatgggggcgctagctagcacgtgccagtccttttgttgacacgtatgcgcgggatagcaacccccacccccttcccccataaacacctccgatccccttcccccataaacacctccgaatgactggtccggcatatcttgagagttgagattgaaatatcaccacgggcaccttattgtcgatgggtacgtttctaccgctgaaagaataattagctgtaaatacgagcactcgtgtcaaaattaggatttgatgcaacttacatataattttaaatcgttaaatttaccttaagattcatgcaagttgggaaggaaaaaatcatagcgcacacgggtgaggagattcggtcttgtgctctctggttcgcgaaaatagcttgttaatagggttttttttttgaaagttatatacaagttgtatatttgtattgtagttatatgcaagttacaatatgattatactatatttatatctgttatttttttaaaaaaaacaagctaaatgctcgtgcgttgcaagggaattacaagtaaaattcaaaaggcaaaatataattattccctctctaatcatcatatcacatttggtataattttgtgtatatatgttgagctacacagttgctcatagtgatgaacaattgatataaattattcagagtgtttatagtgatgaacagtctatctatctattatatatattattaaggcaactaaaaaagaagccaccacgctcaatgtaaggctagaaatttccatattcatcacagtaaaagaaaaaaagttcaagcaaaaatacaatttagaaattaactaaaattcagaattaaaaataaagaaaatttgaagaaaatttcatataggacccaatacgagattaattaaaataaaatataaaataaaattttgaattagaaaaagaagagtttaaataaaaatgcaattagaaataaatgaaattcaaaattaataagttataatggaagacgagtccatatagaaacccactatgagattaattaaaattcaaaataattcattcataattgcaattttcataattgcagcactagtatagtgcagcctgcagacatttatgatcaacagtagagaaaaataattggcaatagataaaacgaaacaggttgatgaaatgatcaatcattattccatcattagctaccaaagtcaggatatatatacaacaactctaggcatctagaatatcaaaaatttccagtaaaaccactataatcggacacaaacagaacagttttaatagtttccattgtctagatgacacacattgttcaacgcaacaaggagacttatcaatgaacatcaacttagccatagccattgagttccactaacatgatcgatttcactagctaccacatgaaacattacagcaaagctaaaatgtacattttggaaatatacagtactgctaattggcgtctgacagaaaataataattcattatagccgagtataccctcgacatgttctacaattgtgatatctttcatgtgatttagcgttcaacagatcaaatattggaattttccttaacagtctaataaaaaggtgtagccttccttaactagttcatatcattccaacactgagaactaacataaactcccatgctaagcaaaacaaaaggtaggtaaggtagtctgactaaggaaaagaatccaacaaaaaaaaaaaagataaatagcataatgtgaaagcttaaacaatattgacgtgaataaacgcttcctcatgagggaataagcaatgtcaagaataaatttcttagacactaatcatgcatgactcaatggaaaatataaatatatgattatagcctataggatccatagttaaatggtaagtgctagagggttttagacactgtaaacaatcggataaacataatgtcatgcaagtccaaacagagttcaaagttactgaaacattggccccccataaagtgaggttactgatgacttaacttcaatgccataattaaagttaacaaactgagcattacgctatgcaattaagatgatcaatgtacatttgccagtgactccgagtacaagggaacatagggaagataatgccgtgtcaaaatatctccaagctcacatatataatgcacttccctgctatccatttcataggaaatgaatattccatcattcagtgaaaccaagaaaatgatattccgttttgggtgaatcgagacaactttgtcgtcatatccaaaatgctgtttgtcagttccaaatagatgtagatggctgacagtgtgcttcaaggtccactgatcactgctgtagtcctcaagaacccataccgataatttgtatagatcatcgcgatcggtatttacaaaacataggcaatcttgagacacatcaatgaatccatcatcaacaccataataaggatcaacaaaagtttctggcattggaatggtcctccaagaattcccctccacatccaccactgccaccacatcatccatggtgatcaaatgcagcatgcccttgaaaaatacgctcctccaaatatcaagcgtcctaattatgcagccccaaccattgttcctgtgaatccacactccagtttctgatgagtaaatttccaccgcaacgacatttccatcatggtcaccactcatacccatagcactatgctccaccaactcgaactcgaacacatggaaatgggacgaggagaccgctggatcaaaccccaagcgagcaatctgttccttgtgagtccagccagattcaggcaggacgatccattgttcggtggcaggattggccaccaggtaatcgaatctccggggatcggagagcctccggcggcggcagaggaggaggccattgcagatgtcgaggagccggagatcgccgcagtcgggaaggaaggggagcgaggggccgacgaagcggcctctgcctgagaagctgatgaaggatctgtggtcgaagaatccgacgacggcgtcgtggaggtgataccgcggcaggaggcggcggtggtcggggtcggagatgacgcggcgccaccgcctgcagacgcgcttggagcggcagagcgacttgtagggcacgcgcgagaggacctcgacgaggaggtcgtcggtgagcttctccgccgccggcgggatccacaccctagaatcctcctcctccgccatggctgcgcaagagagagatcagagaagcaaaagggatcacggcccgtttggttaggagggactgggtgtaaagagagatgagactatttaagtgttttgtttggtttggagacatgggaattttgatgggatggtgatggagaattgagtaaggaactccctcctttttaatacctgggtaggggcaggtaactgggaggaaattcctcctttactttttctaagcaaatctcagctatccgtttttattaatgacctaatctctaactaaactccctatcaatttctatcatctctaccaaacaagatattaggtttaaaaatcaaattcccatcttaatctcatcatcaattccctcgtgtaaattcccaatccccttctctcgagttatcaaacaagccgtcaggaaaaggacggcggcgcggcgagggctttgttgtggtgatcggccatacggtgtggggaatttcatctaatcccgatttttacggggaatcatattatgcgaaagaaaaggcgaaacaaggtatttacaaataaaaaaataatttataaataaatttttatataaatggtaacgattttaaaaaaggctgaaaaataaactacgatgaaaaaattccaaaatcaactctacatttaacgttagaaatttaaatgttttactaataagtataaacataattgaaaagatgaggagttttttttttattctgcactttagccctttggttatggggttttaccgaaacagataatatcactattaacaattatcgtacatgccatgagtttgatcaatggacaaagaaaccataaacccttccatgcgcacgcttcctatactattaaaatgtgtatttttttctgaaaagtttcgatataaaagttgttttaaaaaataatagcaatctattttttaaatttaaaataacaatatttctctcaaacactccaacttacttcctcgttttccgcgcgcacgtttctcaaactactagatgatgagtttttttgcgaaaaaaaatttctatacgaaagttgttttaaaatattatgttgactcatttttaaaaaatagttaatatttaattaatcacgcactaatggattatttcgtgttttgtgtatggggagttggggataggcacctcccgaacacgagaaatttggcattatgccatctttggaatggggtttcgctgaaatgtcattccggaacgtggcttcgttaaaataccactttcagacgatgccaacttactggaatgccattttctccattttacacgaattgtaaatgttttggcacatacactaatctttttgcgccttacctaagccgatgatgcctttgagctctgccgccgattgtagccgagtgaggaggacgggttgccatcggaataaagatggcgcatccggccgatgtcacctttgagctactccgctgtcgcggcgccggtttccgctgagcgagaaggagtggtatgggtcatgggagatgggtggtgttatggaggaggaaggtgaggaactgggacaatagccgccatcctgaccatagagcgaaccgagggggagactcgagttcgtcgggcttcctgtttctctcgccgccgttctgctttcccaacgctagagcggctcaacctttcactcatctcaccgtgggtgcacccgctcctctcctccatcccagtcctcgctcgccatctattgctgcgaccctaccaagcttgtcaacctcgccgcactgggagggctccctctgtcgcgtcaagctcgtgcgatggcaccagcgctgcctgagcctctaggcgtggatctagagccactgctataggcctgccattttctccaaggcacggggaggaggataatggcagtggtggctcgccggtgacggttcacataggaacgaaagggaagagatggaatctagagggtattttggttagcttgacaagaaaaatagggtaaaattcatgtgatttgataaaaaatggaagaaatagtagtagcatgttagccttgtttgaagatgacattctagggaagccaagcaatgtcaattttctcccccggagacagcctagtgcacagctgagagcatcctatttatcaacacaccctagccgtccattttccgtccctctcatcaacggccgtgatcaaacaccaacgctagtctccctctataaatcttcctcccccttccccatccaaaccctaaccccctccaaaaccctaaacctctccccctcacctgcggcggcggcggcggcggcgaagcacctcgtcggcacgacaccatgaggccaccgcgaggtaagcaaccacccgaaaccctaggattcatctcgcgctcgattccacttccacccttacacgatgctgttctgcgtcaggcaggggattcgggaggggaggaggagggagaggcgatggcggcggccgcggcggcggcggtgggaggggattcgggagggtcggggacagcggcgggagaggaggccgtggtgggaggggaggcaggacgccgaggggccgtggcggcggccgcggtggcggcgggaggggtggcatgaagggcgggagcaaggtggtcgtggtgccgcacaagcacgacggcgtgttcatcgccaaggccaaggaggacgcgctctgcaccaagaacatggtccccggcgagtccgtctatggcgagaagcgcatctccgtccaggtcctttgctcttactccctccatttttttttgcgttctacttatttagtgttttgctagaactgtagtatgattgtattgtactgtagcaagctgtaagatgttgcaatgttgattctatgcagtgtacacagattatgttcaaatcgtgctagaactgttaggataatttagtgcgctgtagaaagctgtaagatgttgcgcaatattgcttctttgtagtgtgatacaaagattgtgtacatgacgcttgtttctgttcatattgatctgttttattgtacatgactgttgtttctgcttttctgctatgtacagaatgaggatggaaccaaggttgaatacagggtgtggaatcccttccgttcaaagttggctgctgctgtgcttggtggtgttgacaacatctggattgtaagtttcttggttgaatccacgtgtgcaactttatgcttaagtggtttaaaatcactgtggtttgttaatgctgtagtataaaaaaatgcatcaagtgttaatgtttgcatcatgattttaggctcctggtacccgtgtgctgtatctcggtggtgcctcaggaacaaccgtgtctcatgtgtctgatattgttggaccggtgagatctcatttactgttctcatttattattcagtcacctaggtatgcaattttgccattcgctaatcaagtcattttgcagaccggtttggtctatgctgttgagttctcgcacaggagtggtagggatcttgtcaacatggccaaaaagaggaccaatgtaattcccatcattgaagatgctaggcacccggcgaggtaccggatgttggttggcatggttgatgttatcttctctgatgttgcccagccagatcaggtatacctttctcacaatgatttcatgatcttgaaaacgaccttagataatttattatatggttactagttagtattcattaagtgtgtgacaatggttttggtgacattctttgattacttgcgggctgcaaatgatgagcttactcggattccccttcaggacatcaaattggatgatgcagattcgagtttctgatgcattaaagcccattaccacctgttttttctttgctgtttttgcctgctttttaaactgtctttgttgtcagttttcttatgtctagctgtttatattccagtttatgtttaagcaacctccaacccagaagttctattcctacacacggagtagtattcttgtatgcttctgaagtacttaaattgtaacacgaagatgcattctttcttttgaaacacttctgttatatattttttgaatctatcctttttgaaattggttttcaattgttatgagttaaccatggctatggatttcttttggaagcgtttggtggccttgatgtcttttactaatttatagaattatttacagcacgagtatacctgcagttttgcttctatatggctgtgttatgcatatgaggactttgcatttcagtgccagcactacttactatgtccctatatcccttattatttaatattttgattgggcttagcatatgatgatcttactcggattccccttcaggacatcaaattggatgatgcaaattcgagtttccgatgcgctgtgcctccattatttcattcccttctctttgcattttatgagtattctgtacatcatatttggattgtgctagcaatttgccatatgcttggttgtttatactctctttagtatggtacaaccttcagcgatatgtgtgctttgttggtggctaatagtcatgtttttgactttttgcatattaattttcttgatattgtcttgttcttttttctgtaatatgtcagctttcctggtatagctttctctcctattgttattttgttagtctagtgctaattagaactattccagtacttgccgtactacatttcttaattctgtggcagtgtcggacattgatatgtttttgccttgtaacattgcttacaataattcatgtatgtttgctgctagagtctcggataaattgtctgcatataaaattccctttatggaatcttcttccatggccatgtcctttgttgaagatcttgaagattctcactgatttttgaaacctttcctatggaatcctctgtcctgcaggctaggatcttagccctcaatgcatcctacttcctgaagaatggtggacattttgtcatttcaatcaaggtacttttgtcttttctctcccctgaatcctgaagataatcaccttgattgaggttgagattggggagatattagatgtaatactaggtattggactgaaattgtttgaacaggcgaattgtatcgactccaccatgccagctgaggctgtgtttgctagtgaagttgagaagctgaaggcagatcagttcaagccctttgagcaggtgacgctggagcctttcgagcgtgaccatgcctgcgtcgttggtggttacaggatgcccaagaagcaaaagggtacatcttaagaagaataaaacttgtggttgtgagtgactggtgctaaaatgtagtgctgcacaaaacttttggtctaattgtttttcacttgcaccctggtttgtaaggctgaaatttttggacaaatgatgctaggagagaagtaaaaagtcactcaggttttgcactgccctttactgcaagttgcatcattattggtgctactaggggtgatacgctaatcaatagggatgaaattggtcaccgaaattcctcacagttcctgtttccgacagttagaccgttatcgtttttggccacatatatacaattttgatttttttttatgcgaacagtgaatattttaattgataaatatggtgaccgaccgagtgtctttatgacgacccccttcctaccatcaaaggttttcattttcgtcataaatcttgcgatgacttgccttttcattttatcagaattcttgcctcatcttctacttatcagctaaaatttaaattttcaaccttaaatttagctaaaatttaaattttttaccttaaatttagagctaattttaggggttttttttattaaagattatttttatcctttgcttttatattgttaaaaacatgtatataaaagttttattcataaattattatttttttacaaatacgccgttagcgaagcgaagtttctaattttcttgctctcaagtattataataagctaatgttataggtaacatttccatgcattgagagtataatgtggacgttaaaattatcgtgacatgtccatgctcaacgcattgagagtatagatcaacgctaatattaccggtaacatgttcatgcattgaaacgggcccttctgatttggatggtttgggagtattgatggaacctaaagcacgggattgagagcaatgtggtgggaggagggagcggaaggagaatgacttcacttttacgaaaaatattcaaccaacctttcgagaaaaataaaaaaaaatatcaactacgaacttagttcagttaggccttattttgttcccacatcaaaattttttcacccaatcacatgaatgtttggtcaaatatgtagtattaaatatgaaaaaaactaaatacatagtttgtgtgtaaattgcgagacaataagtctaactgcgccatgatttgacaatgtgttgttacagtaaacatttacaaatgatggattagattaattaggtttaataaattcgtctcgcagttttctggcgaaatctgtaatttgttttgttattagattacgtttaatacttcaaatatatgtccgtatatccgatgtgacaaacaaacccaaaaatttaccccaactaaacaaaccctaagtgaaatggttgctccaaaaaggaaacgggattcgctttttacattaaaaaactgctctgatccctgaaaaaaaactgcactgaactaatactccctacatccccaaacgtacgaaacagaggctgtgtttagtttctgaaattggggagaagtttggggaaagttggtagtttggaaaaaaaattgagagtttacgtgtgtaggaaagttttgaatgtaatgtgatgtgatggaaagttgggagttaggggaagtttagtgtgaactaaacacacccagaaaatgaaatctgaaaaataatttagcactcgagcaattttgttatgcgttttatttactttattattagcaacgtggattccacgtgcaagcatactatttgtgaagaaagtagtggatttgttaacaacatacttcctctagtttttttatgacgttggctagtttaaatttatactggtgaacgttacacatatatgcatggaggtagtatctttctgcctctacatgtgtcaacaatctttaatcaaacaaagtggattttgcttgctaactaaagattaaactttgggtcactcattgcttatgaaccaggccttgctacctcaactttggtcggttgggcttgtatattttgcttgtgatttggtgtttcagcatcggaaagaatgtatgttcttcaatgttggtatgtgatcgagttaaaatgcttttatagctgtaaatattgttgatgtatagcacgtgcattgttgttgtaaatcttaagagtggccagtgtaccgaagaagatccggcggtcacggcggcgaggcaaggaatttctggttgcggcgatgcgccgcacctatcgacgacaagcaaccatgcggtgcgggggactgagaatttgggtctgagctgaatttgttttaaaaagtctcaatttaggctcctcaaacaggggttgagtttggatagtatccctcatcaacgaaactggaatagagctgattagttgactgattatgacctgccagaggaggcatgggccagctctttggggtggcggcagggttcagcggcaagttcaaaagtcgaccgacggagagacgcagatgaggtgtggtagaggccacttgctgtcaatgcttgtgcagtggtttctgagttggtgggcgacaaattacaacgaaggttgtagggtttcatgcgaaagcatcgcccagtggatcactgggccggcaaaggctatgccttcgggtgtcgttaccccttagggcgccgctaagggtacctctctttattcttggcgagttttctttgggtgaaaaccacatctttctaagaatgtgggagatggcgacgtccttgatggcgtgacctacgtggtggcattgttttcggaatctcgtttctgtggtgttgttggaggtctggcgatgatcagccacgcatagcggggggtcattttggaatgctacacattctaatattgcgaattgacatgagacctcgtaatcctgacaggaggcttgttcgattaggatacaacacatcgtattactttgtgaatctagatatatcaattctattagtttattttgatacggacaaagtatccatgacactctgaaactctgctagtgttaagctccagaaacagagaatgcaaatgtcatgaacaaacaactcaagatgtatatgtgttgcaacttgtcaagtgaacagctgaaatactgagttgccttacattatatgctacgaatataattaaaatgttcaccgcaaaagaatgtaattggaatatatccgtataaataacatcccatagtatgtgtaacaacgacccctcaaacaaatgactaaaataacgggtgtcacaaaagaagaaaaaaattcacaatttacgctgctgggctggcttcttcgcaggcaaaataaggcttcacagttccatcgtatcagcagctagcgccagcactgaagtagctaataaacagtggcataacttagataaaaaaggtcttcatctacacaaaaagaagatcccattctagcccccctcaggtatttacacaagggggggtagaccttgattgattgaagttcatcttcgtaacggtgccgatcagcagttcacaccgcattgccccaaggcgacggctttctgagtaggcgaaatgaaaggatcgatcttgacccacagaagggagaagatcgacgcgaggaggatcgaccagacgatgacgatggtcggagtgcggttctgcctgcccatgagacccttgaggaaggggtagagatggaggatcacccagatggagaagaagagctttccaaagagaggaccccatgattggtaaccgctgttaatggcatatgatatacccgccaccatgcccaccaggttgatgacaagcacggtggtcgggggaatgaggagactggtccacttgaacacgtatagctcagcaaagtcaccatcctcatcggacgcctttgaggtaacagtgaagttggtatcaattcctgctaacactttcagaagaccttggaacacagcgaagagatgggcagatgtgccaccaatgacccagaactgttcatttctccaccagtcctcgataccaacaccactccatcggagctccagaataccagttgcgaaaatggaggcgaaaagcagaataaagaacatcccagcataattgctaatctgcatatgnnnntaaggtgtgatcagagaagttccaaaagggcagaanctcccaggnnnnnnnnnnngttttnntnaataannanccntnatgattagcaaaaggtattgttgattgtggtcataacaagtgctacaaaaacatgggggggtttaaaaaaaatttttttaaaaaaaaaaaaaaaatattcaatcccggaaattaacagaataagaaagtgaatggatatcctttgactaacctcaggaatgataaatttgttggtgaggagacagatagcaggaagcacacaataggcgataagtggaatggatgtaattggataaacaatggtgttaatgtaagccagcctctccagaagtttcaaacgcccattgtaaccataccagataggacaatgtctgctaagcagaatctcaacagacccaagagcccaacgtagcacttggttaagacgatcagacagattgattggcgcagaacccttgaagcatggccgtggtggcatgcaatagattgatatccaacctcttgcgtgcattttaaatccagtcagaatatcctcagtaactgaaccatagatccagccaatctgaaatcacattggaaaacaaaaaagttaacttctaggcttctatttctatacagaacaaggagtccacacccatgacttggcaagaagtagaacaaagatctctaggaagaaagagaaaattacgggttgccccactaacctcttttccccattcagttttgtcctcatatccacaactgataacatggatggcttccttcagtagagatgctgggttcgttgagggtggtatgcctccttgagtcatgaaggtggacgcaataaaaattggcgattgaccaaaacgtttctctaatctcttctgggacatcagcactgacctttcatcttcataacctaatgaattacaaaagcaatattagaggagggagccagcttgagtatctcaaaagtctgtgtaaacataagactagatagaagcataatgttgataacactaaatgcagtggttgttcataacataaaagataaaagatgaacaaagactagcacaaaccttcaatgccctcttctatatcttccatgttaaagataggagctgaagactctgttctcttcatcatacggtttttgctatccatgtagctcttgctctttttctttctgccaccacagcagctcttaacaacaatgttaggttccaaatcagcctcagttagtacaggatcatagccatacaaggcctgcctattgaagcagcaacctgttcccacataaactggaccctgaatgccatctaaacctttcatgttaatctgcaaagcagaaaagcatgtcagacatgaaaattttgatatgatggacaaacaaaggcaccattgtactcacatcaaagaagactatgttgcgattagcgtatcgatcgtgcaagtcaatgccatcaaatctttgtgggaactgaacataacaagttttccttcctagtgcgggatccatcatgaagcacattgcttctctaagagctttgctactgttgaagtagtgatcacaatccacattgagaagataggcaccatttgtcagcacagcagatacacgaatctgcccaccagaaataggggtatataagtattgggttgataaacttcagtgataaatttacagaattgaacacataccaatgcattcattgcaccagccttcttgtgatgctggaatcctggcctcttttcacgagagacgtagacaagccgtggcaactcgttaccatcagtgtcaagcccaccactgtgccccaagaacacctgtaatcaacataacaggagtttagtatacacgaacctgattaaattagaatcttaaaccactcccccattagaagtaaagatcacctgaatcatgccagggtgatcccttgggttattcccaggccaagcagtgccatcagccatggtccacccctcttcaggtactttttgtgccttcgcaacaagagcattgatccgtaccttgaattcttcatactctctctgaaacagagtatccaaagttaaatactcaggcacaatgcagattggcggtaatctaaccatgacagtagaagcttaccttcattgcccgcctttctttaacaaaggaaggttggattttgtccttcaggtaatctattttttgagcaaagtaaaactctggagctcgtggttcaatattgtgcttcttgcaaaacggaacccacttcctagcaaattctgcagtttctgacagagcctcaaaagttaacatagctgaaccatcgtcagaaacatagcatgacactttgtcaacagggtaatccacagccagaatggacaaaacagtgtttgctgtgatcagaggaggttcctttagtggatccaccgtactgacaaagacatcaatgggagcaagctgtgatggctctccctccctatcatatctgcaacattagattggacgcctcaggacacagaatatcaatgtaagagagtttcagtgccacgaccctgaaaaaatgtatatcaagtatctcatcttacctcaatgcaagcctgtcaaggtatgtttcacggtttatcgggtaccactttgggaattgatctaggagccaggataaggcaaaccaaatttcacagataacagatactagccacaatccataagcatcccgcactggatgagtgacacgatattggaagaagaacatcaggatgataagacggagaatgataacaatccggtaaaggttgagctggtttgaagggataggcactatgcggctcagaggtagacgtgcatcatcaaccctgtgaaagacaattacagaaagatcaatatacttgaagcaatatatacaatatacatcaaactgcagtagtggtaaagcatagtcaatgaaaatctatatcctgatcaaactcagaggtataaaactatctaataagt

SEQ ID NO: 5630 - DNA, 5963 bp, Oryza sativa
tttttgggtgtctgatgtgaatttctataatgcaaagatacgtatctaaatccactgcaaagcagcgtgtataatataaggataggttgtccatacatttgcatatcttcaccatttgaaccagtcccttccatgtctccccctcttgcctctggatatttattagctacctgcatcatatttttgtcctgcttgttcctccagctggcaactctttcttgccagtcaacactgttaatcccataggaattcaagtccttggaggggtccacaatcctcacaggaactggaatcataatagagaaatgttagcactttccaaaccaatgtttttcccaaggagcaatttatgatgagtaagaaaagtacctggaacacttggatcaacatagcttgatgttccgctgcggatagaatggcgatcgggggaagcatcagggatctctcctgagatctgaatgaaaatatcagtttgtcagtacccaagagcacagcattcttacagaaacaagttcactgatacaagtgagaacttatatcatgttaaactgtacctgttgcccacttgtcagacggggaatccgatgttgttcgtggcgagaagatgaagacaggtcaacatcttccccctgtctctgtatctgccactctggacctttgccattgccatgcttataattgaattcattgtccaggtcatcaacatcttcctcctcctcatcgccctgaactctagggctacctgcattttgtccaaggcggcaaaacaatcacagtatacatcaatcatttgtctttatggaataaaagacagagttggtagtctaattttatatgtggatacatagatatgaagcaagaatcaaacatgaacttagtaatgatatattatatgacatataaataatagaacagttgtacagaaaccaacctttgtgcctcttgtatctagtcttgcactgggggcagcactggttcccttccttgcgctcgtactcgtagcaagggcggcagaccgggaaggcgcactcattgcaggcaacaaagacgtcgccggtggccgagacgccaacagtgtcgccacaaatctggcagacctgaccattcacactcttccctggcttagcctgcatcaagcaagaaaacgacagttagtacatgcccaaacggaactacagaactattagtaattaatcactaactaaagaaccatctgcttcgcttcaagtcgaaaccaaggtcctaaagctagaaatggaggagctctacaaaagctgggcatgaattccacagttctaatgattcagcctctgcgtcatcagtactaaccaagctgagatctaacacatcaatggcacctcaaatgctacccgcgaagcctagactggggaattccgggagctgcattgctctagctaaatccctacaattccacaaccaccggacatttcctcacatgaggattactcactaacaattccacacaggaggacactacaatcgcccgcgccaaatgcacatagggaaaactgcgggggaaaatccccgagcccagcacaaaaaaacaaacgcaattttgcggggattcgattcgagagatgcgcacccaacaccacactcactccctctcccctcaccccagatccaccaccgacacgctctcatgtcgctcgctcatcgcacgcacgcacgtaccggcggtggcgcgtcgccgtcggggcggatcatgacgaactcgttccggttgcgggatcccgccaccatccccgcgttcgccgccatcctcctccccttcctcctcctcctccactcacagcgagaaacggctacgcagctagcagatccgcgcgcgcgcggcaagcctagatcgcggcggccgccggcgacaccaccattcgccgctccgcctccagatctgcagcgccgcctcctccactcccctcctcctcttcagctcgcgctccactacttcctctcgcctcctcgtcttctcttcttacatacgcgagacacgctcgggttggtttcgcttcagttggtgggagtctcgccaccggctaccgccggtcacccggctcgcctcctggccgtcggatgagatgagggggagatatctcggccgtcggatgaggggtggagctgggcacaggctgtcacccgctgacggggtgggcccgggtgaccggcggtagcgggtggatctgtcggcgcctcggcggtggacgggaatgccctcctacctgccgctactcttttttttttgtggtgttttttggaggtaggaaagggggaaagaaatgtggcatgtgcagcaagcgtgtaacatgtgagttggcatcaaatcgatggtgctgtgattggtggatcgaaattatatggtgagaattatttgcattgccaagcattctgtgatatttgcagggaagttaattcaattcttaattataaaaacattgagaacttatgtttctcgaatagcagatgtaatttgtgtattggtctagttttctgcaatgtttttccgttctaaacatgttttgttttaatttgccacagtatatataacacttattttgctgacgtggacaagagaaaatagttgtttcttcatggagaagatatacctcgagcacatgacaggaaaatatgagaaaaattaaagaggaataatattaagtgcaacattgttagttgttttgcataccagcttttaagtagttttctcctatatcatcaataatattacaagtttgaatattctcaatgctttggattgtcattcttaaccaaggttgatgctaacttaagcttgtgcataatatagacttggtgcattatttgaaaatggaaagaggacctggttaggggctcgaggattgaaaaaagaagtgcattattcacatgattaaaactattcctcttctgatttaggggtaagcaatatcttatattaatttgtttgcactccctgaatcgattaataaatcttttatagaacctgctgtgcttagagtacctaacactcctcccaggaaactaattttcttcttgccgtttcatcgaccgacaaatgcaacgttttggcacacatcattacggttttccaccttaccttgggatttataacaaacaacaagattgtagttctttttacttatttacaccataagcgtatagtacatgctatgcaatttttatttaaatttacagcaactaatatataaaatcactaaaataaaagtccctggctctctttactccacatcccatatagatagctactgaactcccctttgttttcatcattgcacctcaaagattcacaaactgaacataattaatttgtgatgccagatgtagattaattaagcatgcattaagaggaaaaaaaatcagaccagattatagggagcctgtcactccaaagttaacaagaacaaatgagatgtgctgacttgtgctttgcaataagcacactgtcaggtaaaccgttcttgtcccaataatggcggttgggctgccactgtcctgcccgtcggtggcctcttttctttattgttacttgcaataatcactaatatatattttttctccttctctctctctgtaatctctcctagtttctttttgttcctctaaccaaattggaatcttcacatcgcatgcatggaaaatgatttgccatcggcttgatggtgctgctgtatttctgttacactgttcgacacgaaaacttcagtttggtttggtactgttgttgttcatcataaaccctcacttattttacttcttttttaaaaaaataataaaaatgggttacatctccggcctctgtccataggcatacagctaaaaaatacatctcacttattttacttctaggatgcagtaacaaatacatagtagaaagtgtttttttttaaaaaaaaaaactagttgcaagccatgtagcagtgaagtcaaagaaactgactaaacatgacaaaaaaatttctcttaacttgctaaaatctatctggtgatttgtgaggaacagcatggaggttcaggctctactttgtctgcctcttttgcccttgattacaacagtggtactacgtactgtagtggctgggattatgctgcaacaactaattgaagtattaaaacgagtgttgctcttgcctgcagcctggttgatggtctagtctaattaacccgtggattagtattagtcctgtcgattattagctgtcttgaggccaggggcagcaaccaccgctggtgacgctaacgtgtctctgcaccgctggtcacatgcgaagttggggcaaaaaaaaaaaaaatcaagggcagaaacgcaacgtgggggaatattcagagttgtctcgtgtacgtactctactactctctgaagaacagaactggacagtgtacagaacggtcagcatccagttaagttaactgtttgtacgcagaactgaagaggaatttcttcgagcatgttgctgtaactaattcttgcgtgtgtatccccagagatctgtgtatttttgtttagaagaagaataagagagggagaaaaaaaaagagtggtcatcggtttgattttgagtagggtatataaactggcaagcagtttctctgtgtgatgatttttcatttaatttaagtttatgtgattcagtttccttctctagttctcttgagtcgtcacaagaaaataatttggaaagagaacggaagcaaagcagagaagacgaaggcctcatttgtccttgcttagatggaccgttgcttagatggaccgtgattttagcttatgaccctgaattaggaataagtccaccttgacccccttcattggtggtcgaatctaattcctatctctgaaccacagtatcggatctttaggtcccccactattaaaactagtgtaatttaattcgcttggtagttttgcaggccggttgcgctgacgtggcgtctatttggcgggtgttgacatgatcttcgtcccagcccccaggtggcgtcgacgtgccgctttagctcccaccccctacagacgggtgatggggagagagagaagggaaagagacaaaggaaaaaggaaggagagaatgggtcccacagaattttaaaattctaataccacacaaagtgatgtgttaacgccatgtaggacgaagattatatcaacaccgtcacgttgttgccacatcagcaaaacagtcctccaaaaccgcaaggaagttaaattgcacctgttttaatagttgatgagttaacatatccggtattatggttggatacgaatcagattcggccactggttaagggagtcaaagtgaacttatattccgaaatgaaatgaaggaaatcttgaccagcccaacttggacccagggacaggcccaaggcccggcccacaaatcctcgtatcattatctcttggaataagttcaccggtggtccctcaacttaacagcgagatttgttgaggtcccttaaccataaaaccagaaatgtgtactcctaaacttacacaaaccgtgcacacaagatcctatggcagtatacatggccccacaaaagtgcgtggggcccacctgtcggctgcacatctatttccttttccttttcttctcttttctctcttctctcctcccttcttcgggccggcggcgggcggaatcagcgagcgccgatgcgagcggcgggcgagcgcggcaccacaacggctgtgagccgcgggcggagcgggcggagcggacggcgggccagcgttggctgttggacgggtggaacgccacggcccaacacgctagcagagacgcccccgccatggccgccgtgaccaggcatgcgtcgacggcgccggtgccggccaccttgctgccacgagcgcctgccgccaccggtggcttctcgtcgtcgtccatgccgtgtacgtggaattaaaggtgacaggaaaaaagaga

SEQ ID NO: 5631 - DNA, 2456 bp, Oryza sativa
cacccatgtatactgctataggaccttgtgtgcacggtttacgtaagtttagaggtacacatttctgattttatggataaaagaccttaaaaaatctcgctgttaagctgaggtaccatcggtgaacttattccttatctcttgtacagtttctacgaagcaagcatgacaactgacaaagatgcaaaattgaactgaccttcgcttgtttgggcatacaggccgtgtttagattcaaatttttttcttcaaactttcaacttttccgtcacattaaatatttggatacatgcatggagcattaaatatggacgaaaaaaaaccaattacacaatttgcatgtaaatcgcgaaacaaatcttttgagcctaattacgctatgatttgacaatgtgatgctacaataaacatttactaatgacagattaattgggcttaatagattcgtctcgcagtttacaggcggaatctataattagttttattattagtttacgtttaatacttcaaatgtgtgtccgtacacttaaaaaaaaattgtcacacgaactaaacacaaccaaagaatccaaaagtatttcactagttcatgcgccaagaggcaagaggactagtgtgttgtaccatgaaaacaatatcataactttccatcccaagaattttttttagcagaactagaatctcacttcagatcaaacaacagcagcagcagcagaggcagcaagatagtagaaatgaaaagggaaatgcaggctattttgttactccttcgagcaaagctggtcaaacaacaatgataaatgccgaccctaaactacatatatagccactctcacttgttagcaacctctcctagattctacccctaccacagtccacagtgcattccaacccctaaagcatgttataacaagagaaaacttaacatatcaagcagaaaacttgagatgtttttagcatagatgaaccagctgttatatatagttaccacttaccaacaaaaaaagaacatgttaaaaatcccaggaaacttttcatgattctagctgcccaatgcccactatgccttttcgtcttaggttcatatttttgttagcaacgcttctttaagtgttataggatgaacaatctattaaacggtacgtcaaaggcaatagtatttctaggaaaaaatcgcttgtacaataacatttcatggaactcgtacttgtcgatgatattttttaaattggacacttataaatggtatttcttgaattttctctccacaaaagcaacttcgctgagattgatcatgatgcctaggtgctgccaaaccaattgaatggtaggcaggaagaccaaaaggatatgctttattggacaaagatggtggaaatgaaactaacagacagacactttatttctcaatgaccgtgcacctctttttattttttcttatgcaaactatgcacatcaattagtaggatcatcatggattattgtgatcagaggctacatcagtacagtacatcaccacctaatgttttgaatccttattgggagtaggttgcatagttggaattgtctgtacctagggacaggtaaatagcaaggtcagtactaaaagacacctaattcctaaccacaacagaaggagagcacatcctcactttcactgacaggtggcgctcatgaccacacatcttttgacaaaacatggtctatataactgccttttattgctaaaattatctctgttcaccctaaagattggcctaccttgtcttataaacctggcactagcctactaggtgtaaagcagatcagataaaaatcgattaccactcatgagtcatttgccaagacctgaagaccctacctaactaattccacattatactctgtaatctgcacatgtactcttgtagtaatcgacacataatctaagcctgcatctgacacatgttgcaaatttctgactaagaaatgctctgcatatgcattttgctagcaaggtggatgaccatgaacaacattcagacaaacactagagcattttcgggtaaacagcactagcttatgtcagtaggaaagtttcctgtgtgcatcagctcacaaggtcacaaggatggttagcaggtcaggacttcatacaaataactcaactagccaactaggcataaaggaaatattagaagtaatgaatgatccatgtgttctatagagccaatatcttactatcagatgacagcactttaactattgttaaaactatcatgcaagacaaaccgccaggagttggtacttctactcagaagcaattggccatcatacaccaaaaaattaacgataaagaaataatgtaatccaaaaggttgactttgactcatcatatactaagtcatccatgcaatcacaatcatttatatgacaatccaaacatatccaaagtcatccatgaaaaatcgcgtaca

SEQ ID NO: 5632 - DNA, 624 bp, Oryza sativa
aatcacgtgacggcccaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgcttatcaccacccctggaggggttatgacagcaaagtactatagccctgccgtccctatagaaattcaggggattccttttccctcggatctgattcttctagacacaaagaacttggatgtgatccttgggatgaattggttggcccaattccaaggggtagtggattgcgcgagacgcactgtcactctgtaccgaggaccagaacaaccggttgttttctttgcacctccaacctcttgtcagaaggttcagaacttcatcagatagaactgtcagaaacccccatagtcagagagttcgcgagacgtgtttccggaagaactacctggtatgccgcccaagcgagagattgagttccggatagatcttgctccaggaaccactcctctgtacaagcgaccctaccgtatggcagcaaatgaactggccgaagttaagaaacagttg

SEQ ID NO: 5633 - DNA, 6748 bp, Oryza sativa
tgatcagagtataatctattcgaatagccgagccctcggttatgggcaagccgagcaatgtacccaagttagtgttttaattcttaaaacctgcttaacaactaaaatatggaatggttggcctgggttggcttaagacgagctgggacccagggtcgggttgccagttcggtctgaatcatcataggccttgggttaaggcaggttcgtgcgggttcacggccttgattaataacattgtttagttctaggatcgtgtttacaactagccctgagcaactaaatgtctttaaatgctgtttactgcaaccctaacccctctatgttataattcctttgtactcccttgcatttattctgcatttgtgggtgtgtcttgttgagtacggtggttgtactcagtcttgctaaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattctatttacgcttccgcttgttaaactctgaattgtatcaacttttggtgtaccttgcctcctgggacaaggattaatgcacgcacgtcaggaacacccgttgggttatttccggtcgtgacaagttggtatcagagcctcccttgaccctaggacgagccgtagatcccaagccttagcagtattttcaaaaataaaaatcctttgttatttgtgaaaactgtctagtctctctctgtcttgctgcttcatttatcgtcaaaatctgacctttgaaaatgttgtttttcttttgtttttgtttgtagatggccggcagcgtcacccgtcgtggtttgcacatgactggcttcgtcttggagctgcgaggcatgtgcgtggtcttagggtatccacatggagtggattactaggccaggccgctcccggagcaggagggtgaggatgcagagcctcacgctggttgggaggtcacagcagtgatcctctccggctctcccgagcggacttcgctggcagtcaccgcgggtggggattccttccccgccgcttgccagaacgccgctctcctcgccatcggcacccttcacccgcgctacccggacgagttgcagcactcgccctaccgctaccaccctcgtcgcggaggagcccgcgactacgccaccttccgggatgctagctcggaggatgacgctaccgtcgtgcatctggcacgcatggtggaggcgtacgacgcggctcgtatcgacttccatcagatggtgcgtcgtggcatggtggagaacaacctgaagatcctggagctgcgtcaggagaacctgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacttgcttcgtcgagacccctcgtgccgagcctgcgcccgtggttccccaggagggggaagcctccggcgttggtagctcggagggtgcgctgttgctcaccttccgccctggcccgtcgcagcggtagacgagcagttagtaggcttgcgcgtgtgtttttcctcgtttgtctttttgagttgtgtggggcatggttacaccggtgtgtggtgtaactatgtcggagcctgtcttattttatttgcctaagcaacttgaacattaatgaaccaatttaatagcagtgataaatttaagaataatggtagtcgtgggtggttagttttaattgttagctccttctctgtttgctggtcctgtgtggggtttttcagatggtgacgaccaggagaaatgttaacaccggtgaaggcaaccaacccgagggcagcaaccacaaccaccaaggcaatccacctccacctccacctccgcctccaccaccaccgccagacaccaacgccattctcacccaaatcctcgcccagcaagccaacatgatgaccgctttcctccaccacctccaaaacccgccacaacagaatgctccaccaccacctccccaacactctaaactcgccgagttcctccgcatccgcccacctaccttctccagctccaacaaccccgtggatgcgttggattggttgcatgccgtggggaagaagttagacacggtgcagtgcagcgatgaggagaaagtcgtcttcgccgcccatcagctgcagggacccgcatctctctggtgggaccacttccaggctacgcagccagagggacagccgattacttgggctcgcttcaccgccgccttccgaagaacccatgtgcccgccggagtcgtggccctcaagaaaagagaattccgagagttgaagcaaggcaaccgctccgtgatggagtatttgcacgagttcaacaacttggcccgttacgctccggaggatgtgcgggaagacgaggagaagcaggagaagttcttggcaggattggaccccgagctgtccgtccgtctagtctctggggactatccggattttcaacgactggtggacaagagcatccgcttggaagccaagcacaaggaactggagtcgcacaagcgccgcttggcgaatttccgcaatcaacagggtgctaaccagagggtccgctacaccaatccctacccagggggatcctcctcgcagcagcagcagcagcagcagcagcagcaacctcgctccgcgcctcgacctcaattcgtggtgcgcatcccacagccgcagcagcagcagggtcagcaagggactcgtgcgccccgtcctcctacgccagctgtgcagcccgttcaaggccgcagggacgctcaaggtcagcagcgtctgtgcttcaactgcttcgagcccgggcactttgcggataaatgcccgcagccaaggcgtcagcaaggccaagcgcctccccgctccaacaacggcgggaaggatgtcattcggggtcgtgtgaatcacgtgacggccgaggacgtgctgacaactccagacgtcatcgttggtacgttcctcgttcattccatccctgctacaattttgttcgactctggagcttcccactcgtttatatctgtgccattcgtggggagaaatcagttgggggtagaaaggcttagaaaccctctgcttatcaccacccctggaggggttatgacagcaaagtactatagccctgccgtccctatagaaattcaggggattccttttccctcggatctgattcttctagacacaaagaacttggatgtgatccttgggatgaattggttggcccaattccaaggggtagtggattgcgcgagacgcactgtcactctgtaccgaggaccagaacaaccggttgttttctttgcacctccaacctctgtcagaagttcagaacttcatcagatagaactgtcagaaacccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagttaagaaacagttggaagagttgaaaaaaaaggggtatatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatctgttcgaccagcttaaaggtgccactgtattctccaagattgatcttcgttccggatatcaccaattacgtattcgtgaagaagatattccgaagaccgcattcactacgcgatacgggctatatgaattcacggtgatgtcgttcggcttaaccaatgctcctgccttcttcatgaacttgatgaacaaagtgttcatggaatacttggataagttcgttgtggttttcatcgatgacattctgatatactcacaatcagaggaaaaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttgggtttggcaggatattaccggagattcatcgagaacttctccaaaatcgctcgacccatgacacagttgttgaagaaagaagagaaatttgtgtggagcccgcagtgcgagaaggcgttccaaactctcaaggaaaagctggtttcctcgccagtgttaatcttgccggatactcgcaaggatttcatggtgtattgtgatgcttcgcgccaaggattggggtgcgtgctcatgcaggacggtcatgtggtagcctatgcttcacgtcagctacgacctcatgaaggcaactaccctacacatgacttggagttagcagcggtggttcatgctctaaaaatctggcggcactatctcattgggaaccgctgtgaaatatatactgatcacaagagcttgaaatacatcttcacccagtcggatctgaatcttcggcaaaggagatggttagaactcatcaaggattatgatgtgggaattcactatcatcctggtaaggctaacgtggttgccgacgctctaagtcggaagagccactgcaacactctcaacgtccgaggcattccacccgagcttaatcaacagatggaagccctgaacctaagcatagttggtcgcggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggccttccaaaaacccaaggtggatatgattctatatgggtaatagtggatcgattaaccaaggtggctcgatttattcctgtaaagaccacctatggagggaataaactagcggagctctacttcgctagggtcgtgagtctccatggcgttcccaagaaaatcgtatctgataggggaagccaattcacctctcacttttggaagaagctccaagaagagcttggtacccgactaaatttcagcaccgcgtatcacccgcagacagatggacagaccgagcgtctaaatcagatcttagaagatatgcttcgcgcatgtgtcctagattttgggaagacttgggataagagtctcccctatgccgagttctcctacaataacagctaccaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacttggaattcacagtggatgattttgtgtatcttcgggtcacgccattgcgaggtgtacacaggtttcagacgaaagggaagcttgcacctcggtatgtgggtcctttccgtatcgctgctcgacgcggagaagttgcttaccagctggagttgcccgcctccttgggtaacatgcatgatgtgtttcatgtgtcgcaactcaagaaatgtctccgagtgccatccgagcaggccaactcagagcaaattgaagttcgcgaagatttgacctacgtggagaggccagtaaaaatcctggacaccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaagaataattaaaattcatgagaaagcctccaacaattaaaatgtgcaaagataaaagtcaaatgaggcttggaggatttttgtatgtttcctaaaagcctaaaatgcttaaataaattttagtggaattttcagagcacaaataataatagaaaagaaataaacaaagtaaaaaggttttataaaaagaaaaccctaaaagaagttctttttcccccccccccttccctcttgg

SEQ ID NO: 5634 - DNA, 617 bp, Oryza sativa
aactagccctgagcaactaaatgtctttaaatgctgtttactgcaaccctaacccctctatgttataattcctttgtactcccttgcatttattctgcatttgtgggtgtgtcttgttgagtacggtggttgtactcagtcttgctaaattttcccaagcccagatgaggagttcctggaagatgaaggctttggtgtctagctcgtgcctgccgtcaagcgcctgtggtcgtcgccctagtcttccgctgtttttcgttgtctttgagtgtgctgggccttcgttgcccatgtaataattctatttacgcttccgcttgttaaactctgaattgtatcaacttttggtgtaccttgcctcctgggacaaggattaatgcacgcacgtcaggaacacccgttgggttatttccggtcgtgacacctgcgtaccattactgggttagcgagccactcggggtggaggacttccctgatgaagccagctttgagaagtttgtcgaattcttctcgtatggcttgttttcgctcgggtgcgaatctctgtagtttttgtttaactggcttgccatcgggtcgcaccatcaatttgtgctcaatcacctctctaggatttc

SEQ ID NO: 5635 - DNA, 8912 bp, Oryza sativa
agcttcctgttgaaatatttacttgctttatatcttaaaaagagtgtatcggagtataagccgtacacgctagatctatctgatcggctatgctgtaaacgtctataatctcattgttaatatatattccgatctaagtgatttatattgtctcggcatggcgaccgatctatcccaatcacttgatttaagtatatatcgacataaagattatatactgttaatatctatagccaatcgagtagatttagttttaatttacttattaacaactgccgatcgattaacatatgacatcggctcaaatataaatgatatgtcatcggcgactggccgatcggctatcatttatggatttaaccgcggtttctttgtctattatttcttgttgattgcaggatcaaatcaactggcacgctgacaaacctaaaaggcaagattttggatctgcactggagttaagcagatctcccaggcctcgtatttttattatcaacacgcttttggcacgcccggtgggaccgagtttcgacaacatcttctgctgagaaagcaccacagtcactggcaacaaaaccggtgatccctcctcagagcaagattccaaagcccacaggaactagtgagtctgaggttaatgaaggaaacattattccgatcactgtagacaagctttcaccagaacaaaagaaggagtttgaattgatgatgaaacatacgcaacaacaattcatgaactcattaacagaaaccaaacaaggaaaagtcattcaaaagtataagctgaaactagtagctgatatgcctggaatgggttcgtcaaaagatggtgacactcaagcagctaaaggtagtacaaacgattcgggtgataaaggcacataccctaaggatggtgaagttggagttgtaggagatggcagtgaagaacaattgcagtttaacaacttccaggaccagattgactatgctgtgcaacatgctttgatcaaccaatctggagtacttgttaatactttaacaaatatggtgaagactgttgtcaatggtacaatagccgagcaccaagccacggggccagtttatctaccaggtggtgttttcccaaactacaggcctttggtcacaggtaactagcaggatgcttccaatataccgccagttcagccgacggcaccggtttcaacccctgcacaagctgcaccatcgtcggcacctaggcagatggttaatcctcgattgttgaccagggaacagccacagcatgttgggcaaaatatcaatcgactgactcaggagcatgttgctgcgatgtttttaccaactccgacaacagccgacccagtacagtcattgccgattcaacaaacaccacagaggcaacagacggttcagccgattcaatagcagaatgcaacatacatcagcaaggttgagaacacctgataatcggcaagtacagcacgtggtcaaccaggttgttcctgagcacttggttcataatgtgcagccagatcaatcggttgtagcccaagttattcctgagcatttggtacgtaatatacagccaaatttccagaactatcagggaggtaacttgaattatcagtatcagcctccatcgccccatgtccagcatcagcaaggtggatcacctcaactgcagacgttgccgcaatttaaccagtttgctcctcaacttaatcagttcgagccgattcagcagcatgtgcaaggagtacctcagcagaggccttgggctgatatgattgcagatgtgatgagggagcagtttggactcaagccaaaggacactggaaacttatatcgtcatccttaccctgagtggtttgaaagggttccattgcctagccgatacaaggtcccagatttctctaagttttcagggcaggataatgtttcaacttatgaacatatcagccgatttttggctcaatgtggtgaagcatcggctattgacaccttgagagttaggttgtttcctttatctttgtccggatcggcgttcacatggtttttcttctctaccatataactctgtcaatagttgggccgatttggagaaacagtttcacaactatttttacagtggaatacatgagatgaagttattagatctaacggcaataaggcaaagacatgatgagtctgtgcaagattatatccagagattcagggagatgaggaataggtgttatagtttgtctttgactaattctcagctagccgatctggcttttcagggtttgatagcaccgattaaggagaaattttcatcccaggatttcgagagtctatcacatcttgcacagaaggtaacttttcatgagcaacgatttgctgaagctaagaagaatttcaagaagatcaatcatgtatatccctatatatatgattctgaagaggatgatgattccgaagtatcagcagccgaatgggtcaggagcaagaaagtcataccatgccaatgggtgaggagttctggaaaagaggaaaggtttgactttgatattaccaaggctgacaagatttttgatttgttgcttcgggagaaatagattcaacttcctgctggtcatataattccatcggctgaggaactaggaaagagaaaatattgcaagtggcataattctggttctcattctactaatgattgcaaggttttcaggcagcaaatccaggcggccattgaagggggaaaggtcaaatttgatgactcaaagaagccgatgaaggttgatggtaatcctttccctattaacatggtacatacttctgggaggacagccgatggggggaagaatcaatgttttcagatgaattcagctagaattatcaacaagtatcaaagaaagtatgacaagcagcaggagaggtattgtgaagaagatgatggtggatttgatcctcattgggactgtgagtttttcagattctgttggaacaaaggcatgaggctaccatcaattgaagattgccctgggtgcagtgataatacaggaagttcaagccgatccaacaatagaggtaatcggctaggtcataaaagggtgtctgttcatcagaggttgggcccggttaatcaagattgctaccaggatgacgatgaggataggaagactcagtggtgtccttctggtattttcacaaagaatcaaaagagaagggttcaaaggttgaggaatagagaacgcttccaggaggtgcaacaagagattaatcatcagctgaggaaaacaaagaccaagcaggagtggcgtgttaagagcgcggttacaacagccgatgaagttgaagctaacaaggcgagaagattgcttaagggtaaggctactgcatctgcatcggtgaatatgatttttatgctacctgcagaatttgaagctaggcaagccgatgttgatgacgttgaagaagtttctgctagattggttttgtcaccagaacaagcgatttttgagaagccagaagggacagaaaatcggcatctcaagccattgtatatcaatggatttgttaatgggaagccgatgtccaagatgatggttgatggaggagctgctgtgaatttgatgccatatgctacattcagaaagttgggcagaaatccagataatcttaccaagactaacatggttctcaaggattttggtggcaattcgtcagagactaaaggagttttgaatgtggagctgacagtcgagtaaaactgttcctacaacatttttttgtcatcgatgggaagggttcctatagcctgttgcttggaagggattggattcacacaaattgttgtattccttcgaccatgcaccagtgcttgattcaatggcaaggtgacaaggttgagatcgtgccagccgacatgtcagttaacgttgctagtgccaatttagctctttgggagatggatggtattgattgcctgtctggaaaagtttgggatggagattttctaaaagtgtccgattgtgatatacagctaattgaagatggagagcccaaattattatgttgagggcgtcttggagggttcaaacgtctacaccaaggacacagtagatgatctcgatgacaagcaaggagagggtttcatgtcagctgatgatttggaggaaattgacattggtccaggagatagaccaaggccgacattcattagtaagaatttatctccagaattcagaaccaagttgatagagcttttaaaggagtacagagattgcttcgcttgggaatattttgagatgccaggactcagccgatcgattgtcgaacatcggcttcctatcaaaccaggggttagaccatatcagcagccaccaaagagatgtaaagccgatatgctcgatgctgtcaaggctgaggttgcacgattatatgatgctggcttcatacgtccatgctggtatgccgaatgggtttctaatatagttccagttatcaagaaaattggcaaagtcagggtgtgcattgattttcgggatttaaacaaggctaccctaaaggatgagtacccaatgccgattgctgatcagttggttgatgctgcttcagggcataagatattaagttttatggatggcaatgcaggttacaatcaaatctttatggcagaagaagatattcataagacagctttcaggtgtcttggtgcaatcggcttgtttgagtgggttgtgatgactttcagcttgaagagtgctggggctacatatcagcgggccatgaattacatattccatgatctgatcggctggttggttgaggtttatattgatgatgtggttgtcaagtcaaaggaaatagaaaatcacataaccgatttgaggaaggtttttgagagaactaggaagtatggcttgaagatgaacccaacaaaatgtgcttttggtgtatcagctggacagttcttgggatttcttgttcatgggagggggattgaggtaactcaaaggagtgttaatgcaattcagaagatttaacctccggaggacaagaagaagttgcaggagttgatcggcaagataaatttcattagaaggtttatctctaatttatctggaagattagagccttttacacctttgttgagattgaaagccgatcaaaagttcacttggggggcagagcaacagaaggctttggataatatcaagaaatatcttagttccccgccagttttgatatctccacaaaagggggcaccgttcaagttatatttgtcggctggtgagaagtcaatcggctcggttttgattcaagagctcaaagggaaggagagggctatattttatttaagccgaaggcttttggacgcagaaacgaggtattctcccgtggagaagttatgtttgtatttatatttctcctgtacaaaattaaggcattatctattatccaatgaatgcactgtggtatgtaaagccgatgtggttaagtacatgctgttggctccaattttgaaaggaagggttggaaagtggatatttgctttaacggaatttgattttcggtatgagtcaccgaaggcgattaaggggacaagctatagccgattttattgtagatcatcgtgatgactcaatcggctcagttgacattgtgccttagactttattttttgatggatcagtgtgcactcatggttgtggtatcggcttggttatcatttcccctcagggggcaagtttcaagtttgcctatactattaagccatatgcaactaacaatcaggctgagtatgaagcagttctcaaggggttgcaattgcttaaggaagctgaagccgatgctatcaaaattatgggtgattctttgttggtgatcagtcaattagcaggagaatatgaatgtaagaatgatacattgatggtctacaatgagaagtgccgagagtagatggatggatttcggctggtaactttaaagcatatgtctcgggagcagaatgttgaagctaatgatttggctcagggggcatcagggttcaagccaatggtgaaggatgtcaaagtagaagtcgccacaatatcagccgatgattggaggtatgatgtgtatcaatatttgcagaatccatctcaagtggtttctcggaaattgcgctataaagctttgaaatataccttgttggatgatgagttatatcatcgaacggttgatggggtgctgcttaagtgtttgagtaccgatcaagccaaggttgcgataggcgaggtaaatgaagggatttgtggtactcatcaatcagctcacaagatgaagtggttgcttcggcgtgcagggtatttttgatcgacaatgttggaagattgttttagatactacaagggatgtcaagattgtcagaaatttggagcaattcaaagagcaccaacgtcggctatgaatcctattatcaagccatggccattcagaggatggggtatggatatgatcggccaaattaatccaccctccagcaaggggcataagtttatattggttgtaactgattagttcaccaagtgggtagaagctattcccttgaagaaggttgattcaggagatgctgtacaatttgtcaaagagcacataatctaccgatttggtattcaccaaactattacaactgactagggatcaatctttgtatccgaatagtttgttcagtttgctgatagcatgggtatcaagttgttgaattcttctccatattatgcacaagctaatgggcaagccgaggcgtctaacaagagtttgatcaagttggttaaaagaaagatttctgattatcctcggtaatggcatacacgactggctgaagcattatggtcttatcggatgacttgtcatggatcaattcaagttcctccttataagctcgtttatggacatgaggcagttttaccttgggaaattagaatcagctcgagaaggacggagttacagaatgaattgacagctgatgaatattataacctcatggctgatgaaaaggaggacttggttcaatcaagattgagagctcttgcaaaggttaccagggataaggaaagggttgctcggcattataacaagaaagtggtgcctaaatctttttctgaaggggagcttgtttggaagttaactttgctgataggaactcgagataaaaaattcgacaagtggtcgccgaattgggaatgaccgtttcaaattcataaggttgtgtccaagggagcttacatgttgcaaggacttgatggtgaagtttatggatgagcacttaatggtaaatacttgaagaaatattacacaagtgtttggattaattcatgatcggctgagtttgccgatgcatgtaatgccgatgtagttgacatcgcctttagatggccgatacaaattgtatcgcccttagcagttttaaaacatgatcggttgtgtttttccacctatggtttttgtcttaaactcaaactggtttttggagttcagggtcattggattggccgaagaagtgatatctaaaccagtgatcatggtgatgtctagcagagtgtgggtcatcggcccttgattgaacatgaaggcattaagagtgttggaccagaaataagctgcagaagccatcagaggttcatctttagccgaattttctattgtgagagcaagcgcttggccgattcctagttcatcccaatgaacctgcttgctagccgatacacgcttgtaccatacgggtcataacgacaaccagtctcccgctcccggtcgagatcgaggacgagatcatcattcgacaagcaaggctcctcaaccaagcgacccctcgtcctcgtcatcatccttgtcagactagcctccccgacgatgtcagcatcgcgggctaccttttgctctagagggtggatgcagggcattcatgcccgaactccaggatgtacggtggcccgagaaattccgactgggagcaatagagaaatacgatggaagtacacacccagaagaatttctgcaagtctactctacggttttctatgccgctggtgcagatgatgttagcgaccaaatttggtaatttcagtatcggagatgaaaataaaaccgaagcggaatcaaagaggtagatcgttccagaaaaagagcaagattcggctgaagtccaaatcggctacgaccaaagtcggcagagttcgagtcggacaaggtagtcgattcagctgaatcagacaatgtgactcagtatacgtcatcgggctgagttaatgtgcttcatatggattgccacacacggattcggtcctgaaacgacaattgtatctattaattaggatattctatgtaatttccttagagataagtttgggcaaaagtttgccgcaaagacttatggtatcttagagtttgttagagataagagtcgtgtccaacatagacatattttgtaatctcgggtataaatagaccccgagccccatgtaatcaattaacacacgttcaatacaatctcggcgcatcaccaccttttactttcgttttgttttcaatgagttcttgcttttgggttgagctgcatcgggttcgatcttcaactataggtaaaacttgttatggcggcttgcgttctcgagattagtgcttccatctttatgacactctaatctcgtttatgtaagttgttgagttatcatatatcttatataatctctggcaatatcattatttaaccttctatcggctagcatatactcctagaagacagccgaataggttaaataccgatattgactttgattatataggatatttatcactctatgaagcttccaatggcttgattttctagatattgtctttcttttcatacttatggctgcatcagttaagtttgacctcataagtcgtgcttagaactataatct

SEQ ID NO: 5636 - DNA, 7511 bp, Oryza sativa
tctgttataccgtaccaggtccgatatcctcaaaccttccttggggatcaagatgatccatggtttaaaagggaccccctgagagaggttcaggggatcgaattccatcgccaacacacccaccaaagttacgaagccggagtacgtggagccaactcgccgggagatctcgtcgaatccctcgactacgatctcgtctgtaccatctgttttgactactctctttgtaatttgttctcgtcagcatcaatctcatataaactggactagggttattacctgataaggggcctgaaccagtataatccttgtcttttatctgcttgatgtcgtactacatagaccctcattccaatgtaccccaatactctacttatccggtccgcgagtatcactcgtcgacagtggcgcgctaggtagggagacttggtgctcaaggatataccggtatgacttcaagactttccgacaacagtaccaacaccggcgtcgatcaaggagcctctacctcgacatcgctggtattgactcaagtcggatctatcgtctttccggtctataccgttacaccgatctcgactggaccaatcactatcgggaacgagaaaggcacggttaagactccgagaaacgatgccccgccgacaattcctcccacccaagtggagaacggaacatcgacggtcccaacacctgggaggaatcctcaagcggccgaattttgtcctttgtacaaaaaatcagagccgacaatgactaccaccctaaagctgagaccttggtttcctgtgcataagacatccaaacatattctcgaggactgcccggtgatactccacgtgaaagctgaactctacgcctgctgggagcgtgagattcagcgcacttcaccgacaagaatcacctactgcccaattcacaaatctaggtctcacgacatcacaagctgcaggattttcctcagaactctgaaaccaccgcatcatcgcgtccaacaatcgcgagttcaaactccgtgtgttgccaaggagcgagatgcagtgatgacatcaaatcggttcgtaggatatgttggtactaatccaaatgagccatctgtgctacacctcctagaagactacgaatcctcctcggagttgccatgagatgtaaacgtggtcgacaacactgaaacaagtgcgtccgcagcagtgagaatgcccgctcaacagttgcgaaacctggatgcgatattgagtgaaagtccttttgatccggtcacaaaccccgacgtcaaccaatgggcgacgcgactgtgggagaccgtgactaacctcaacgccgcatttgccgaagcagcggtcaacccggaacaacatgaggatgaagggccaactgcaggagatgcggacggagaaaatcccaacggaacgcgtccctccggtgaccagtcacctcgagagagacgagaccctactccaccgcgtcccgagaactgtgatcttcgcgatcacttagacaaccggtggagggacagaagagatcgtgacaacaatgatcgccatcgacatcgctctccttcacaccgcggggataacgctgctgcccgacgacatcgtcaccgcactcctccacgacagagaagggacgatggtcggggaggtgcacctaatgaagatcgggaccgacgggcccacagcggtcgccgcggcgacgccaataacgacttccagcgagaccaagcagctaatcgtcgagatcaggagcggaacggcggcaaccgacgagatcggaattcccagtctcattctcccggtcgaggtcgaggacgagatcatcgttcgagaagctaggctcctcaaccaagcgaccccttgtcctcgtcatcatcctcgtcagaccagcttccccgatgacatcagcatcgcgggctaccttttgctccagggggtggatgcagggcattcacgcccgaactctgagatgtacggtggcccgagaaattccgactgggagcaatagagaaatacgatggaagtacacacctagaagaatttctgcaagtctactctacgattctctatgccactggtgcagatgatgttaacgaccaaatttggtaatttcagtatcggagatgaaaataaaaccgaagcggaatccaagaggtagatcgttccggaaacagagcaagattcggctgaagtccaaatctgctacgaccaaagtcggcagagttcgagtcggacaaggtagtcgattcagctgaatccgacaatgtgactcagtatacgtcatcgggctgagttaatgtgcttcatatggattgccacacacggattcggtcctgaaacgacaattgtatctattaattaggatattctatgtaatttcctaagagataagtttgggcaaaagtctgccgcaaagacttatggtatcttagagtttgttagagataagagtcgtgtccaacatagacatattttgtaatctcaggtataaatagaccccgagccccatgtaatcaattaacgcacgttcaatacaatctaggcgcatcgccaccttttacttttgttttgttttcaacgagttcttgctttcgggttgagctgcattgggtttcgatcttcaactagaggtaaaacttgttatggcggcttgcgttctcgagattagtgcttccatctttatgacactctaatctggtttatgtaagttgtcgagttatcatatatcttatataatctttggcaatatcgttatttaaccttctatcggctagcatctagtcctagaagacagccgaataggttaaataccgatattgacttagattatataggatatttaccactatatgaagcttccaatggcttgattgtctagatattgtctttcttttcatacttatggctgcatcagttaagtttgacctcataagtcgtgcttagaactataatctctagcctgcgtcttggttgttgattagggtagtatcagggtttcagccgatcttacctgatttagctttatgttttatatgcttaattgtcatgctagatccgccctttacgttaagattctattgcatttaggtgtattaagcttcctgtttgatatattttacttgctttaatatcttaatatagagtggtatcggagtattagccggtacacgctagatctatctgatcagctatgctgtaaacgtctataatctcattgttaatatatattgcgatctaagtgatttatactgtctcgacatggtgaccgatctatcccaatcacttgatttaagtatatatcgacataaagattatatactgttaatatctacagccgatcgagcagatttagttttaatttacttattaacaactgccgatcgattaacatatgacattggctcaaatataaatgatatgtcatcggcgactggccgatcggctatcgtttatggatttaacggcggtttctttgtctattatttcttgttgattgtaggatcaaatcaactggcacgctcatgaacctaaaaggcaagattttggacctgcactggagttaagcagatctcccaggcctcgtgtttttagcatcaacagatgataacgcgctagcaaactacataccagctgcgttgaagggatctgctcgatcatggctagtccatctcctgccacgctcgatctcatcatgggaagtcttgtggcaacagttcgttgccaacttccagggaacctacaaatgccacacaatcgaggacgaccttcacgctctaactcagaacccaggcgaatcattgagggactatattcagcgcttcaacgtgcgcaggaatacaatccccgagatcaccgatgcttctattatccgtgcgttcaagtcaggtctccgagatcgatacaccacccaagagctggcaacacgacgagtcacctctgcttgaaaactgttcgagatcatcgacagatgcgcccatgcagatgatgcattaacaagcaaagacggaaaaagcaagacgggtgaggagaagagatcaagcaacaaggacgcaccagagtcaagcaaaaagagaagtcataaaagtgggaagcgcaaaccctcgggagaagtcctcgccgctgagcaaatggacccacctaggcgccccaatccccagaacgatgactcacacaagcaatggtgcccaatacacaagaccaacaaccacgccatggagaactgtctcatcttcaagaaggagctcgcgagacaactggcgattgagagagggaagcgagttcgtgttgttgagacagctgaggaagccgctaccctcaattccgactttgccttcccagaatatgacctccatgtctcccacatcttcggcggctctacatcgtacagcttgaaaagggagtacaaaaaggtggaacgtgaagtctgctccacttcgcaagcgactacctccaagatgaagtggtcccagcacaagattgagggcctgtttggttcgctgccgttggtatccagccaggttgtggcgctgccacagttctgtggcgaaggaaaagctcgccgcacttgtggcgaaaactatcacagaaatgaactgtaacgttgtgtggctggctcaacttacgtgggaaccaaacaatagcctgttttgcgtggctgccgcattcaaggtgtggcgaattctggcggggaaccaaacagcccctgagttctcggaggcagatcaccccaagatcgcgactacgcctggcagatatccgatcgtggctgaacccaccattcggaacatcaaggtggctagagtcctcatcgatggcgggagctcaatcaacctactttttgccagcactttagaggcgatagagatacgtcgaagcgagctgacacctacagatcagcccttccatggaattaccccagaatcgtcatctaaacctgtaggcaacatcacgctacccgtcacttttgggcaggccaataacttccgaacatagcaaatcacctttgatgtcgcggagtttgacaccgcatacaatgccatcattgggagaactggactcgctaagtttatggcagcatctcactacgcttatcaggtactcaaaatgccaggaccaaaagggacaatcaccatccagggcaacgctaagttggcagtacagtgtgacaagcggagcctcgacatcgagcatactctcaacccacccgccacaactgagcagcccaagaaagtgagcaagcccagcaaaaaggcaaagccagacggtgctatcaagataatcccgttgtctagctccaaccccgacaagacggtcaggataggggctacgctgatgacaaataggaactcgcgctcatcaccttcctctgcgacaatgcagacgtattcgcttggcaaccgtcagacatgccgagaaatcctagagaggtgattgagcacaaattgatggtgcgacccgatggcaagccagttaaacaaaaactacagagattcgcacccgagcgaaaacaagccatacgagaagaattcgacaaacttctcaaagctggcttcatcagggaagtcctccaccccgagtggctcgctaacccagtaatggtacgcaggtgtcacgaccggaaataacccaacgggtgttcctgacgtgcgtgcattaatccttgtcccaggaggcaaggtacaccaaaagttgatacaattcagagtttaacaagcggaagcgtaaatagaattattacatgggcaacgaaggcccagcacactcaaagacaacgaaaaacagcggaagactagggcgacgaccacaggcgcttgacggcaggcacgagctagacaccaaagccttcatcttccaggaactcctcatctgggcttgggaaaatttagcaagactgagtacaaccaccgtactcaacaagacacacccacaaatgcagaataaatgcaagggagtacaaaggaattataacatagaggggttagggttgcagtaaacagcatttaaagacatttagttgctcagggctagttgtaaacacgatcctagaactaaacaatgttattaatcaaggccgtgaacccgcacgaacctgccttaacccaaggcctatgatgattcagaccgaactggcaacccgaccctgggtcccagctcgtcctaagccaacccaggccaaccattccatattttagttgttaagcaggttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaagactgagcccctagcagtagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccattttaggggattttgaatagagggggcggtgtgaagccaattccacaataaaccaacaattccatagtgtccaggtgatatgaatatttcccaaggtctatagttgtaaaaccacctaatgttacctaattaaagcaaagcatctacctaaaatcatactagtgataccacgagtagagtgtccactagttggggttttgtttgatctagggtgaacaaggtaataatagcaataacaataataataaggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaagcaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaaaaactatttattgcgtcagccgagggagccgggcgcgcggaccgggtccacgggaagtggggcccacgcgtcagccgctcggtccacggtggacc

SEQ ID NO: 5637 - DNA, 3872 bp, Oryza sativa
ggcgcgcccgcgccccgatggtcaccgccggcgaccaccggcgcggcggagcggcgcccgagagagaggagggaagggggaagcgaaagggcggtcctcggctcaccccgggacgacgacgacgacgagaacggcggccggagcggaggaagacggcggcgcgggtcgggatgacgatgacgacggtgctccggcggtcggcgggcgaagcggagcggcggacggggtcggcaaccactcggcgaagccgatggaggtgtcgccgagtaaggaggaagtccggagcggcggcggcggcggaacggagctcggcggcgatggcggagagagcggagcacggcgcgagcacgaatccgacggcgagagcgagcggcgagcggcggaaacggaagagcggagctcgggcaacgattttatagcgtcggaagggagagaaggcggccggggaggaaggaaaccggccgcggagatttcggccgccatagatgcgccggcgacgaatgcgggattaaaatcggacgaatccgagggagagagagaggggaaaacgggggaaacgggagagggaatcgcggggaatgattcccccctcattaaggcgcgcggggacggcgggatgcggcgcaatccgcggcggcgacggcgctagggcacgggctcggcggcgggcgcggcggaagaaagccgatgacaggtgggccccacccgtcagcgagagtggcgggcgggcccgcctgtcagcggcgcgcacgcgcgcggggagccgatgggccgcgggggaggagagagagagagggagggagaagtgggccgagccggcccaagagggaagggggggggggaaaaagaacttcttttagggttttctttttataaaacctttttactttgtttatttcttttctattattatttgtgctctgaaaattccactaaaatttatttaagcattttaggcttttaggaaacatacaaaaatcctccaagcctcatttgacttttatctttgcacattttaattgttggaggctttctcatgaattttaattattctttgcacaattttgaggatgaattttagagtcgatttgggacgcgacagcagggtcaatgggaagtggaggatgtgcgttgacttcaccgatctcaacaaggcgtgccccaaggaccatttccctctccctcgaaaagaccaattggtggattaaacgacaggatgcgagttgttaagctttcttgacgcttacttcggctaccaccagatcagcatggcaaaagaggacgaggagaaaacaacgttcatcacgcccttcggtgtattctgctatatcaagatgccattcggattgataagcgcagggaacacatatcagcgtggaatccaaggggcacttggcaatcagcttggacaaaatatcaaagcctacgcagatgacatcgtcgtcaaaacaaagatgggcgattcactaatcgacgacctaatggaaacgttcgacaacctccgcagatatcgaatgaagcttaacccggagaagtgcacgttcagagtaccatcaggaaagctactcggcatccttgtctcaggatgagggatggaggccaaccctgagaagatcaaggcaatcgagaacatgaagtcgcccacaagattcaaggaggttcagctgtgttaacgaccaaatttggtaagatatgaaccaggttcgacattggaatcaaggcagattcggcaaagagatagatccgaagaacagagtatgcatcggctgcgaaggcatcggctggaatgtgcatcggctgagacggatcggtcagaggatggctgataccgccgatagagccggtatagccgattccgatggaaatagctccgaggctgtttctagaatcgattgacgtgcttcacaaggattgccacgatggagataaagctctcagaaaggcaattgtatctattaattaggatattttatgtaatttccttagagatatgtttgggtaaaagtctgccgcaaagacttatggtatcttagagtttgttagagataagagtcgtgtccggcaaggacatgttttgtatctcgggtataaatatgacccgaacccaatgtaatcaacaacaacgttcaacaacactttcggcgcatcgccaccctttttactttcgttctttttcaacgagttcttgcttttgagttgagctgcatcgattcgatcttcaactagaggtaaacttgtcatggcggtttgcgttctcgggattagtgcttctatctttataacactctaatcttgtttatgtgatccgtcgagttatcatatacgctttgtaatctctactaattgctctatataactcgtcatcggttgattcttattgttagaaagtagtcgatagagttatgttttgttattaatttagattatatggtgtatctaccatctcttagagattttcatcatcttgcctagatcttatacttatctttatgcttaatgctgcatcggttgagttcgatctattaagtaatatctataattatgatatctggcttgttttatgatcatcgaaagagatagcatcggggtttcagccgatcttacctgatttagctattttatatctcatatgcttaattgatatgctagatccgccctttatattaagatcttattgctttaaagtatattaggcttcttgtttaatatattttgcctgttttaatatcttagtataaagtagtatcagaggattagccgatacacgctagatctatctgatcggctatgctataaacgtttatataaccatcgctttaatgtatatttcaacttaaatgatttaatactatctcggcatgatgaccgatctatcccaatcacttagtttaaatatacatcgaagaaaggattatatgtcactaatatctacagccgatcgagtagatttagttttatcttatttattcatggctgtcgatcgatcccaatatgacatcggttggatgataaatgatatgtcatcagcaactagccgatcggctatcatttatggatttaatcgtggttttctgatctttatttcttgttgattgcaggatcaaatcaactagcacactcacgaacctaaaggcaagattttggacctgcactgaagttaagcagatcttccgggccagtttgtgttttcgcatcaaaaagcagttgacaggatgcatggcttcgctaagccgcttcgtcgtaaggatgggagaacgaggacaagctttctttgccctgctcaagaagcaggacaaattcgagtggacccaagaggtagagaacgcgttcatcgcgctcaaacgctacttatcaaacccccctatactcgttgttcctcaaattaatgaagaattattcctatatattgctgctacgccttattctgtgagtacggttatcatcgtagagagggaaaaagtacaacaccctgtgtactatgtcagcgaggccctccatgacgcaaaaactagatatctacagatacagaaactgctctacgccgtggtcatgacatcaagaaagctacgccactacttccaagctgtcgcgaccgggaaaattgccttttcccgaacgctagtgtattaatccccgtcccaggaaaagccggggtacaccacacaaacatgatataaaagacacatctttattatatcgacaatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgag

SEQ ID NO: 5638 - DNA, 6965 bp, Oryza sativa
atacacatgatcacatatccgcatctttcaaacgaatcctcatggaacttgtctgtattacacatttctcccttattacatgaatgcaaggccttgccttaaacaaaaagggaaggtgcttaacatcagtacattgcatcctcaacatgaatcttccataaacataacaaactcattgtttataatcatgaatgtatttatttattacatgattgctgcaaactcccgattacacaatgataagtagcgaactgaaaaccacaaacgtggctgctcattttgattctggagagatatagctggcattgttctagtgactgcatcatccttgattggttctgtgatgatgtgttaggactgcatattgctataattcacaggagaagcttccttctgattgctatttgaagcagagaacgatcttctgcttggtatcgccctcctgagattgattgcccttcgcttgacctggagtaggtcggggagagaaacaacttcttccatcgacgacaattcattgctgaggctgtcggtgccgagaatggttggtgctgaaggtattatcgctatgatttactgcagaatcaggtgcagcaagaggagcattggtgttgtggatgatatcgtcgatgttgctgttggagctgactagctgatgagacaatcgtagagttgttcgttggatttctgcggtcttggtcaacaacacactgagttggcaatccttgggcacatggtttgtaccttcgcacagaaaacatatgaccttgcgggtgggacactcccctggtggatggtcttcttcgcaataagcgcagagtgtgagacacatgctagcaatgtgtccaatttctccacaacgggtgcatgcctttgattccatctcttcctcgccgagatgtcggggagactcatcttcatcatccgaggagacttgatctgacccttcactatcagatactctgccaccatggcttagaaggtgctgggtcaactgtcgtgcacctcggaaagtatttcctttctgacgtctaggaatagttatccctgctggaggccattcggtgctggtaatagtcatcttacgtacttcttcttcagttcgcatcggtgcttttctcttctgattcttactcttcttgcctttggcttgcttagtatgcgaccccacgtggtacgagaggctagggggaaagcatttcccgggattcaatgggttctctccgttgagctctctactttgcacactaggctgcaagcttgacttggtgtgaggaggctggtttagcgatgcctgccctgttaaaccaaaggaaggggcttctttggcatatacccatggacaattcagggcatagtgtccttgctctctacaatcatgacaaaaggggacatcctctcctggcattggaagctcattgacctgggtggcaaatgctcgatcaaacacatactgattttggtcttgacttccaaccaatggtagctgtgaactaagcagcgtgcttggaatggaccaagggtgtgcccttgttaactctcttgaggccagtggtggattgagttgaaaacttgagttacttggggcatacccgctgacattctttcctttttctctgttaaacatctgttacagggattgaggtgagagaggaaacaagccaggaaagaatagaccagaactagggacaggaccttaaaggaactaactcttcttgctgatgtgttgtttgtttcacttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcgctcctgcttcacagctggcttcactgcttccttcgcttcgctagcggatcctgcagtcttccggagcttcggcaaacaactgacgatgtcttcttcttcgcaaagctgaccatctagtactagttgaaaatccgaagaaggaagaacggagtaaaccttttgcaaatagcattaggggaaggagaaaaaggaactttcgcaaataattttattcataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgacaatatttacattattacaaaggcgcttcaggcctggcaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagacacacccacaaatgcagaataaatgcaagggagtacaagggaataataatatagggattaagttttgcagtaaacagcatttaaaagtcacttagttgcccaaagctattttgtaaagacgatcctagagctatacaatattattaatcaaggccgtgaaccctcacgaacctgccttaacccaaggcctacgatgattcggaccgaactggcaacctgacctgggttccagctcgtcccaagccaacccaggccaaccattccatattttagttgttgagcaaattttaagaattaaaacactgacttgggtacattgctaggcttgcccatatccgagggctcggctattcgaatagattatactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccaaagtgtccaaatgatatgagaattcccaaagtctaaagttataaaaccacctaatgttgtcctatttaatcagcgaagcatctacctaaattcatactagtggaaccaggaatagagtacccactagttggggttttgtttattctagggtgaacaaggaaataataacaataacaataataataaggtcataacaaaggtaaataggtatggctagataaaacagtgataacgcgggaatttaaataaagcgataatgcattaatttaaatcaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttacgaatttcttcatttaaattttaattaaaaaaacctatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcacccgagggcggcctcgccggcgcggccgacgggagtggcgcgcacccgcgccccgatggtcgccgccggcgaccaccggcgcggcggagcggcgcccgagagagaggagggaagggggaaacgaaggggacggtccacggctcaccccgggacaacgacgacgacgaaaacggcggccggagcggaggaagacggcggcgcggttcgggatgacgatgacgacggtgctccggcggtcggcgggcgaagcggaggcgcggacggagtcggcaaccactcggcgaagcggacggaggggtcgccgagtcggaaggaggaccggagcgacgtcggcggcgaaccgaaggtcgacggcgacggcggagagagaggagcacggcgcgagcacgaaaccgacggcgagagcgagcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccccctcattaaggcgcgcggggaaggcgggatgcggcggattcagcggcggcggcggcgctagggcacgggcgggcggcgggagcggcgggaggaaggcgatgacaggtgggccccacccgtcagcgagagtggcgggcgggcccgcctgtcagcggcgcgcgcgcgcgcggggagccgatgggccgcgggagaggagagagagagagggagagggagaagtgggccgagccggcccaagagggaagggggggaaaaagaacttcttttaagattttctttttataaacctttttaactttgtttatttcttctcaattattatttgtgctctgaaaattccactaaaatttgagggctccttttagaccaaggagaatttaacaaaaattctccgggccacatttgaatttttcttgtacgtattttagggtttgccaattcttttcgaattttaattaattctattattccttttagaagatgatttttattttgggatgaatttatcaggacgtgacaaatccaccccccttacaagaatctcgtccccgagattcgaggaggctagcaagaagatgggttgggcggtcttctcttcttgtctgacttcttccgttgcgtcttgacgaacttccagcaaaactttaccactcggaactgcttggcttgacctcctgttgcggatggaatcttctcttcacctgacttggaccaggatgcaccttttggctgactcagactaggttgcggtagttcagtgatgcttccgttccagaacttctcatgattcatatcttcggagtcaacctcggacaagttatcaacttcatgtcatgcgtcgtaacctgcttgtcattactaggataccatgcttgttatttgcttctaactcgccaccaactgcctcatattagcttccctggtctccgggtgatagctacttctgctatttgatgcaagggtcgataactttacctttgaattatgcttcccaagagagccaacttatcctacttgttatactttgacgtcttcccaaatggctttactgctggatttgttattgtctaatcattaccctgtcaaatctgaggcttcgttgtgagaggtgattttaatctgacctctatagactatcttcgaacgtatcactggttctataactgggaatggctctcacgaacaagcagctcggattcactttctttacattcagtttacttcccattattatcttcaggttatcctcagttagcattcaacgtattcctttacacttttaaccttgatgtgttctttcccattggatcatctcccaagacttggcattacctggtaaccggtgcttgcacttttcacttcgtgtagcatctgataccgagttgaagatttcactccttgccttcatagaaacacttttacctaggtcatcttgcttacttaatgacaaggtgactgttgcggggcaattacaatcaggggtcttccttgagcgatgcagagcatgtttctgtttatcaatcacctttcggcctacttcttttatgctagagaacatctttgccaatttcttttatcaatcatctttcggcttatctctaacaggtggtattctttaatgtggattgcggacgcttctggggatgatgaggtcctttggcttgctgcctttcagtggaaccttgatgtggttcgtcaaaagctgtactgactgccttcagggaaatacattgcttgctatctgtatccatgccactagggtttgattgccgatgatcatctttagtgcttcctcgagatggggagcatccaaattgttcttctgccacatcacctttgacatttttctgataccaaataaactaattaccaaccatcgactattatgttctcaaatattgatatctcctggatctccttaactgttggcaggtatacccggtcttatcaatgtagaggcatggcgggtacccttaggggtttcctccaacaatccttatcttgatctgtaaaaggcgtatccaaactcctatcctcaactactgtctcgttggcttttttaacccaacacagtttaattgtttttcttttccatccccaggttggttattaactcgaggttagaatatag

SEQ ID NO: 5639 - DNA, 10923 bp, Oryza sativa
  unsure (1)..(10923): unsure at all n locations
ccgacccggcccaagaggaaagggggggaaaaagaccttcttttaagattttctttttataaacctttttaactttgtttatttcttctcaattattatttgtgctctgaaaattccactaaaatttgagggctccttttagaccaaggagaatttaacaaaaattctccgggccacatttgaatttttcttgtacgtattttagggtttgccaattcttttcgaattttaattaattctattattccttttagaagatgatttttattttgggatgaatttatcaggacgtgacacaagctcataaggttacgtcgtctcttccttccctttgggggaggttgtcagaaacaaagacgtcgtcggccgaatcactaaatggtagtcgagctaagccagttagatgtacacttcgtaccaaggatagccatcaaatctcaagtcctagccgatttcgtagccgactggactatcccagaggatagaccggccagccaactagacaacgaaacttggaccatggcgttcgacagcgcgctcaacagccaaggagcaggagcaggagcagggttcatcttgacatccccttccggagatcaattcaagcatgcaatccacctcaatttcaggcaacaaaaaacacggccgagtacgaaggcctactcgaggagataagagcagcagctgcactcggtgctaagcgactaatcgtgaaaggagatttcgaactagttgcaaaccaagtacatagactacaagtgctctaaccccgagttagcaaaatacctcgccgaagtttgaaagctggaacgtagatttgacgggatcgaggtctgacacgtctaccgaaaagacaatgtcgagccagacctcgcacgccgtgcttctagatgagaaccactcgagcccggaacatttctggacatcttgatgaagccctccgtcaaagacacgcacgacaaaagcatcatagccaacaccgacattccgtcgggggttgcagaagttgcatacgtcgttgcaaacattgagataacagacgactggcgtattccgctaataaaagtcctggaatcagacgagctaccggacgacgacacggaggcagagaagctatcccgtcaggccaagatatattgcatgatcggcagagatctatataagaaggccccgaacggtatcctcctcaagtgcgtctcatccgatgacggaaaagctctcctcgtcgacatccatgaaggcatttgcggatcacaagccggcggacgtaccttggtcggcaaagcttttagacaaggctttttctggccaacagtcttaaaagacacctgtgacattgtgcaacgatgtgaagcttgccagttctttagcaaacacaccaagttgccagcacaggtgctccagattatccctttgacatggccgttctcgtgttgggggctcgatatactagggccattcccacgaggacaagggggctacagattccagttcgcggcaatcgacaaattcgctaagtggattgaagcagagccaacacgagaaatcaaagtcgacaacgccataaaattcatcaaggggatattctgcagatatggattgcctcaccgcatcctcacagacaatggctcccagttcactagcggccagattactgcattgagctaggagtcaagatctgcttcgcctcagtatcccatcctcaaagcaacggacaagtcgagcgtgccaacggaatagtactccaagggatcaaaacctgcgtgtacgataggctcatggcctacgacacaaaatgggtagaagaactcccgtcagtccaatgagccgtacgaaccacgccgacaacatccaacaaggaaaaacctttcttcctcgtgtacggatcagaagccatgctctccacggaggtacggcatcagagcacacgagtacataaatattccgatgaggaacaagatgaaagacgaagtgacgatgtgaatctactgaacaacatcgtgaaccaacaagccctacgccgatatcatgagaggcgcatcagagctcgcacacttgccatcggcgactacatcctccgacgagttcaaaaccaggaaggtcggaataaactctcgttcaaatgggaaggaccgtacacggtggtgcgagtcttacgaccaggtgcgttcaagaatgcagatggtgagcaccttgagttatccaactcttggaacattgatcaactacgtaaattctatgtatagaatcaatgtatctcagtaatatcaagtaaatttcccaaaggtattttttgaatacttcatgagatagttttctacccagagatcccttaccacgacaatacctactattgaaatcgaacctaatgtccctttatgccagtccgacaagcctccgagaaacctatgggaatttcggctggggacgcccagagcagataaggccttgtcggaccctaagagccaaacgaccatgtcaaacctagtcatgtaagagtgctcaatgatggcgcattaaccaagccgtgtaatcggaaattgacttttccaacctcacggctaggggctaggtaatcgcgttttcaaataggcaagtttcgggtcatcgagcgttctcctcggataacagatttctccgaggagaaggctgggggctagggagagtacccgactcaacaataggcaaaaatagcctgaataacgagtagtactcgcacatttcatacaccattcaaacacttagtaaatagatttctgttctatttacaaaaacttaacatttatattacagacactcctctagatattttttttctacagggaatgacgtctaccaagagggccattgccaaaccatcgacaaaaagaccttctcggcaaggggagcaagagaacgagccagatggtcaacttcactcgccgacagtcgagaacgggcaaatccctcacgcaagaacccgagattcatatgcggacgtggatctcggatgcaggcgagtacgtgacccccggcataacggctagcgcggcggcactcctcctttaggcagttgtcgatccgccgtctgacatcctctagctgggcacacgcacccctcatccaggatagatacccaactgtcgtctcctcgggctctgcacgatcaatcttgagctgccggtagatctccaacatggagatacaacagctcttcaggtacgagttcaaccagaccttgcgccctcagagcgtttcaatagcctgatccttcttcacgaccacgacggatcgttcgagctctgccaccttaaacttcgtcctccagtagagaacttgtcgatctcgctcgccaagcgtgttcctgagatctacaaagggcaagggttcagggagttttgccccgtaacaagtaaagcttcaggagcaaaaatcctaagatatcccacctgagatctctcggaggagcgaggccacgtcgagatctgacaagccagatgcggcatttacatccacagacgcgccgatgaccccaccaatgtccgacgaaggcattccactcaatgaaaattggttcgtcgcatcgacatcaggatgtccgccttgctggacgtcctcaggatcaacatttctatgagaaggaaaacatgctacaaataaacgaatcaagaacatcaagaaaaggaaattgttccaccaaagacaacacaaaagaatctacacagaaggagcacaaagcagagaattactcctcgaaaagtgggaggacggtctccccaagatccgccacaacggacatcacgtcctcacgcgtggcatcgtcagcccccttagacaagatccccttaagatcggcgttagggagagcgagcttcacgcaagcgaggacatgacaggcccccgtgtggatcccgttggagatctcctccgagaccttggcggcatgcttagacgggatgacctccatcttcgtcgccagctctcctagcgccgatgtcagggaggtctcgttggggtgcgcagggatagaagacttcacgctgcactccagggctagctggtgtaggctggtgaagctcttccgaagctagtcgccaatggagaagatatgatctagcagatcgctcatcctcttctccaagccaagacgttgcatctcgttgccggccacgatctccatcttctgaaggtcgtcatgggcgacttcgagttctgtctccagctgtgccaccctcccgtccgatgacatagcatgggccgtcaagcggtccatctgagcccctacctcccgagaagtgttctcaaagaggcggcggcactcggacatcatgtcagaccagtcctatggccctgaagacggcaccacagtcgtagtcacgacagcaggctcggcggactcggcagcagcaggtgcagacttcgcacgaggagaggtgacaacgggagtcccgctagtcaccacctcatcgccgctctgcgcggaggtcgttgaagctttcctgcaagtacaagaaaacatccctgataagctcacagacgcgataatgaagaaggtcaagagattcacttacttatcggcggccctcttcactaacctcctcttcagaggaggggggaggccaccagtatcctgagtaaaacagcagatcacggctttacttcatcatccaacgaaagagaaaaagacaacggaccgagaacgatgggccttaccttagatccgcggacttctgtcgagatccggcggaggcgcttgaccgagcccacggcttcctcttggtcccactcccccatgcggtgacagggacagagggagcagcggcgacctcctccacaaccttctccttgagggaagcggaggcctagtgatcgacaaggggaccgatgacgtccatcaatggcaggacctgcaggagttgaggtcaactcgatccttcgttgaacaaagaagcaagaggcgttcgttctcactcacattgatggcggcgaccttctccacttccggccggtcgcagataggagtcgggatctcctcggccttggaggcggaggtaatcaccacattccccactcgctgcaccacggcgtcgtcggagagcgctgcggaaagggcaagtgattcaagttaggtcagaataccaagataatatttatgcgagggtgagcaacgatgacacaagaacgagtaccccgtgacgagatccgcgtcacgtcttccgtccccgtgtagccgaaaatgggatgagcgcgagcttgcagcagctggatccgacggctgacaaagtcttgagtgacctcatagccggtcagcccatgctctcaaaggtcgctcacgatgacaacaaaggctaggagggaaggagttagaaggggtttggaggtctagctatcagaacggtcaggttgattctcgggcacaacaagaactggatcaagttccttacgcttgatgtaaaaccacttggaccgccattggccccgagatgagtggttctggaaaggaatatatctcgccttcatgccgtcacgaaggcggaacccacaacatccagacactcgggtgccctccatccaacggagttcgtaaaagaagcgaaaaaggtagatgaaaggcactaccccaatgtaggcctcacaaaggtgagcgaagatgcttaggaaggcgatggagttggggttgagatgcaagagagaaagaccatagaagttcaatatcaacaaaagaaattccgaagggggaggtaaaaaaccacaacggacgaaatcctctaccactaccatgcggcctagaccaggagagggttcagtacctccttgttctctcgccatggtttgcttgggagggatagccccgtctatatagagcttcttcagggaagccgtatcggaggaagacttgctgaggtccgccatcggatgaggatcaccaggggaggacgaaggaacctagggaattttggggaagacgaaaggtttgagactattggagaattggaagattttttggcaaacggacttgaaatggatcccaaaaatccctttaataagcgcactacctggcggtcagaattttaaggagagagattgccgctgaaaaatcctgaggcctgttaagggcagttgttcagacttcaattcaaattcatgtttaagctgtcggacttccatatgtgttgtcggtagcttctaaccttcccggctccgcaccgagaacgaccaagtgagcacgacaagccactaacaagagaagtcatggatgacaacatgaattcatttgagttgaagtcaggggctactgtcagggttacggataaggcatacctcctatcctacgacttatggaatataccgataaggtataccttcacgtatacgggttgtttctgtatatgttgcgtggaaaccatttcaaattataagaaatatctctacgagtcaagtgatttccaaagtcctactcggaaggtatagagtttatgttataccgtactaggtccgatatcctcaaaccttccttggggatcaggatgatcgacagtataaaagggaccccctgggagaggttctagggatcgaattccatcgccaacacacccaccaaagttatgaagccagagtacgtggagccaactcgccgggagatcacgtcgaatccctcgactacgatctcgtctgtaccatctgttttgactactgtctttgtaatttgttctcgtcagcatcaatcccatataaactggactagggctattatctgataaggggactgaaccagtataatccttgccttttatctacttgatgtcgtactacgtaaaccctcgttccaacataccccaatcctctacttatccggtccacgagtatcactcgtcgacaaatacatgcacaaatttatttgcgaagtggctgatttctatataggtttgcatattgctttttgatatttgatcagtatacctgaatgaaatggttcactgtgcccaaaaatgtgttcattggtgctgacatggttaataagttcttatatcccctgtagatagacttgtgaatatgaatgtatcagaatagctatgacactgacaggtcacttcgatcgtcctgtttacagtacttttctttaccatggctgtgtttagttccatgccaaaattggaagtttgaagaaattggaacgatgtgacggaaaagttggaaatttatgtgtgtaggaaagttcaatgtgatggaaaagttgaaagtttgaagaaaaaagttggaatctaaacagggcccatgtatgagtagcaatatctatgaactgagggaagatcaaatataatggcaaatcaaatgagtcacaaggacacagataagataaaaaaacaccaagtcaccaactagagctgctctcaactaggtgtgaaaatgtatgttttgaatttagtcttgatcaattcaggtaattctagattataagccccaagaaaatatgaattttaaattactctaatttttttcacacacactatttttcatataaaagtcaagttatttttctccacttccctccctctgctaatttttcacttcgtatattgatcattagcagaagaaaatattcagctgtcgggtcccgaaactaatgatttgaaaaccgacttatttaactgtatcaagccctgtatcgttagattgatacaggttcaacgatctggatcttcatcgcgtatatttggtcaaggctccaaaagagatgttattacataaaataatagggtatttataaggttgtggctaactactacagcagaagctatagaatgatttaactctaatgtttggctataaacttaaaccatctatctaatctctacttgagaattaagttagaataaaactaacttatgtgattgaactcccagcttcgacaaaaactccaaatagactctgaaaaagaggggttgaagcaagggtgagtacaacatactcagcaagctattatatcaaatatgaatgcatgaaatagtagtatttgagtagggctatgaatacttgcagaaagcagaaaatgtagaagtacaaagcctgtaatgattttaatgcaacagtatctaataaaatcttgaattatatttctaaccaagatgccattgcgagtcccgatgctcaatattcgtgagcatagctattcgaatagtttcaagaatattcatactgcagtagatgtacgctttacccgcaatccatgacatgccaatattcattagcttagtcatggcaaaacttttcggttactaacatcagtggcacctgttccataaactataatccccatgcgctctgaacgtaacgttatcagtagcgagaggagttctggcgttcccggggtttttagacagaactggttgagagacccccggcatctcaaccaggttttcacaattatatataaatataaataaatatatatatatatatatatatatatatatatatatatatatatatatatatatatatatatatatatatatatatatatatatataaagcgctgtgcgccacgaaactaaatggcgcaacagacatggctgtggagtaatggccgcggggccattcccaccatctcaagtggaaccgtaagtaatattttagagcaattctatggtccttgaggacgtaccatgaggtaccactttttctattgtaaatttagtatctcttgatactttggtaccatgaggtaccaaattttacactaaatttttggtacctcatggtacctcctcaaggaccgtaaaattgctcaatattttaactaatttgagaggtgtgcacgattaattaactcaatccatgtggtagatgaagcatgggtgggcacggagggatgttacatagttaaaatttgactcgaaacgacgtgttgatgatctcggatgacacgtgacacgcctgtaggctaaaattgatgtgtacggagtaaaattttgactcataaagtggtgtaggtagtggcggattggattgactcccgtgataaatgaagttaaaaaatagagcatttttactgtccttgaggctgtgcagtaccaaatcgtgaccgttgatcaggcctcatcggacggtcaaaaatcatctgtacctcatggtaccgcacctctgccttgaagcggtaccgtgggtgggagggtagttatgtactttcgcgtctattccgcatcacgcacgcagcatcccttccttctctgtttccttctctgtttggcgagagaacagaagccgcgtattcgacgggctagagcagcgagagaaagaaaccctagaatgcatggcagcgatagatggcggcgggagcaggttggactggcgacccgatggtggcctagatcgggtagccccggcgaatcgtcaacggcggcgggcgcggcagtctggatgcgacggctgcgctgcattggcggcggcggcgattcgtcggcgacggcgggtatggctgtctggatgcgacggctgtgctgcatcggtggcggtggcgattcgtcagggtcggagggcaacggcctcgatgcgacggcggcgctgcatcggcgggaggccggcgatggttggatgccgatgaaactgatgaaattcaaggataagcgagcaaccctcacaactggatggaatgctttggttggagccaatcttttcgagcaagctgatgtttgtgtgtttctgttcactgaagttccgatgtaatatgtctatcagtcaattctagtggtatggtttgcataattgatgcccctgtttgtgtgcattttgtatggatgcttcttgcgagatttattactggtgcatgcttgctgattatttgttactggtggatgctgtctgcggaacttaagttggtgttgctgagatgaaatacacatatatgctgctgaattgactgtgtcacaattgcagtttgcctgaacttattgctcctcttgctggaattactgctacaaatttaaatttgctgcttggtactgctttttgatgctgaaaactgaaaattgctggcactgctgcttcttgaacagagatcaaacttagaccaacaagattcaagtacttactttatgaaagttgtacaagatacaaacaacaatggttgaaacaaattatgcacacggcatacaacgtaaattcagctcaaacttagacaaacaacaacatcatacagcatatttgttctgctaccaacaccttccactgtacacggcacagtgaacctgccaaataatttaccaccttcatcacttcttcaaccataaaatgtatcaacaaataacaaatccagatgaagcacatttcaaatttagttcttattacgacagagtccacaccagatggtggaaaagatgccggagtcttcggggtggctacgacggtggatgggacggggtggaggcggcgatgttgatgcgcctgcgacggcggatgcggcgggtggagacggcgacgtctatgcggcggcgttgaagccacggcggccgtggcgtggtcgatgcgacggctgctcggcggcctcgatgcgacggcggctgcggcggcctcgatatgacagcggcagacgcgtgtgcgacgcatagccgcggcggcctcgatgcgacggaggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5640 - DNA, 3980 bp, Oryza sativa
aaataccacatcatcttagcaggaattctcttctttgttagctgcccgtcaacttctcctggatcgtctcgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccgagaagaatgttcttgacgagtttcaataaatcgccaaatgccttgtcactaaccccattttttgccttccattgcaagaactccagagtggtatccaatttttgtgcccctgctcgcaacctgggtacaacgaagttctgtggtcctccaacatcttgtccaatttatgggcctccttttcactttcgcagtcctccatagcgtcctgcaacatctgaccaagatcatccgcaacgtcgttaccatcagcagctatttcctcctcacccgtttgattttcttcaaatccaacatactgagcaaagtccggaatattgtcgtcttccacttcatcttcttccatttcaacaccttgctctccgtgggatgtccaacaattatagcttggtatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaagattaactttcactagagttttccttctcaactattttataataccttgtttagcaaatgaactaaatttctatatattctttcttccccacacacattttctctctcatcaacttacaacttataaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatataaataggggtgggactttagtcccggttggtagcgccaaccggagctaaagatcaccaggatctttagccccggttggtaataccagccggggctaaagttacgatctttagtcccggttggtaactaaagatcccgggggggcctgacatgccctgacagcattcgaaccgggactaaagatgatctttaatcccggttggtaccaaccgggactaaagatcaaatatgcccgttacccttttgaaccgggactaaagatcatctttagtcccggtttttattgcatccgggactattgcggaaatcggccgaccgacgaaagatggtttctccaccagtgacagattcatctctagaattggactttttttgtgtgtccagatttatctgtagaattagacttttttttttacggagggagtactccggtaagcacaaggccgaatttttctcatttttaattttaatttttttaatatttatagaaatattataccatccaaaatatttacacaaatggcccctgtcgtccaagtagagggcgtcaaggtgtacgcattttgcacttaggtcccttgccgtcctctacaagggctgcaagggggtaaatgcaatttttgtcctgccaaaaaatgcattttttctttttttttttcaacttgtccgtccctcacgtcacttctgtaaatgtttatatttacgccggtacaatatttctataaatattaaaaaataaaaatttaaaatgaaaaaataccgcacagggcccatccacaaactcagatgggccggcccgtcaaccatccgcgtggcccacttaattgagagagagagagagagagagagagagagagatcgtcttcaatcgcgtggcaccttaacaccggcacgcgcctcctcctcccctcccctccactccgcgagccgccaccttctccgccgccgacgacgacgacgacgccgcatccccaaccctagccgccgctcggcggtgctgcgacgtaggagcgggtctcctctctgcatgatccgttagggctaccgagccgatcgaccggcgggcctaaaaccctaccgagagaggctgcgggttgggtgggggtgggggcgtgctcgactctccggcggcgccatgaagctgacggtgaagaccctcaagggcacccagttcgagatccgggtgcagcccaacgacaccgtgagaaattttcccccctacgcccatttcgattttcttttccccgtctcgtgtgtagctttcgttagtggggagatggagaatttttgctagggtttccaccaatgtagatgcgaggtagccattgagtcctgctccgctagggtttcgtttcagcaagtatggctcacctcgttggagggctcgttgtttgctgttatttagttatttattattatatggtaatgtagtggatatgcctggatgatgatagtccctcggagctgtgttcgtgaggatggatggattaagctgcaggcttggagctatcgtctgctttggactcatagttttacagtgtgttcatgatgattcaggcgcagcaatgttagcaagtggttactgtccgaaaggagctatcgtctcctttgaaatattgaatgcatagcattgtactggctgattactggataaaagtaaaacttgtcaggtttcactgggggatgataattccatccaaaaccagtatttgaaaccctgggtgcaacaggggtttagatatttatttcttgtctgctacgtcttctataattatagcaaaaatggctctgctacatatataaccgttccaggatttttctgtttgtacactatggaacagattatggctgtcaagaagatcattgaagagatacaaggaaaggatagctacccatggggccaacagttgctgattcacaatggcaaggttttgaaagatgaaagtacattggaagagaacaaagtcagtgaagttgggtttttagttgtcatgcttagtaaggtaggccgcgtatgtgctgtatataatttaaatggtgatgttatttattacgcttcatttaattcttttctgactggatgctgggtgtaacggtgcagcaaacttagttgttaaggaaaacacgatgacgttccatatactccctccatcccataaaaaacaaacctagtacaagatgtgacacatccttcatattcatactactaggatgtgtcacatcccatagtaggtttgtttttatgggacggagggagttaatagcataaacagttaaacaataacttgcgagacgtaatcattttgtggatattcataaacgatgaatatgcctggctctggcctcatttaatgcatgttggttttctgataatctgacatgggcgaataaggaacatgattaatagtcctttccacgtagcagctatactatgggtagtttcttctatgccacagtaccaaacttaattgacacctgaatcgttcttatgcttctttctatgattaattttcatgacctgtcaacagtcgcttctctatctactggctttacagtgaccattatctataatcacattatccgacatttcctctcatgcttgtactcttctt

SEQ ID NO: 5641 - DNA, 25537 bp, Oryza sativa
  unsure (1)..(25537): unsure at all n locations
atttactgactgcatgatccgttattagacttcaagcacccctttgaccaggcaagaaactcctgcggatgcttcacgagcagctcctcaacccctgtgagtgcactattgactttcttttttgcatcttccccattcatataaggtattactcactaggtggatgtattgtgctcttgcagagttgcacctacaagaacaccccagcccgaaaggccacctgcggagtatgtttccagtctgcaatcaatatttgtgctatgtccttttttgccactaatatccttgtttcgtgacgtggtcactccgaaggaaaattcctttctttaaatttgatagcacactcaaatcattcaacatttcatacattaccacatctgataaggttccattgtgaagactggcatacacgcatacgtgataagatgaactaataaattgtggtctgcgagagaggaggggaaaaaaacacacttgctagctatcagcaggaagttaggctttagtcctgatcaattttgggattctaatagctatggaagatagatctgaattggtcttatgaatatgggttccactgtttactttctaatgaaatatactttatatgcttgctaaaacttatttttattttagagccccttcaaacgcatatggtcaagcagcatcaaatctattgtcgggaagcaatcttgacactacgattaaccagctgatggaaatgggtggtggcagttgggacagagataaagtccaaagagctctacgtgcagcttataacaacccagagcgtgctgttgaatatctatattctgtatgttctgtttcctcctgtaaatgtttgttattcttttttttctaacgttaatagataatgtttgtttctcccaaacattagggcattccaattacagcggaggttgctgttccagcaggtggtcaaggggcaaacacaaccgagccatcttctactagggaagccagtctgtctggaattccaaacgcatccccgttaaatcttttcccacaggtttatatgctatcttggttattcattaccatcgcctactattgcatgtatttaacaattgaaatttagcagggcgatgcaaatgatggaggtggtgctggtggtggaacacttgagttccttagacataaccaacaggttgtcatcctctctgttttgccatataagattatttttgttttttgttcagtataattttcctgagcaaatatttggttttttaatatagtgtttcttgaatatataaattatgttgccattgtttgtctggtaccggataactaccttttagcttttcatagccagcaatggagccactgtatgcatgataagatgcttttgatgctgctagcattgtttctgattaattattgttattttgatagcacaccctgtcatcttttgtgcttgaacagcgcaccaccctgtatggtgtgagcatcaacttagtgaaacttccatatcatgttttccttttttgagacaggccctaatgttcacatcattttggtaccctcatgcgtattcgagaaaaaaaagcatcattttggtatacctccattcagtataacgttgcgttgtttgaattgttgaagtataacacccctatcttcactattttgcagtttcaggcgcttcgggaaatggttcatactaacccacaaatattgcaggtcatttatcttgtttgacatgtttacatgctatggattatcttgtatagcctgctatggcttattttgtatcacctgcctaatctttgtgctggtatcatgttatagcctatgctccaggaactgagcaagaagaatcctcaacttctgaggttgattcaggagaaccatgatgagttccttcagttaataaatgagccctttgatggtgctgatgggtatgaactgttcatctgcttgattcaattctggtttcatttgatttgttatagggttataggattcgttaatgcgaaatgaaaaaaaaatcaattataaacttgaaatgccattggtatgttctctgtgttgcttcagcacactcccataacttctttcaatggattttcctcggtgctacttgtacaatatggttacacctttttatggactttctgtggtagtacgtgtgcattactccggtattcatttgcactcgcctgcttcctgatgatacagggacttcttagaccaacctgaccaggatgagatgccccattctatcaatgtcacacctgaagagcaagaggcgattggacgggtatgtacaacatagttaactcacttattacctcttggtacagaagtatatacagtgtacataacattacataacaacaatgttttgaattattttcatgcttcagcttgaaggcatgggatttgacagagcacgtgtcatcgaagcattcttcgcctgtgacaggaacgagcaactcgcagcaaattaccttcttgaacatgctgctgatgaagattagatggaattatttaaacccggtgagaactcttgccatgtcctggccgactgtttccctgtctttggttcagtaggaaaccatgcactaacgattatgttttatttgtgggggccatgacagcttattctgtacacctgccctgcaatttatcagacttttgaagtttgcgggtgctttggatccaaattgaacaagctgagatggagctaacaccgcgttgcatcgatttatctcttgtacaatacttgctttatttaattgctggcttagcattcaaatacatggcttaacatttattcgagctgtctgagggacggatccttttgtccatccgtttttagccagaaatttcaatggatgtgaattgtgttgaccacattttctgtcctgtttgtgttattcaattcgtgatttctagagcagtaaatatagtgtgcagaaaacattgcgattgtcgagaacagagctccgttgcattattagccccttctcaaggcgagaatgggacaattgctcttacaaaatcgctactcaattcaaaataggccaggactcctttggaatgttggaaatttacaggattattacggacattagtttaaatcctataaaattcttgtgaatttccaccaatccaaatgaggttccctcacatctccgatacatcatctcatagtgtgcagcatagcttggagtcgatggatgccaggcaaatgcacaatgcctggtagccagtcaatgggtacctacaacaaacgatgcttatgctaatgaatctttgctctttgactgataaaaaaattcagaattacaccctgctatgatgaagattattgctttctttttttaacttacctgaagtccataatgtacttggatttgccaatcctaccaagctgcaatattgtctgccttcctttctcctgccaaacaaagcaaaattactcacagtttgttccgttgtgatagccatgagattccaatcagatccaacaattagagttcaggagtgtggcaacagcataaggttgctctgtttacctccaaagtcatctggaagttcttcaccgatggctgcaccttgtatcccatcctccctgccctctctctgaagtccagttcataccgttttgtcatctgtgaacgatgaatgcagcaggacaaacatcttgctatcagcttactctgaatcttggcatagtatcaatcaaataacaagagtcattttaaaatcttaagagagaaattgcatacattgttgtagaaaggagatcttgagcagagctgatcagccttgatcttcttctcttgccaatcctttggaagcccactgatgtgctgaatctgaaaaaaaaattgaacattccaaaaaccacattcttagcctaatgaattattccactgaatttccaacctccacaacaggaaattcacttgcctgagctgaattgctgttcttcagatgaatggattggttcttgggaatccaagccctcatgcttctgaagctccctgtaagcgtagtaacagtaggcgcaaacctgcacaaaaccaaaacctgacaaattcaacaaaaatcactcaaaaaccttcacaattcctgcatgaaatgaccccaaacggatatcgaatctcacgcgacgacgccgaggagccgcttcgactggctcttgatctcatccaccctgttcccctgcatttgcaaccatggacagttgaacacccacatcaatggcggctcatctccaattctccatcaaactatcaccatgaggaaggagagagagagagagagagagagagagagagagagagagagagagagagagagagagaggaggttgtggtttgttgtacctggccccagattcggtatctggatccgacgaggtttgagctcaatgtgccgaggaagttcttgtcggaggtgcagaagatgccgtccagattctgcgccaccacgaactccgacctccctctcctcctccggtgccgcgccaccgccagcttcctgtcctgccgcccctgccccttctgcgccgccgccgccgattagactcgctcaagcaagcaagcaaccagagaggaagatttggatgaaggatggaagaggctcacgttggtgtagagggagtagagcgcgacgccacgggcgcctgcggcggcggcggcgagagtctccttggcgatgatgcaggtgcacctgccgacgtcgagggggagagggcggcagaggagggcgcggttggggagcgtcgcccatgacgaggccggcgccgcctcgttgtcggagaggtcccacgcctcgtacgacgacgacgtcggcagcggcagcggcggcggcggtggcggcggtggaagtagcagctccctccccctcggccccatcctcacctgcaaccccgccaccaacgccaccggcggagacgacccctcctcctcctcctccctctccttctcctcctcggccttcatgcgaacctgcagcgacgacggcttcagcggcggcgccggcggcaccaccaccgccaccaccacaggcggcttcttctcccctccatccttcccccgcccaatctcggtgggcacctcgttctccttctccttctccttcgccgccgcagccgcagccgcgccgccgcgagcccgtctctcgaccgtgccagcgttggagctgatggggcggaggggctcccgcttcgtggccgccatgggaggcgaggcgcgagagctcgcgagttctgtgtgtgtgagagagagaggttgtgtgtttgtcttattcaaattgtgggggttgggtttgtgatttgtggtggtgatttggagggaggatttaaatttgaaacgcgagaggggggtgggtttgggtttgaaacgtggtaacggtcgccgtcttggttgggggttggactttttggggtggattgatttgattcctttttggagcttttcttccttggattttgccatttcggtgacacaagtacaaacctcatgtactgtgtgcccccctcatttgaatggaacacgcggacgtcatcatcagaatccagatcatttaaacattatacaaaaaatgttgaaattcaattttttttcaaatgtgcttggttggatacatcctgatgtactccatactactatctccgtcccaaaatatagcaacttttgactattaatctggacacactagctaaaaaatacttatattttaggacagagggagtagattggattgatttctattttatactatcaaaaagttgtttcaaaatctagaggtatattaattcatctatttcaaatttgctcatttaaaagctgactctgcaaaaaattattactcctacctatttttttcccgcaaaagaaaaccatggcatgcttaaattggacgagcagcagcagcgaacagtacaataaatgaatgaactgataaaaaaaaaggataagatgaacagcggggccgtaacgttgacgcattccatccatccgtaataaagctgcggttccaataaattcccaaacatgtgagccgcttttgtttaatgcgcaagtacgaagcaaactgcaaacgccagctttggaagcagcaatcatcagggtgctcgaattttgcggatgcagtgcaacttgttaaaaaaaacgccacccaaatttaaacgcggggatggattgggtgggtggtttggtttggcctccgcgcgccgccgccggcggcggtgggtgggtgccccttctccggcggcggcgatcgtcggcgtgcggcggcgacggagcggcggaggtgtgcatggtgatcggggtctgctccatccaatctccactctatggagacgagggctggttttcccagctccatccactctttttttcacccgcatgctttctaaatgttcacagttattttagaaaagttgtttagaaaatcacagtaatctattttttttagaaatattagttaatacttagttaatcatgtgctaataaattgttccgttttacgtgtgtagaagagttcctaacttgttgtcttgttgagaagaacacagccacacgggagtacattctccgtccctaagagcaggtacaatagcgggctataagttaactatacacatattttaaggagataaataagaagagagaagggcagcgggctacacatttgtagccagctgtagcacagactccaagacacattgtacgtatgacatatgggaccagctattaatagtgtagtatgtaactattgtatgaatgagctattagattggctatagatgaattggagctagtagttggctatactattaaacttgctctaaatataagggattttgtttggatgtgacacatcctaatacaacgaatcttgacaggcttacacatcctagtacaacgaatctgtatagagaaatatgtcatatccaaccaaaatcccttgacggagggagtactaatttgttggtaggttgggctcatatgttaaaaatgtggacccggcccactaataaattggccatgcgttggcaccagatgggcccacatggcagaaatggacctagccaatatatactttttgggccatcgcggaaaaagcgaaactgtctctcatattattaccggcgtttttccattcatttttggccgctttatcaaatcgttgccatggactatttgctccatgtcttaaacataagctctcttttttttaagataatggaataatcatctcggcctttactcaacaaagctaagtataagctctcttagaaacaacttttgcaccgtattcatttcgttaaacaattaatttatttttataattaagtaggtaatctgcattaataattaatttggtgaatgatatgtttcaaacgggccatgtctagggttttctttgaaaaaaaaaactctcgaactgttctgcgcaaatgaaatcaccgtgccatttgagcatttgacaaaaaaaaacaagattaattagtttgagataacgaagctgacgagatcaatctttcacgaatcctcctcctcttccttccgccaagtaagcatgtatagtagtagcgtctctcaccgtctcttccaagcgtgcaagccacccaccctgacgaaaccagaaaattcacttgttattactccatttacggggacattcacttttaagatgtgtcaattaattatttgccactcgctgtttataacatatgggtcctcatatgtctatgacatgtaggtctagtggcaaatcatttatcaccatccgtaagagtgataaataattaattattctccatttggtaaactacacggttggtggtacgagagaaagtagtgtgataaactacacggttggtggttggcccaacggccctaaccttttgaaacgatgtaccggtcctgttcgtctcagataatttaacagcaaattggcagtctaaacaataacaaaaacagttaaatttttatcataccagttttacgaacaagttgcgaggaaggtatcctttgtaaaaaggaaaaacgtagggcatagttcatacccgggttgaacgtgcgtgactaaaatctgaagtacacaatcacacacttgtattacttggcattcagtgagctatgttgaaaaaaaaaaccaaagatgttatattttgaattatcaggaaacgaagtgacatcgcgcacctccaagcatgtacacatcctccgttaaaaaaaacaacaacaacacttctaagtttaagtttaaggtatgtttgttttagtttaagattattgtaatctagattattgagtcatattaccataaaatgaattataataagttgacatagtgttagccgtttgtttctctggattattagctggttgttaggtgttagccacacaataattaaaaaaacagattactagattatagtaatctggcttttagatcgtaataacatatcataataagctttctgtttgtttcagcttacttctaataattcagattgtaataatgctaagctgaaacaaataggaactaaatctgaacataagtgattttttatgaagtgatcactatgagtaggcatttatcatgagaactattttaagatgtggttttcttaattttcataaaagaacatacacgtggacgtcttgcactgtacaatgtatatggccatcacaatttaagcatgcatcactcgaaaacaaatcatgcgtaatcatgcttatcaataggaacacacgttgtatctcaaagacgcaagcaagtaacccatgtttaatggaattatctctcgcacatatccatccagatgtgttgcttttttttttcttccacttaccaaatgtgcacccgcatgttagcatgtatcaccaaacatcatatctatcccagttcacaattgtatcaaacactttaagccaaacaaacccctcttcaacatcaatttgatttaaccaatctacgccctgtttttgttttctctaacaaaaattggataagcttttagatactcgtgacacgtttttcaaactgttaaacggtgtgtttcatacgaaaactttctatataaaagttgttttaaaatataagattaatccatttttaagtctgtaacgattaaaactcaattaatcacacgttattatcacctcgttttacgtgaaacacttaatttttatcttcatctttatcatcaggagattcaaacatcttagtacgtatcagcgctctttccaagtattgccattccacacaggaaaatataggttgtgtttagatccaaagtttggatccaaactttggtcattttccatcacatcaacctgtcatacacataactttttagtcacatcatctccaatttcaaccaaaatccaaactttgcgctgaactaaacacagccataagctcaaaagcacaaagcaccgctcacaaagaaaaaaaaaatatcgtaacgattatcctagaccatctgatccacaatccgacggctgagctgtcaggtgcttctccgcaagaagaaaatagaaagagaacatttaagaaatgtcattgataaaaacccaaatccgagaaatactattgacgagtacaggtttcataaaaataccatcgtacaagtgatttttgtcccagaaatacaatcgccgttatgattttatccattccgtgtcattaaatgcaccgttcattctaacggaaccctaacggagatagcatttttaagaacaaaaacacttgtataatgcaatttcatagaactctacttacgccgtgtttagttccaaaataattcttcaaacttctaacttctctatcacatcaaaacttttctacacacacaaaattttaacttttccatcatatcgtttcaattttaatcaaacttctaattttggtgtgaactaaacacagccttatcgataatatttcttgtaattggatcgattacatttgttgaattttctcagataaaaaataggctgtgcaagtgcaacggaacaggtgaagagttgcccacccatcccatccctcccatgtgccctgccgcccgctcgtgttcgtccgcgtcctcgtcctcgcctcgtcgcccgtgtcgcccgcgcgcccgccgcgcgcgcgctccccgccaagatttcgccacgccacgccaccacctccggcttcggctataacctcgccgcacgcgtgacgggagcgcatcgcccccttcccttcccttccctccccatccaggcacgcaggcgcgcgcgagagagagcgatgggagcggtggtggccgcggcagcggcggagatgaggcgcactggccgctgcggcggcggcggaggcgggggcggggagaagaagggggcgaaggaggagggggtggtggttgcggcggaggcggccgccgagagggggcggcggctgcggctggtggggtacgacgagctcccggacttcctgcgcgacaacgagttcatccgcggctactaccgcgccgagtggcccctccgcgacgccgccctcagcgccttctcctggcacaacgagaccctcaacgtctggacgtgcgcgcccccaatccccctcccaattccattcaatctctccttctcatcatctcatcggtggatgatttgcttttcaattttcatgccgattgtttgttgtgcatgccatgcagccatctcggtgggttcctgctcttcctggcgctcgcgctcgccggagccgccggcgacgccgccgccgacgtcgcgccggggatcatcaggtaaatacattgcatccacacacatcacatcccacccacgtcacagtcttattcaaaaatgtttttcccaatttctattcctttcttgttccacaatttaaaatgcaatcctcttcgctgttctaattcatttttaatcttacaaatagaaaaaaataaccgcgtgatttccgggtgccagtaggtatctttgaaaaggtctatctagtgtgtatactatttgctttgatgctttcatgtttgggacttttgctgtggtgccctctagattatgtgtatttactactttttaccccaaaatattcaaatatggagtatatttgctttggttacttgattacttctgcgaatgaataagctcctaccactgactgatttgttgccgcttagtttcctatattgttcttgttttcacatgctttcgcaattttgctattgtattatttatatattggtttttttaacgattattctgtaaattagttctatgctattaataaccatgtcgaaatcaaaacgacaaactttcgcatacggacaatcacgcaaagtttgccacacccctttttttgggagcaagttcttggtggtatcactagagctatagaggaccacctagagtagggattaccaaccactcccaaacaatttctgttcgtgttcgtgcacatgtttgctgtcgtaaatgtaatactattaacatttacagaagggtcaaatgcattcttacatgcataccactgcaaaattaccattcacactggagatatggagtagcatacagcagattgaaaatttgtggtgacaagatagattatgaattgttggtgtgcaagtgtatcatagtagtcaggaaaagatagatgctggcatgctgcccatgtgatgctaatctggataagctgaataattcactgtccaagattgtgagaatcgcacaaacaaggtccgagaataaggtcaggacgtgtactcctagctggggtacattatcgtctcattctctatacctttcttgtcggcaatgaaggaaatagtactccactataatacaatatggaattatggagtatctctttggaaatgcaatggctttggttgtgcaaattctaagtttgttggggggttttcagtaagaacatgggatgctcattagttcttcatgtaattaaatccttttcttcgtcatgagctctccagaaaatgaagggttttttttttcctgtttacgcaaaggccctttaattctgtgtcatccttatcttttctttgcaggtttgtggtaggatcaaccaatgcttcttggcagactaacgatcattcggtaagaaacgaatcgaagaatatatgaatatgtcctgttttcgtattactttcggcgatactagttattttcatgactcatcatattacttttcggagatgctgaaacaaacatccactctctagaagaaataacaatcattaattatttaattgtttactcctcagcagattatatcccttgtcacagctcgcaatctttgctactctgcacatatctgaagaaaactgcagttatttatgcaccattattgttggaactttactgcatagaattttgtttgacactaggtaacgaacgacatagtttggcaatatgggacgggtttcattgctcattcagataggtgcactatgccgtaccgccattagtaaagcttgattaagctaacgaattaatctagccgggtcccaccatccattgcaagtgagaaagggacatgaacggccgtgatgagctgcagccaacctagggtcttagctagggaacacacacatatgtcatccttgtccttgcattctgcaagctgcaaggagaggacatgttcatcagctttggtgtcttggagatgcctctgctgctttccatgtatcactggtacaattgtccaggcatctatccacacttccacagggatgatgatgattgctgatgaatcggcatctatccacacttacactttggagtagtagtacagtacttggcaggccagttctgaattcggttttgagttctctttggacctcattggattattggaaacacgagaatatatcccagatttctgtagaagtttaacagaaactcctgcgaaaaatttagtaatgttccaaaggagacctagcaaaagcagccagattctaacaaaaaaactgtacactgcaatcacaagcagcaaggtgtttttggtgccatgtgagacagttcaccttgtgatggagacactcctctcttcttggaaacaaatgtagcgtttggcttttgctttgctggtcccttctttttatcattggcaaattaagatttgctagatagtttgcagcattttcacgaatgctcctgaaatgatacaatgaacgaagtgacacctgccatgagcactagcttttgtcagccatctggcccagatcaatgagcagacaagaccaagtggcaaatctttgtatctatcctgccgttgatttctgtgatgaccaatgactcaatccgtctatgaatcttcaacaatttcttcttcttcttctttattttgagaaattacgatgaaattcaaaagaaacttgaaaattgtgctcactatttttaagtggcactatgcttgcatatgagttggtgtgtttgcacttagcatcatggtagtatgcagttgttacagtgatgtgaatgaaggtggcattggatgcagggcgcggcgagccatgacgccgcggcggcggcagcggcggcggcggtgctgggcggcgggcacggcgtgccgcggtggccgcggatggtgttcctggtgggcgccatgacgtgcctggcgatcagcgcgacggcgcacctgctggcgtgccactccaggcgcgccagcgtggtgttctggcagctcgactacgccggcatctccgccatgatcgtcgcctccttcgtcccgccggtgtactacgccttcctgtgccaccgcccggcgcgcgtcgcctacctctccgccatctcggcgctgggcgcgctcgtcgtcggcgcgctgctctcgccgccctgctcgtcgccgcggttccggcgtctccgcgccgcgctgttcctcgccatggggctctccggcgtcgtcccggcgctgcacgcgctgtggctcaactggggccacgccgcctgctacctggcgctctcgctcgaggtcgccatggggctcgcctacgccgccggcgcctggttctacgtcagccgcgtgccggagaagtggcgcccgggcgtcttcgacgtcgtcggccacagccaccagatcttccacgtgctcgtgctcgtcggggccgtcacgcactacgtcgccgtcgacgtgctgctcaactggcgggagacggtggccgccgcgtgcagcgcgacgtcgtaggcgactctcctctcctaggcattttgctcattgcgttttgatgattcaaacaatattcaaatttagaagaatggagcagtgttagatgagattcaggatcagggtgtgtgaccttgtgtcattcgatcgatcgaacatctatatgtgatgaattgaggacgatgaagaaattgatttacagtacaaaaaaggtcgtgcctccaaatcccggtgaactttggaagttttggtttccttcaatttggaagttctggtttccttttcgtttattaatgcgagatctgaatttaaggggttgtcacgcatgaattttaaatgaattttgtattaactagttcaattttcacaaaattcatatgaaattcgtccgttccaaaggaggccagaacgacggcgatgactgatatgaggacgatttgtggtatgcaccgaattttccgatcctttatttagagaagatttgctagtttttacaaaacttccccaaactttacaaaaagatgaagaacacgagacggaaagggctgcaggggctgccatcttctcaatcgaagacgacgagcttgtcgtactccgggccggagatggccttttccatgacggcgcgcggggagacgacgccgtcgccgtcgaggaacagcttgaggaggttcttggagaagccgctgaccagcgccacccccttctggccggaggtgaccggcacggccttggagtcccgcaggttccagaacaccacctccggcacggcggcgccgtaccccgccgccgtgtacttgcgcacgatcgcctcgtagtccgtctcccacggctgcgccgacgcctggtcgaactccatgtcgctgaacaccaccacgcggcgcaccatcttgtccggcgagagggcggcgcccgcggccacctcgaggatcttgtcgaacaccgcctggaagttggtgttcatgccccagttcatttcgcggatgaaccgcgccttgtcggagagtgcctcgccgacgatgtggtggagctgtgggctctcgctgaaggtgatcacgcggccgcgccacgggtcgtcgctgaggtcggaaacgaggaggccgagcgcgacgcagacgtccatggggaggccggtcatgctgccggacacgtcgcacacggccacgcagttgcggagcttgccgagggcgcgcatgtcgtcgaccatgcgctgccactggaggtcggccacgccgctgccgccgccgtcgtcgtcgagggagctgatgatctggtgcgggagcagcgcgcccgcggagatcttcttcttgccggacttgacgtcggcgaggtaggcgttgaagcggtcggcgtcgtgcttgaggaagaggtccttgtagttcttcatcgccacggaggcgacgcgcgtgtacaccaccgactcccacgcgcgcgccgagatgtacacctccgggagcttgagcgcgcggcggagcggcacgagcgccgccttgcggaggcgctcgcgggcgcggtaggcgtaatgcgcgtcggggaggtccgcggcgagctccggcaacgagcccttggggaagaggcgccgcgcgatcgcctcgcagaggagggtggagcggtcgtacgacttgtccagcgacgggcaccacttggcggcgagcgagaactcgtggacgttgccctcggcgagcttgcgcatgtcgtcgcggaggaggtcggcgaagagatcggccgtgcgatcgtgcagggatcggtaggtagggtcgcggctgtacctctccaccgccctcgccgcggcctccgcccgcctgcaccgccgctccaccgccgccttcgccgctagcctcccgtcgcgctccaggctggccgcgatgcgctcctccgccgaaccgacgccgcgcgactgcttcctgctgctggtgtggtagccgcgggcgaaaccgcgtccacggccacggaagcaaccgcggccgcggccacggccacggccacggcgggcgatgaagccgatgccatcagcggcggcgaggcgcgccttcttcccgggcttcctcgtggacaacccaccattgacgatgcggtggaggagctcggggaggtccttgaggtagccgaaggccgcgacggaggcggcgttgagcgcgagggtggcggggtggtggctgtggagccagagcgcggcggcgtagaacccctcgcggtccgacttgccggtgccgcgtacgcccctcaggttggccaccagccggagcgcggtcgccgggtcggcgccccacgcggcggcgagcagcgacgcgacggcggcggagggcgtcccgggcacgacgtggaagaagaagtcgaggcaggcgtcccccgacgacacgaacgtcggcgagaggttctccgtgagcgccttcctcggcgccggcttgttgaagttggcgtccatcaggtcgaggaacgcgtcgcccgtggtcgtcgccggcgcggcggccaccgcagcggaggggcggcgtgcctccggtgggccgaggagggtggcgatggcggtggcggccatggagagagagagagagagagggctgggtttgggctgggtagtggatgggctttggagttgagcccgctgggttgatgtggatgtgttggtggaggaggacgcgtggcttatatagggaggggtttcgtggcagccaaggcggtctaggtcggtagtgctcggcaagttggcatggatgaaatgaaccgacattagcgtatcaagggaaaaaaaaaaggagaaaataaaaaaaaaatgaaccggcataggacgggtgtgtatggatagtaggactcgtgtaccgtggcgggcaaggatcatttcgttttttttttttggttttgtttttctcgtcgtggagcacatgtagcgtgatcgaaagactatgtgttttctactgtagtttgaaacagctgtcgtctttttgtttttctttctagtgactcaagcgtaggggtggacaaaaagctcgggctcgcgagctcggctcgggcttggcttgagctcgcgaagctcggctcggctcgaagactaaacgagccaagcccgagctccctccacagctcgtttccaaaccgagccgagcccgagctagctcgcaagctgctcggtaggcttgtcaagcctatggaaaactgagttccctaagcgagcccaagcccattaacaattgtctggcccatgaaagagagaaaccctaagtcctgagctgagccgagcgcgagccgtgagcacctgacgccccagatccgatccctcccctaatccccttcctccgttcctcagccactagcgcagtggcgctggcggtgactggcaagaggagttgccggccgccgcatccatcccctccccagcgccagaccgccagcggcaggccggcagcgccgttcgaacttcgaagccccctctgtgccgccgccgccggcccgccacctcccttccctgcgcggctgcgccgcgggcgtgccgcctcgctccttgcgccgcctacctcccctactgtggctgcgtcggctccgtcctccctccccggcgacgccccctgtgccgtcggcccaccgcggcgccgcctcccttccctagttccctgcaccacctccggcctccgtccaccgtccccagtgccgctcgagccgagctcgacgccccctgcatcgccggcgtccctgactcgacgccgtccatcatgacctcgccgagacgccatgtcgccaaccgatcgacgacagttcatgcatcacaccgcaacgacgagcctaggatgaagaggttcgtgatgtattttctcatttttgtgatgcatgtacatgtaggcatgtagctgtagattgttgtggtcagtggagtagcgtgtgtgtgtgtgtgtcagtgtcaaactgtcaatgattcaattacagaaagaatgaggcaaataaatcaaaaatgttgtaccaatactatagtttgaggctttgagccatgtgttttgtgtagtatattatatatgagagtgagactgcgagtctgcgactctttgttagttgttatactgcactgcatatacttcacactcttgtttttccattgtttataattttgactcatctttaaatatgttgatagatccaaatccaaatcaattggtgcttcagatggtaacgtcgtcggtgcttctgcattctctactactggtgcctcctcccaagcagttgtagggtctacgacaagtgatatggcatacaaagattgtgatgtaccattatctccaataatagccttggtacagtacttgccctacatgaccttagttctaaaatgaataaatgaattgcatgtcgatatgcattgattaaattctgttttgtttatgaactgtagattgatgacgataattcaaaggataattcttttgatcacattgatgacatgtcaatgtcaatgccaagtggtgatgaggcagcgactggtggtactagtgatgcttctggaggggattcattgggtggacgccgaagaggaaagaagctaaaggtttcacccaaagttgctactgtaaaggggaggaagcggtcaacttgttggaataacttcaccgaggttaaagttacttccaaggtaactccaggggagacagaaacaaaggctaagtgcaagtattgccattcattgtatgcttacaaggctgggggagctactacacatcttgtgaggcacatgaacaagtgcacgccttacttgaaccagttggccaagaagagggctcaagctgttctcaacttcacggcagagaaaggtgactcagatatccctctcattgtcacccctagtgagtataaccatgaggaaactcgtaaactgatagctaagatgataattgttcatgagtacccatttaggatggtagagcatacttggttcaatgtcgtgatgaggtatttaaacccttcatatcagtttattggtagaaagaccataagaagtgaatgcttgaaggtttttcattctgagaaagaaaacctcatgaagagtattaggagtgtggaagtgattagcttaacatgtgatttgtggacatcaaatcaaaacctttgctacatggcgttggttgcccattacatagataaaaattggacaatgcaatgccgagtgctgaactttgcagagttggatcctccacatactgggaatgtcataggtcaggccatctttgattgtctagctgaatggaaaattgaagacaaggttataacaattactcttgacaatgcttccaacaatgatacagctgtcaagggtttaaaagctaagctagcagctagacgatcaagttgttacaatgctaaatacttccatgttcgttgttgtgctcacattattaatttaattgtgaatgatggcttagcacccttggcatctttgacaaagaacataaggtctactgttaagtacatcaagaaatctccatctcgtatacacaagtttttagaaatctgtagaaatcttgcaatggaattgggagagggcctgaaacttgatgtgaccacaagatggagttcaacttatcatatgttgagaacttgcattgcatatcagcaagcattagattcatatgcagaaacagatttaaattatgagtggaagcccagcccagaagagtgggatttgtatgcatcaattgagccaatacttgggtctttggctgaggttactactgcattttcaggatcaacctatcccactgcaaatattttttacccccatattgtcaatgtgaaagttgctttgagagatgcttgtgcttcacaagatgctaatttgaagaatatgggaaaagcgatgttggataaatttgacaagtattggaatgtgaaaaacaatgcaatggtgcttgctactgttctagacccaaggtacaagttaagattcattgaatggtgttttaagaagatttatccaactgattttgaaaaggagttagctgaagttcgaactgaattgaatacactttatgataagtttgagaaggagcatagggaaaagatggcagctagcaaaggtaggagcttgagagcttcatcatcagtttcaacttctgacataaacaagtctctaccctctgtctcaagcaattttcagtcttatttgcaatcttcttctgaagatgcatcaaagtctgagatgcttttatatcttgatgaacgaaatgaggacttagcgaacaaagcttttgatctacttgtgtggtggaagttgaatggctaagaactttttgactataccagccagttcagtgtcatcagaatctacttttagtgctgggggaagagttctaagtgattatcgtagttctctatgcccaacaatggttgaggcgttgatatgtgcttctagctggattagaggcgctccaatgattacggtactcactattatgccatgcatatttaatgcatattctcttcttaacacatgacatgagtagctgaattaacttttgatttttctgaatttcaggcagcagaagaagaagaggatgttgagagtattacatttcctcaaagtgtagtgcaaagcaactagtaagtaaatggagtacttcactcattttttttcctatttctttactatcatttgctcgcttgtgattacatgatgatttatcatttatgtaggcaaatggatggctcatggctggaacatgttgctgtggagtgtggagaaagtctaggagttggagatttggagagttccttttaatattttgcgaaataataattagatgttctataattattttgtgaatttgagaatggagactttggacttttggaatgtggtctactctaagttatgtactctctataagactataactatattactctatgcttctattatggtgtggtcatgactattaagattatgtgtgtcatgttgggacatgtcctgtgagtgtgaggctgtgaatgaatgatggagattgtggaattgtggtcttgtgaagttgtgatcttgtcagcttgtgaaatgtataatatgttgttgctgtcttgttgatcgtacatgttgatttggcttgctaattgattgctctattgttgaagtatttacttgctgctgtacatcacaagctggctcgagccggctcgagctttgaaacgagccgagccgagctgcactttttgctcgttcaattaatcaagccgagccaagccgagcctgtagttgagcaagctttcacgagccgagccgagcttggctcggcttggctcgtttccacccctactcaagcgttgcagatctggagactggacttcatcattctttccgagaaggcgagaacgggatgactttgagaattcgtgcacttaatttctgagtaacatggtgattttttttaaaaaaaaattacacatataacttttatataatatttcctccgtttcagaatataagatttttctatcattactcatattcatatactccctccgttttacagtttaagtcattctagtattttccacattcatattgatgttaatgaatctagacacatatatctatttagattcattaatatcaatatgaatgtgggaaatgctagaatgacttacattgtgaaatgaaggaagtatattatgtctagattcattaacatatatatgaatataggcaatgctagaaagtcttataacctgatgaaacggaggtagtacgtattaattgattttttttttcaattcgttcgttccctcgaatcattcggctattcaacatagcattttgttccattcaacatttcgaacaatagaacaatgcacaatggattttacttgaaaataccggtattattgtaggtggaggagcagtggatacgtaacatcatccagtaggttcaatcttgatgtctactactctgttctaaaaaaagccaatcttggctatgaacctggacaaacatgtgtctagattcgttggtaggattaggtttttatgggacggagggggtattaatgaagtgtgtgttagaggacgctttcacggctacacgagtgtggtaggtttctatgagtatacggttggcagttgtgccattgacatgtgggttatagtaaagtagagttcacatgttagtgatacatgtgcaaactgcacaaagtcagatggtttgtttacgagcgtgacatactccctccaaaaaaacaataacttttggttatgaatctatagatataattagattttttttttatggaacggagggtgtatatgtgtcctccatctaaggaaaaaagaaaaggtttattttgacttataagagttaatcacatgatattgcctcagctgccattttctatcgtgcccgagaggattagatggccaaagtggtcccggtcaaaattagatggccaaattggcgggtatttacataagttgttcttgcagaaacaattgttcgcacatactagcattgttaaatacacttaccaggggcctagtagtatatatgttaaaatttactaaactagggggctattcactttgatatctaaatcaacattaccaaaatttgtataaggttgaaaagtgtaagcttgtttagtttgttctctttgtcaagtttttgtgagagattctagaattaccaaactttgataatggagacaaattttggtaatctttagattacttaccttgccaaaaaaattttagtaaacccaaaacttggtttgatttattttgggaacgaagtgaacagcccctagatttcacaacgaaaaatgccagggagaaatcaacagatcaatcatatggtccaacagcagcacagcaatggaacatatgctcaacatcaaaccaagcaagtgcactaacaaaagcaagacaatgatatgaaagaatattcagtctgcttgaacgaagatgataacatcagtggtagctgagagtctatttacaaaggaacctgatcatcatcattatgtacaaaggatgaagaagccacaagcaaccaaggaagtctataaatttcagtttcagtatatttacagttgagagtttctcccttcatttcagcagccataggcatgatcaggaaggcgttttcaacgaatattgtcaggtatcatcgcgaccgtcaccaggaagtactcacatcccacaggcagattgtacgggttcagcatggaagcgggcgaccggcggccaccgctatcaaggcgtgaagcttccatctggtcaccgtgcgagggcagctttgctatgcgccgttcgatgtgcacaatctgcccgattatgtaagctgggtgccgtggatgctgctccgtgaatagggccactgattcctctgataggtagtagtttgagcagttccggttgattgcttcgtaatgcccagcagggttccgaacaaagaccgcgagctcatgaacttcgaaacggccgaatgatatcttctccttactagcctgttgaacagtattgacaaccgaggatactgtcttgttatttcaatcaacaaaatttaacagactcaacctaacccatagagtaatatgtgcttattattgattagcgcggaatttaaactaaaacaatttcaaagtaattggcttcttatgaattcatttattttaataaaaacagtggcttaagaagttacgactcgtacctgtttttccagttgaagcttactgtacaaatttttaatcgactctttcttctcctccaacactcttacaatccttgagtagcgttctagcagctcagcactctgtcgtgatagaaaaccaactttgtctgccaggatcttgatgcattgctgaaactgaatggttgtatcaccttcatccttctttgcactgtttcaataaaaaagtattactcagccagtaaatctgctgtttcgataactctacagcagtaggggatccaaaggaagaaaatgctaatacttttataaagtaacagaactctatgcaaaggaaactactctgagcaaaaagaccaaaaacatacaatcatctgaaggaacacaaaattattttgacgaccaatatttcactgtaagcacaaaatacagtttactactccctccgtcccaaaatataagaacatctcccaaaatataagaacagtttactactcactgtagaaagcatgccaaggttaaataacatctaacatcttcctagctctgtttactacaaattatgcaaaaatgtctcgctaaaataacatccagcgcctctctaaatctcaacaatgagccaagatacagaaaatctggacatacttcctggaagctaccatgaattctattctgctgtttattttgtcggtctcactgactgccaactcacaaatcactaataacttggatatgttgaaccaagatacagcaaatcttagaagttccttcgatcctatttttcttgtttattttatcagttccatagacttggcatggatcaagcccaacagcacaacgaacttgggggtgggtggtttgtaaatgaaatgcagaactgactacacatgagtttaagcgaatgagagcagtaagataccttgctaatgagagagctaaagcacgcagtgagtccgcaaaaccagacatgcctggtgcagtgacacagttatttagtctctcaaacagaccatgtatcctcagagcagatgaacgcagggcatcatactcaacagcccttctgtcagctgaacatttgtttgtgcgggcctcttctcttgcctcgtgtaagcagttctccagttgcacacagttcatctatattaaaatttgtaaaagaaagtaagcagcaatttcaattgagcatgaaaaaaaaaactattgctgaatattctacctcccacttgacttacctgagactcatcaagcagaccctgggtgtgttcaagttctttcttcagagagttgacctcatccaccaaggcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgca

SEQ ID NO: 5642 - DNA, 41094 bp, Oryza sativa
  unsure (1)..(41094): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagtattggaggaaaaagtaaaaagacatatttgcaaatgaaaaataatttatgaataaaacttttatatacaatgttcttaacgatctgaaagcaaaggctaaaaataaggataaaaatttcaaaattaacttcagatttaagcttaaaaatttaaattttgatcaataataagtataaatataggtgaaaaaatgaggatactatgggcctgtttgggggagcttaagattttaagaagcaactggttggtagtcagcttcttagaatctggaaaagccgggtttcccagtttctggcttctagttcattttctaaattctacaactacagcttctcagaatctggactaaaagctagactgtttgtgggagcttctgattataggagaaactgcaacagctagaaactcctccaaacagaccatatagttggctagagatgttgtagcctttctctcatataaaactcttgacacgaatttgatatagtaacaatttatcccctcacaccaccataccaccttgaacacatgcacaccataaccagcctgaattgccattaattttgataatttgactctttgcaaaaactaattttacaaataaaccgccgccaaaacttatttcaaaaatgacccttttgttcagcgccaaatagcgtggcactgaatttagatacctcagcgctaaatagcgtggcgctgaatgtacgttggcacgttgactcagccttccatccacgatggcacgacattcagcactagatgatgtggcactgaagtgtgtaagttcagcgtcacacgatttggcgctaaaaaaaagggtcacttttgaaataagttttgacggcggtttatttgtaaaattagttttttaaaaaggtcaaattgtcaaaattaataccggaattgccatatggacctatccaatcatgcaaccatgatcgatcaatcaatccaatccaatccaatccaatccaatgcatgcatgcggcgtcatgactcgtgccagatttttttcagggctcagaacagatttcaggattcaggcaggcagcagtagtgtgctggcctgttgcattcgtgcatgttgcagcaacagccacgcgtcagccttaattaaatgccgccgttgacgagctgtacggcatactagtagcacgtcgaatggacggccccgatctgtgtctgcttctttttggacggatatgatgatgtgatatgcatgcgtggtacactgtttattttctgcctatcatatagggtgcgtttaggcactgtttagtaataccaaaacttatctgaacttctaactttccatcatatcacatcacatctaaaacttttctattcacataaacttctaacttttttttccaaactatcaactttccccaaacttctcttcaatttcatgaactaaatacagccttagttaacgttaaaattggaagtttggttgaaattgaaacgatgtgacaaaaaagttggaagtttgtgtgtaggaaagttttgatgtgatgaaaaagttagaagtttgaaaataaaatttggaactaaacttggccatagtagtaatttttatcatgatttttgtaccacgttttttaaacaactaagtgtattctgtgcgaaaactttatataaaaaatattttaaattattctaaatttataataattaaaacttaattaattatacgttaataatttcattgtttttcgtgtcctaatttcatcttcaatagaaataacagccaccttagctaaatgttggaggatatggtcaacttatggcagttgctctcaaatcattctccctatgtagtttatgttattgaaaaattctaagaattaatatagtatagaatataaaaatgaactaacttagagattgaaaatcctagctttttttatttttattggtcggctaatctattatattattaaaggaatagaaaaaggagcctccacgttcactcttatggcctagaaattcccacattaatcggagaaaaagaaaaaacagagtccatataggaatacaatttaaaaataggtgaaattcggaattagaaaataaggaatattagaagaggagactagagtccatatagaaatacaattaggaaataactgaaattcggaattaaatataaggaatattagaagtagagtatagagtccatatagaaatacaattaagaaaaaaaaagaaagtcggaattaaaaacaatgaatattagaagtaaagtatagagtacatatcaaaatacaattaagaaaaaaatagaaattcggaattaaaaagtaaggaatattagaagtagagaatagagtccatatagaaatacaatttacagaaaattcggaattaaaataaataaatattaaaagacgagtctagattccatataggaatatatataatttacaaataactaaaatttgatattaaaaataattaataactaacacgtatataaaatacaatatgaatatgacacattagtagttttgtaaagttattgtaaaatttaaaattatgtttaaatataaaattttaatatatttgaataatataatgagaaaacatatatgctattatatgagagaaaatataataatactagtcgcgtaatctgtacgggccatcatgctagataatactaaattgtaagcggcttatcagaatctgcagctcccgaaacagcggctgtagcaacttagctttcgtttggttggtgcctgtttgggcgccggtgggtcgagaattgattgcaaagttaggagtcgtagcactagcaatcaattaataaacggcacgacggcgaggacgacggagagaagtagtgtagtcctagtgctgccattgttgcaggagtacacaggttgcaagtacaggccggcaatgaatgaagtgatagataggtgttgtgcatttgtgcatgagagcagttggctcttcgctggccccctgagtctgcctctgcctccctgcctgccgccggatcattcacggagctctttccatgtgccgtttgttatactgctactaaaagagtaattctacggtgctctttattggtagactagtaaaattaatctgaaccctctaggactatgttcggttgcacttatttcaattgtagtgtagccaattcgaacagtcctatgtgtttgttgctgcagcaataaggggtacattgtggtgtagccgaacagagcactttcatactactactttatcttctcgttttcccatgtcgtttaaaaattcattaaaaagtctagaaaactttaataaggcatgtcgatatatgatatgtcactcaacaaacgattcaaattcaatttggagagtagaaacgccaaaaagagtaaattaactgcatattggattagttttcttaatttgccaaaggtttcgccttgaactctcttgcacatttttttcacttttgaccagccttgtttactcatttttttgggtttggtttggaccaatggcccagctgtcagatcgtctatatatgagaacaaaaaacggcttccaaggaaagccctggttgtggagactggcgagctccctgacgaaatcctccaacgccatctacttggtgcaagttcgtcggcaacgagataacccaaagtgaaagtgtatattcggtgtaaaagtgaaaaaatggttcaagatgcaactgtggtaattactagttcgtcgtgcaaattcaaacaaaaataaataaattttactgcaaatcgttattcgcggtcaaatttgttgttttgtgtttctagtttaacttacatatttatctgttttgttaagagaaattaattttcgtgatagctatttagacgtacgacatgtataaaacggcgggaaaaaaatccacaggccgggcagaagcacatcattgtcaaagcactataaacagtatagtggagtactaactaatataggctgtgtttagttcacactaaaattaaaagtttggttgaaattggaatgatgtgacggaaaagttgaaagtttgtgtgtaggaaagttttgatgtgatggaaaagttagaagtttgaagaattattttgaaactaaacacagcgatagtaagtgatgtataaatattgagttacctcataatcaacgaaaaataatagctgtcgatgtataatatctattggatgattgcgagacgacgcatgcaaatgattcaatggttcttgttttgcgaacgatgtggcacaatacatgtttagttttcttttgtcttaattagcacaacatagtatagtagataaatgaggagaatatctatttgccactagtatacgttttagggcatgtttagatccatttgaaatgttaaatggcaaatggcaaaagttttggtggcaaaagttttggtattgtaaaagtactagttggtgtttagatgcatgttaaagttttgccattttagcactaaagtgagagagagagaaagaaagagggagtggtcccgaaacactttttggcacaatttgctactatggattagcaaatgtcaaatgccaaattaccaacttttgctactagtgtttagatccaaaatagcaaaaggtgctataaaataataaaacttttgttattttagaggatctaaacagtgcttcagtggttgggaagcataataagctgcaggaaggacgtgggtagagagagtaattaacgtgtcgatgttggtcgtctcaactgtcaaccccatgtacccatgcatatatgcgcgtacgtcnagccgtcacaaaggtaggattcacatgcnatgctagctagtcaaacgntgtgtgggtgagcaccggggcgttgcgtaccgctgtctcgccatgaatgatctacgaggtacccatgcatacgatgtcggcgagctaagctagctagcttgctcaccaacggtatatcgtcgaccagctcgccggctgcttgagccatctgacattgtagtcatatttagtgagattttgatagctatagctttttttaagctttcctaaactgtttaactttttatttagatgctaaaaagttgtggttatatattctacagaataaagtgcaaggtagaagtaagatgctgtgtttaattgttagctccttgagattctcataaactgttactcaaaatattaaacacaaataaacatatatatttttttggaactatattacactatatagtgactatgggcttattcacttcgttacaaaatccaatccttttaaatttccgaccttgatcaaatgcgctagctactgcgctgcgataacgaaaacttagagcaagtttaatagtatagtcaactactagctccaaatcatctatagccaatgtaatagccaattcatacaatagagacttactacactattaatatatggtcccacccatcatattcacattacgtcttgaagtccgtgatgcagctggctataaatctgtagcccgctgctcttctctctcttcttttatctctttaaaatatgtttatagctgacttatagtctgctattgtacctgctcttataaaccaacaaactaaacatgcatgcatatataacattatattaccaacaaatactaattaaattttggtaattccgaaactagcttcctactctcaaaatttctatcaaattttgataagatatcaaaccaaatactactcaaccatactttaattatcttattaaaatttgataacactaaaatattttttttctatttggttacactattatttatgggtgcgtcgcatgcttatatccaatacaactgaacacaatcctttttataatgatttaaataaggcaacaaggacataactacaccgataatattagctggatagtattaaagagagatacccttaacgggtaggtacactagcattgatcgaggatgagatggtgaacagctagatttagctagagagatctatcgattctcatgaaaggggacgaataatgctgcccagctgactcgctgaccgtccagtaatggatttggctgcgcgcatgtactgtaatttctgtgattcttcacaggttcagtaacaacattacacgatggatggatttgttttgatctgtccgttttcatatgcatggtgtttgctcgctgacaggctagctagcttagctttgctctgccagatcgatgcatatccacgaggccttgtcgccaaaaaaaacaacatggaccagacgtacacgtgtccttttgatctgcgcgcaatatatgctgagaagcagcggataaaattttgaaaaacagagggtttgttcactttgctattattttcaacattactaagttttggtattatcaaattttgataagcttgtcaaaattttgataaggttaccaaattttgacaagattttatatgtatttgacaataaactaaatgtaaacactttttttaaactttactaaaacttggtaaagttgaaaatggtaataaagtgaacaagtcctgagtttttatcaggttcttgctactaatttattttctaaaattatctgaactgttttagaaaacttctgaatacattactatggaagatgttacagccaccgaaacatcctcaaacagggcctacatgatgcccgaacaagacgaacattaatttacatatacaagtgtagttacctataacgcaaggtttaatttgatccacgagaccatgatttcaactttaccagtttgaaaaaaaaaactattattaatccgcgtatcacagttggatgtcgctgaaacttttacaaaattaaaaccgtgccattgagaagaaaataagagaatgaagaaaatataaaatgtgacaatgataacacgattctagttttgtaaaattttaataatattttgctgatatcgtgaacagtaatatcatcgacaaattaaaacggcatggatcaaaaactaacccatatcgcaatggtagttcgttcctctagctccgtgtggtgcctttgtgtgcatatacgcgcccaattagagcaggtacaatagcaggctataagccagctgtaaacatattttaagaagataaataattagaagggcagcgggctacagatttgtaaccagttgtagcacggactccaagatgcagtgtgtgtatgataggtgggactacgtattaatagcgtgatatataactattgtatgaatgagctattatattgactatagataaattggagctagtagttgactatactattaaacttgctcttatggacgtgcttacaggcgtacagatggagtaattaattaaggtacccacggaggagaacactcacgggagatcggacagtgatcgcaagcacgtacggcgtagtacttgctagcagcttgtggctacggcaattttaaccatttaatcactgcanaaaggcgtactttgctagggcaattaatcacttaatcactggaaaaaaagcaaagctacagtaattgttggttgcgatgatttgcagtggagttaattattggttgcgattgcgatgatttgcagtgctggtttgcgtgaggacatgcagatgcagagggattttgcctctccggcctgttgtttggtgggcccggcctgtgttggaggtagtggcgtgtcttcttgcattgtgagcccaatttggtggttggatcactcccattcccaggcccgtcctgtagaatattctagaacaaggccgtgacagccaatacaaaaaaattgaaaaagtatactagcttattctagcccaaaggccgtgagagccaatggaaaaaactaaaaaaaaaaagtgagacaatggggagaaaaaaaattccgttgccgggactcgaacccgggtctctcgggtgagagccgagtatcctaaccagctagactacaacggattacaagctgatgctgtacaattatccattttgatgtttgtaaagaatcacattaactatccaatgtatcctaaccagctagactacaaccgattacatgttaatggagtacaactatccagtgtcaatgtttcttttttttccatgtcacggattatatgttttacaattgtattgtttagaatcgtatcctacataggccaaagattttgaagggaatgaaacacacacatggaaaggaaatatacgccgtgaaatgccatatattttaaaattgtgtatggtttacaatcgtatacagatgcatgcatacaaaattcatcaagccgatgtgattgggtgaagatcataacacggatggcacgcgcccagtagagctcagcagtacagtcacggagagtatataagtggcgatctttttttccaagtttgcccgtgaataaccccttttccttcgccattggaaagctggaaaagcgtacgtctcctttccgttgacagctcgagctcattcatgccatccatccaccgtccacgcacttttccgcacagtgcagccgcaggtacatcttcttttaaatggagtatttcgttttcatgcaaacatttgctgatttcttaccctccatctgatagatcggccttccatcatgccattgtgaccgtccgatcagaaatcaacggtcatgattggttcgacggtgcgggaaagcaccaacaatgtagtgatggagttgttaatgcatgacctcatccatcagaattcaaattatggatttattacgtaaatgcaagtgaaagctttcaatgcgactttagcaaaatcacagatgtgctggatttctatctctttgagccagtgataaagacagatgtacaaacttgaagggaaacatcaacatatgaaaaagcttaattaaagcttttctaccaaagaggagaaactaggtaaaagttataaaataataaggaaatacttataataaaatatagttgtttggtttggttacattttagaatcaactatagttattataactcgacaaattaaatcatatacacacataatatctaacaaatccaaatgtgtttaagaaatttttgagagtacaaggtgtatccggcctatgctttgagcgcgtcttagggaatgcaaatcaaggatgtatgagtgtggtgtgttgcgtgtgcgtagtgatcatgtgtcatataataaaatggttcaatcgtctgacaaggcagggtgcgattcttttaaaattctatgtaactaaaagttgaattagatttttttaatcactatatactagtcgtaatattagctattatgcggttaagttaccgttaccagagcacaacgtaacgtggctatgcattgcacgctagggttcaagtgacagatcggttatataaactgctaaatggaccgctccattttccgtgcgcactgttcgtgttgaaaagtactacctccgttttttaatagatgacgccgttgactttttatcacacatttgaccattcgtcttattaaaaaaaattgcgtaattataatttattttgttatgagttgttttatcactcaaagtacttgaagcatgatatatatctatacatttacataaatatttttgaataggatgaatggtcaaacatatgttcaaaagtcaacggcgctatctattaaaaaacggagggagtagcaggaacaaacgcggaaatgcttcctatcagacgtctgacgctacaaacaaaaattggacaggcaaactactacttccctatccactccacacatccatacatgttataatgatatttaaaataattttacttctgatctacttatctaatatatgatatgatcataccattatatttattataattaaatctttataacaagatatcacatcattatattccgatgaaagaaaaacttatgtttcaatccgttaagtttaatgtttcagacacggtagcaatatgtttcattgtgagttttcattatgtttcatagaaaagttaaatatttcagtaacttattttttttgtttcaccacgtacaatgcttcacgctgaaaaagtatgagacgcatatgcctcacacacacacactctctctcatacattttattgtctttctccccacaccatgcatgcatgcaactatttagtgattttaaaaaatcttttttcttccaaactacttaacctatgagcgattcgatcacaccgttgaattcgctataattaaatctttacaacaagatatcacatatgattatattctgatgaaagaaaaacatatgtttcaaaccataaaaacttaatgtttcatacatgatataaatatgttccaccatgtgtttttattgtgtttcacaaaatttttatatatttcagaggctgatttttccatttcaccatgtataacttaatgttgcactaacgctcaactgaaacatttgtccgtccgattttttttacaacatcggacgatttggatgtccgatttgtagctctctccgaacaaacgcagccttaatcccgtgcaccagcgcgcgcggatctcaccgtctccgatccgatataaatatctctcgcacttgacgcgcgcgggcgtcggcgacgcctcgtctcgttctcctcctccttccttccttttcccgaccatctatcctccccttcctttcccgatcgcccgcgcgcgcccacgagaaagattgagaaaggaatccatgcgagcaccgagccatgcgaaaaggaaaatccggagagtgctacggctcgaacgtccggcatcacaccaaaaatcggacgtctaaacgagcgcatgtgagaacgaaccatgtcactgtaacgtatgtgcatagaagatgtttcttttcattctttcctcctctctttaaatatttttttctcctaaattacttatccgatctacgatccgatcacaccgttgtattcattgtaattaaatctttacaataagatatcacatgattatattatgtcaaaagaaaaacatgtgtttcaaaccgttagaacaaaatgtttcatacgtgatagtgatatgtttcaatatgtgtcttcggtgtgtttcacaaaattcctgaatctacctgctactactctctctccacctcatgcatgcatacatgcatgtattttagcaagcttcaaaatgatttttcttttaaattacttattcaatctatgatccgatcacaccgttgtattcgttgtaattaaatctttacaacaaaatatcgcatgattatattttgatgcagagtaatccaaaccagagtaatccaagaggtcgaatgtactgatgcagccttgaacgacgccgacgtagacgatacaattgcctggactggtggaacattggacttatcccttcgccggagatcgaagacgatgcagccccacgtcgggtgccaagttccgtcggaacgtaaaaacaaaagtagaagtaaaaagggtggcgatgcgccgaattgtattgatcgtgaagatagattacatagactccgggtgtacatatttatacccatgggttgatacaagtccttgtcggacaagaaagaaactaacctaaagataaaaggaaaacataaagtctttatcggacactaaacacactttcctaaagataaaaggaaactaacaaactattcctaattaatagataaattgccataccacatcctctttaaactcggtcacttattgataagcttcctttagtagattgatttccttaaccgaatatagcaggaatccgactattggcgacttgataactcccatcggctgattccgagatgctgcagccgataatgattctaaaccgatgacgtctttgccgattaccaaatttcactgttaacagttgccaaggtggcatgaggcgccattactttctctctcttaatcaaactttaaacaaaattttattctaaaatatatatccaatctataatttataacaagatctcacatgaatatattttgataaaaatatatatgcgttctagaagaaaacaaacttatgttgaactatttaaaaataattctttcatcacttgtggagatgtttcaacccacttcacaaattgttccaaagaggtacaacatataaaaagtattgacggcaacaataatcattattacatgaaacattaagtcccgactagtgaaacattttttatatttagattgaaacatcgtattataattaatgtttaaacataataaatgtatttgctgaaacatataaaaagggatagcatgaaacattgctaatgaattagtgaaacatcaacaatgcttgttggaacatttcagtaacaatgtgtgcaacatttgaaaagtaaatttaaaagtcgtcggaatatagtcatgtgatatcttgttataaagatttaattgtaacgaatccaatgatataattagtttgaaattcggataaatagtttaagagaaaaaatcatttaaattttaaaacatgtttgaatgcatgctccgttggtttgtcgtacacctaaccaaccgtttcaccatgcacctacactgttgttattttagattgagacgtccaattttttatttctggccggacggccgatggtaagcattttcgggaaaatcccccttcttgcgatcgatccatccatcgatttaaatcgatctccgcagcttggcctctcgagagagagatcgggatcgagagactacgaggtctatcgtccatggccgatcgagacacatagctagggtaatttgttgtgtgtcgtggtggggggctcgatcgatcgatcgatctccatggagaaggggaagaggcggggagggtcgtcgtcgtcgtcggggccacaggcagtggcgaggaagagggaccagttccccagccgggccaaggactacgagctgctcgagccggtcggggatggcgccaccgccgtcgttcgccgggcccggtgcctccccctcggcggcgaggtcgtcgccgtcaagattatgaacatgtcgcagcgctctgaagacgatgtggtacgtacgtatgtccatttcttcttcttcgtcgtctctggatcatgcatacttgcttatgcgagtcgactgtgtcgtgtcattggtgcatgcagcatccaaactcatgcaaacttaagttcatcagtaatttctagtaatctagttgcatgatgatttcataaattttagtggattataatttttttcgtaggaattatcacggccctgaaggttctaagtttatgcatgttttccaaaatgatcagttaagtctttaggtcaaaaacgtaattagtatttccaaaggtagaatagaagacatataaaacaaaattgtatactatatgcatactataagcattactgaatatcaaatgaacttgatacacaaattagacaatgaatctgaaggtaggcttaagtataagtttatttacttaactaatacttaagtcttcgagtcgaaaagaataactatttctaacaatggaatataatatctacgtaacaaaattgtgtatatcatgcatactgcgtgcattactgaatatcaaataaacttggtacataaacaactaagaagacttaagtataagttttacttattaagaggtcttgaagtcttcgggttaaaaagagcaactatttcgaaaagtggactagaacctatacatacataacaaaattgcgtacgacatgcatactgtgagcattagcccctctctccctctgtccctggaaaagcgatggtgctagcattcatgatagcaagctaagcaatgcacatgaggcattttcccaacacaaatatctctacattgtatctaaataagcaacgtaatcaactctttgtttcgcataatgaatttaatatatgtctttgggtgaccgtcaccctggccttaacttacttcttcttactaagttaaatctgctatgtgtttgggatttagacataataactaattaaatttatagtattgcattggagatgacttcacaacgaaacagtagatgcgagtgttgatttgtagataattgtagtcttattaataacatggttgtgcatacctctagatgcatagtgtgcaagaatgaaattatgaacatattactcgtcagttgtattgagagacacctatatttctttactttctgcagaatcatgcctctgaggaagttaaaatgatgagtactattgaccatgacaatctccttggtgcatattgttcatttacagaaggtgaaactttatggattattatgccctatatggctggtgggtcatgctttcacttgatgaaatcttcatatccaaaagggtttgacgaaaaatttatagcatttgtcctacgcgaaacattagaaggcttagcttaccttcatcgctatgcacttgtacatcgggatgtgaaggtatgaatctttctcatgcagagtttaataaatatgaattaattcataatttatatggctaacatgtattacggtaacacaccatatacttcatacgtgatcttaggctggcaacatactccttgatcaacacaaaggagtgaaacttgctgattttggggcctcggctagtctttatgacccaatgattaatagacatggtaaaagaaagactcttgtggggactccttgctggtaatttctaaagaacagaaaagaactatttgtgaattttaaactacccaagtcaatttaatgctaatatactatttattttgtttttccctttaggatggcacctgaagtcatggagcaaaaggaatatgatgccaagtacttatcaattttgattattggcttatcatctttcagttaagaatgagtgtttttatttttatatttttcaataaaacaaaagtcaactgtagggcagacatatggtcttttgggataaccgcacttgaattggctcatggtcatgcacctttttctactcaacctccagcgaaggtatttgtttagtctaaattttttattttttttcatagcatcatgataacttaataccttttatcaaatattgtataggtctttctcttgacattacaacatgctcctccatcacttcacaatacaaaggataagaagttttcaaaggttcataaatatttatatggtggctcaatatgtgtatttttaactatactaccttaattgtacatttgttttgcagtcctttaagcaaatgattgccacttgtctaatgaaagatccatcaaaaaggccaaccgcacaacatttattggaactcccatttttcaaaaaggtaaagtttgaagacaatgttttgaaatccgtgctaaataagttgccatcgttgggtgatcggatgcaaagtatacaggtatgatccctacatcgtcctatcatagtcaaatattcatcccttcataatattaaattctataagttattttctgtaggagaatgaagcaaagctgcaagctgagaaaaaacctcttgataaatgcaaagagaaggcatcacaggtttatagtactaaaaatatactttgcaatttttgttacactaacaacattgttatgacaaatgcattttctctaattttcatttgctagtgcaattattacttgttcacacctataaattgtattattgctattagaactaatgaatgcatctaaattggtgctaacattaactaagattatgtgagatcaggttgttatataattttaatttatggtaaccgtcattatctagaaatcgatactattgtaacaatctttgaacatttttttacgtacaggatgagtatatgagaggagttagtgagtggaactttgatatagaagaactaaaggcacaagctgcactggtacgagtatacttttttttgcaaaggttgtaacaaccttttaactattaactatataaagttttttttgaacaatgtttagtacccagatgagaatgatggcggcgaagatgagtatttgcgttttctttttgaacttgatactatttgtgaaagtgctcccatacatgacgttcaatcacgagattactctaaaaatgaaaatgagaaggtaattttatttttgagattttttatttttattttagtgactatgttaatatatacatatatctaataaaagtcacattttcagaaggaaagcaatgaaatcacaagaaatgagaaaatagatacgacgcccatacttcaaaggttcatcatcgacttcattcctttcacaatgtttcatttttttaatacaataataattttcattaaaataattatgcaaatcatttcacaataataggtgttccaaatatgtattctttaacaataaatgctcaatgttaatgccacaatcttttttttgagccaagtatgttattgatgtaacaactctcataagatgtttacaatgcattgtgtggttatttgaccattattgtgttttattatatcattgccctctacttatattacatacaagctctatcattttggttggacatgatttatttaggaatgattccatgagattctgatgtaatcgcaagcataaaaaagtttaatacatcatatctaacttagttgtttatgtcagtgtgaaacaacttgagaataaaggaagccctaatggcctcgtgcgccacgagtcatttcaacatcgacccaaatcacctactaagcaaatcacaagagcaggcatgtttgtacatttccttatcccaactaaaaaagtggcggttaaatgcattataatagttttaaattaagtattgggtaattagtattgttcatattttcttatgcttattattgtttcacacattttaaaactttgcattttgaatatagtataaattttggagtggtttacacacattagagcaaggtaagaatgatttgttttttgcagtatcaaattgcaaggactttgatgaatatcttaaatcggccattcagaaaggccgttttaaagtgacggtagaaggtgctgaggttgagaaggtaagtcttttattatacgaaaattttctatatgtgatcaagtttttaaagcattacttttgacttgtttattgcatgatattttctctaactataagtaggggtaaaacaagttatatgtgacatggtactcattttgaattagtttatatcataattactagtttatgtgcttatttttgttcaattcatttgtccttctcttgcaatttacatgttttggtagagtatattcgccgagtaaaaaaaaagaactatcagacgaacatcatatttgatatatatcatttcatatatagggtataaagtcattttgcatgcaccctaagttatgtaatgccataatcttcaatttagtttatcttggtcatatgattatctatattatgtatgtttcttaatttgtagcttcaacatatctagttttagttgttaacaaattgcaatccaataggcttatgaactagttaacgtataaatgctattgttaaacattgataggaacatttttaaagtaaccatttgaaatcttctttgtggcagttggaagtggctacaccacgagaaaaggaattattagaacggattgctagtttggagcgaatgtacgcctctatttgaaacaactttcactatcttaacatataattctctagtttaaagtgaaagtaatttatttgtttataacatcatattttgtaaccatatatctttgtaggctccatgatagccaagaggaggttcagaggcttagagaaaagggtaattgtaattttgtcctaaaattatacttcccagagattaagaggtttactttagattcacagtttatattttgttccacatgctctttgcagagataaaaggagcaatgtcatgcccacagctacagtagcaaagtccaagtacaacccaagttagtctggaaaaagtacaagacaatttctatcttattaggtggttcttggcataacattgagcaatgtcaaatgctctagctgtcataagagagtgtatagttttagaaaacattatgacattatgtcttagttataatcttagctcaccttctattttattgtgtctaaattagacatattattatctagaagaaaaggatctaggagtgcaaatttgatgtttatgatcattggtcaagcacatggctaaaatagagcacatgttgacgtggaaggctaacttatttgcttgttatttatgtgcatgtttccctacgatatgtcaccgaagacacatgcatcttacttgtggatagggtttgaattttcttgaacaacatctcataagcttgttccatcttgaatatagttcaattatcaaaaaatatttgtttttttaaaaaaatctcgctcagtattttccacggcaatatcttttttccctaaatatactccttgttctcccacctagttccttacaagctagcactagacaatgcatgcaatgcaagttgcaacatattcccttcgttctaaaatagaccaacttctagtgtttgaattttgtcgcaaaataaaccaaggcctatcttcttatctaccatcgatccataaattgagatattttatttcttcaataccccttacccaccctacaaccaatacaactttcttattataggaattttatagtcattgagaaaataccttaaggtacctaaattttacactaaaattttttggtaccttgagatacttagtacctagaggtaccaaatttttacattataaaatatggtacctctaggtactttataaaggatggtaaaattacccttcttattaatcaaggatattttggtcttttatctctcctttaatttttcttgatgcttagggtttgggttttattggggcgcaattcattacaatttaatactacgtccatcccaaaatgtacgatgttggttagttcatttttaactaatcaatatcatagggagtaatataatacttatattttgaattctaatgttcttttcttctatgaagttgaagttagcgtatacaaaatgggaaaaccattagtgtatgttaaattaagttttaattactaaagactggaagaataattttatttgatattttaaagcaacttatataaagaaaggcttttaaaaaagtactgtttgtagttggaaaaacgtgctaacgaaaatcgaggtaaaatctacatcttaatatgaaaacaatgggccttaaaatgattcataatagcaagtttagtaaaaggctataaaccaattgtaaactcatgtgaaggtgagagaactagaaaaaaaaagaatgttggctctcattcgaaagctaactcttcacatactgcgaaataaatatgctaaatgtataggtgagagaaaaagagaggagaagaaaattagagacaactttataactaatctattatatacgtcagttttatatgggtttatagctgatagctggtttctacttttaacttgctctaagattttcaccaagatagcacccaaccgagcgattcaggtgaccgagccgaggccgcctcaatctccgggcccatcagctgcaccacgtcaccggcccatacctcactatacatgggctccctgccgtgctccggcccaacaaaaagatggcgttaatccatctggacctctcgccgccatcaccaccctgcctggcgagagtcccgtgcacgcgccttctttaccattacgggaagaaggcaaggacaacggttggggaggatgataaggaggaagaagagaggtgtatagaggtagatgtgctaatacatggggcccgcatgattcccacgctatctcagtcgtcacatcagtcaacaccaagagcaatactgccttgagagtccaaagttgggacccaatacgacccggtttcacaaagattaggaatacgctgtatctgatattccagtccagagacgatttcgaaaatcgaggacaagacgagggaccccaagtgaactttttcctatacacacggtactagtaacccaacctagagattcaggcctggtcaatctccaggcccatcatcagcttcgccacgccaccggcccatacctcgccgggacatgggctccccgccgtggtccggcccaacaaaaaataaaagatggcgtgaatccatccggacctctcggcgcgggcacccccaccaccactccgccattcccggacgcctccccacctcacgctcctcctccttctaataaccccagcgatgggtgggagccgagcccttcccctctcctccctcctcgccgccgccaccaaatcccccctcctccaccaccgccccctcccgctccgcctcgccgcctccatgtcgtcgtcgtccccttccccctctcccgctgctccggcctccgcctccgccatcgacttcctcacgctctgctaccgcctcaaggtgacgccgacgccgacgcgcgcgacctctgctctgtatgcttcctctgtttgtgccgccatggggattggcccgtgacgccgttggtgtgtgcagacgacgaaaagggccgggtgggtgaggcgcggggtgcaggggccggagtccgtcgccgaccacatgtaccggatgggcgtcatggcgctcgtcgccgccgacctgcccagcggcgtgaaccgcgacaggtcaagcgtggggattccatttccttcttggctcctagcgtcattcatgtcttggtagcgagtttcattgttttttttgcaggtgtgtcaagatggcgatcgtgcacgacatagccgaaggtatccaacattttcgtttgcttgaattggatctgtacggtgattgtgttggacatgtgcatgccgtgggtgggttgtgttgaagcgggggatttgatttggtggagtaggatgttgtagcattcaagtgcttataattgtcagaattgttataatgtgcgtgttttatatgttacacaaatttggtaaagtgatgatgcgttgcttgcataattagatggtaatcaaagtttatgcaaaatgctatagatttggtgtaaacttttcctagttacatttgtaatgggccatgacttatcccttacaaactttcttgtagctgcatgcacattttccatgttataagcagtttgaatgaaagtacttgcatttattttctttattcttgcaacttttgataatgattggctgtgatgcgaagatgctgggttgtttgtctcacttaaaaccttttttccctgttctccagctattgttggtgatatcaccccttcagatggcgtgccgaaggaagaaaagagccgcagagagcaagaagcattggaccatatgtgcagtttgctcggtggtggtccgagaggtaattatcctacatgcaaaagcaacatattaacattctttgccatgggagttaaatctgcttcgatcctgtcaaaataatatttgtttatcttttactaccatatactccctccgtcccaaaatataataacttttagacctcagaatttgtcccaaaatgtaacaacttacccaccaacattctcttcccaaccaatcacaaccctccaccattcacttttcccacctacctccggctccactactcatccaatcacaacccttcaccatccacttctacctactttcttaataaccgtattcaactctaaaacttcttatattatgggatggagagagtatttatttaaagtaactgtgatgctagcgtaaattgctgaaaacttcctggtgaccgtaaacaatattcttagcatgccagcaagatgatccaactgttcaacttaatgccttattccccactatgcttgaaagtccaacgagaagacctgagagaacaattacgatattgtttagatgctaaaaatattggttccagctgaaatccattgttagccttgaattaatactcatcatccttctagtgatgttcccttgacaaccagatcatatcatcaaggaattacttattgctgacatcaggaaaatagttcaggacctagagatcccctaaacaggttgtgttctcacactttggaacataacgtaaaagtcctttaggaagcactttgaaacaaaaaaaaagactaccatttggagaaattgttcttcttgcaggaagcaagatagataaaatactgttgtgtaaaggacagactgaagaatatacaaacagtgttgttctttgtcctacaatatttgatatacagtaaacatatgcctattctctgtgtcattttattcagctgaagaaatccgtgaactttggatggaatatgagcagaatgccactttggaagcaaaggttgtgaaagattttgacaaggtacagttttttttgtccagctatgtaattatttatcttgctacccacaacgattggaggggattgaggtgtggaattaatcccttcctcaacatgattaaccgaacaacgattggaggggattgaggtgtggaattaatcccttcctcaacatgattaaccgaacaagtcctaagtgttagagattttgtctaataagtaattagtatggatgtgggagtttgtaccctgtccctaacgtgcccccacgggggtcgccaacccctgtataagtgtatatcagtatatcaatgctcctgcacttgcactatcaactgctagtctaatgaggcatgatgtctgcactcatcatttagaagataagaagttatgtaaggaaataaaaatactggcatgattggcatcatttgttccaggctattagatgtcagaagtgccatagttaaaaagtattgttaacattaggtgagcactatagacaattgagtaaccctcaagagacttgagatttggatcactgttttccttaacttataattagttgtttttcttctttctattcaggttgagatgattcttcaagcattggagtatgaaaagggtaagctcttattttgctagtttaatattttgatgtatccagaatcatccttttcctttttgaattagctatgaactatacagatatacatttgtcaattattcttgtcgatatgcaaggatcaaggaaagttagatcaaatgtggaatatcttttgcattattgtttcacaaagcactgacaaactctaaatagtgtacaaattgataggcactcagaacatcttgactatattaatggagtttacagtatcagtaatgcttatgtatctgaaattttgcagagcaagggctggacctagaagagtttttccagtcaacagcaggtaagatattcttgggatttccctccatcaaattatgttctgttgtttgcatgagcattcggtatactcaattgaaatctgcgcaatggccttaactgttcaatacatcacaacatgcttgcaccagagtggttattgttgacataagttttgttttctcatgaatttctatattcttctgggggtttttttctccttgcacttgttcttaattttccaacatatctttatagcaaccatttgactaatgacctaacatttattttggttaattgctttgcagggaaatttcagacagacgttggaaaagcatgggcagcagaggtagcatcaagaagaaagtgaaattaaccaatcacatgacatttgacaggccccctttggtgtttcttttccaaagataacctcaaggtttctgttaaacttcacccttaaagactttgttagctctgggccatttggacccgatgcttagagcttgagaattgagatcagctggtttcagaggctagttgtttttttttgcttaagctgggttcttgtagctcacctgcctgcctccgggatgctgattcactaggaaagccttattggccgtcctcgttgttgtgatgtaaaatcaactaattcagtttttatgccaatcgagtttcctcgtctcaattgttgctatttgaatcgttgttttagataaggacgaactgtggtcgctaactaaatatatccccttatactgttaaacctttcattagccagcatacttttgtcatgtcaattcatgtttttgtcttaggctctgtttggaagtgattttggtagtggtaactttcttatttttcattagcacgcttttcaaactgctaaataatgtattccctatgaaagtttctaccgtatgtatttcccattttacacgtcgctaatatatcaagcctaactgagccagtctctctctccaattatttcggtagtatgcactaagacaagcgcatcgatgaagattgggaccaaataagctggaaatgatttcatctcttttctctatatcaacatatggaaataatttcgccagatttcaagatatatatagccatgtcgtttttttgttgaaatccatagccgtttcatttttgttggcagtagaaaaaatggcataaatttcatcttgtaaagtggggagaaaacgaaactgatggtaccgtacgtacattaacaattgaacctatttttatgaatagattggcctacgtatgtttttctttaatcttatatagggtgtgttttagttcggggaaaagaaaatatttgggtgtcacatcggatgtttgaccggatattagaaggggtttttggacatgaatgaaaaaaactaatttcataattcgcttggaaaccgtgagacgaatttattaagcctaattattttgttattagcaaatgtgggttactgtaacatttatggctaatcatgaactaattatgctcaaaagattcgtctcgcgatttttcatataaactgtataattagtttttttatctatatttaatgtttcatgcatacatatgtccaaagattcgatgtgatctttttgggtaaatttttttaggaactaaacaaaaccatactctatctatcccaactataaaaaatctagggtcggatggaacatttctcatagtacgagaaaatgtctcatctggttctatattttaataatgtggaatggagggagtatgtttttctttaaatctcctcgtgtatcaccctactaattaatgcaaaattaattctgcaatgtctaatcatgatagtcacagtcatacaaagatggatttggatcgacctgttggggtttaatttatcggcataatagtgattcttacggttacgccaccacctcattcgatttatttcattctagagatgtcggtattaccctaattaactcattctcgatcaaagtagtaatagtaagatgttagttaggatcgacctaattaattaacccacacattaattaattacttcatttgaggcttgaaccaaaatcatccaactttaattgaccaactagcaatttttaacaattttatatgagcatgtgtatgggtaaagcatactattattcactctaataaataatgtcatgtcagctctaatactccaaaagagtgggtcgtaatctgtaatgtgacacgtttgatagtgttggccaaaagctataacgaataaagtacagtgtcccctcactgcagtcgctgttgacaattgtatttcgtgtctttgtttgtagaattgataattcaaagctaagaaaaatatctgcttttgtgcatctaatttgatttagacatggggaagcatgtgatttgatggtgctcgacttcaaccagcggggtttaaattttggtgtccacgaatattaagcacgtacaagtgagttttcagcaggattttaataatatcagggaaatgtcattggttagtttatcccataataagtacttctaggatagattccactcctaagtcctaaattagctcagctagttaggtttcctgtggtggaaccaacctacccacattcaagttctaaatttgttcttgtggccacattttcaagtcctaaatttgatagggtgctcgtatttactgctaattagtctttcaatggtagacagagtattcgtcaacagtgagccgtccgtggtaacttcattaatctcaagatgtacctgacaagtcttatagagatgctcatagagataggagttgcgtgcgtatgttcataaggataagtgtgtgcgtgctgtgagcgtctacctttgtattgtgtttctaaaaaaagtttccacttgattaaacccaccatatacagattatcatatgattatcatattgtgtgagatctgaactcctttagcatctcttgctagttggcaagagacaaacatcttacaaatgtatcatcttcctctatatatatatataggggaaggaaaaaaagacaataaaaaatggctgccagttgtctagctagcttgtacgggtatgcatggccacgagcaacggtgcaaacggtagctgcagtagtacacacagcatacggagtaggtgacaattactccctccagttttttttaaatgaagttggctagttcaaatttatactagccaacgtcatataagccttccagcgaaattaattagctgcagctagctacaagccgatcggagtagttgcgacaaaatggccaccagcgatgatatggctgcagctcatcatctccggcgccacctcccgtggaggcatgtcaacggtggtggcggcggtcggtctcttaaggaagcccttgcacaaccccgtccagaatcgacggtctggctcactggcctctaccgtccgccgcgcctcctcgcctatgccactctgcaaccaagaaaatcaaattaatataaagagaaggaaatatctatagtatatatggtactccatccatttcatattataggccggttcactttgatgccattttcaaccttaccaaattttggtaaagttacaaaaaaaagtggctacatttagtttgctaccaaattttgctaattacataagaaatcctgccaaaattttggcaagctaccattttggcaatgccaaaatttggtaaggtttttttttggcatcaaagtgaacagtccctataagtcgtttaacattttcctttatcaagcatctttaagtttatttttggtgaaacacaatacaacacatacgctcacccctcctataaacatacacacttcccctatgagcactcttttaagtttgatcaagtttatagctaaatataataatatttttttcattacaaaacaaaacattatatcaaaatatactcaatgttaaatttaattaaactagtctggtgtcgtagacattactattttttctataaagttggtcaaacttaaagaactttgattaagaaaaaaattaaatgacttataatataaaaagagagggagtacaatgttatgtcaagtaagattctatatatatccctatagggatttggtacatgagttgtacgtgtcggtccaaaagctatatgctcgttaggtgtaatgtatgtgttgttatatgttgcacaccagtgctctataaagaggccttaattaaaagtacgttttggttatatgattcttttttggtttagagcctcatttaatttcgcatatatttttttcatatcaaggtctcaaatgtttagagatggtgattaattttgcactgatgctgcttaccgtgatggtgttgttattgacaagacggtcgatgaggttgaggaggatgtcactggtgtactccgggtggccctggatgcccaacacattgtcgccgacggcgaacatctccaccggcgtcttgtcggagtaggccaacaccctgcccattggaggcacctccaaaacctaattcaattaagtaattaagcacacatcaacttacattttcaggtcaatcgattgattaattatatattaaggtacaaacatatcttttgttaggtattgcatatctaaatatttcttttgaaaatactagacacttgttttgttacttggccaggaagagaaagtgatcacagggagaaataataatagtacgcatatgattagtatgcagtgctatgccatgcattaacccagaagtacacattttcagtgtcaaggttttttttttttgagaatattttcagtgtcaagttgagaggtaggagtggtgctcaaatcagcactccaaaaattaagtcaaacaccgcccaatctagccaagtgtccgcaattaaggttttaaaacatgtgcaaatggctatagaataatgcaaacacgaaatatacgatatgatattatcaaactgtgtaataattattatattattaaaatatagcgtaaaagggccatcacagtcgctcttactggttacaagaattatcatattataatatgggaagaaagtggagattgtctagactacaacaattaatgtagttgatctaaatcaatgtagatgatgagaagtagaattttgtttttatataataaatatctaacagccatgtaggagaaaaaaaactattactttcatatcatttcaagatttattccaatattcgttctatggaaacttttaaaaaatatgataagtgtgctctcacctcatcttggtgaacctcgatgatggaggcactttggggaatttccttgagatccccaaataacttggacccctcaaaatcacgcacaaaggtcatcttcttcaccccaatgttccatccacttcgtgccttgccaattctaccacccaatgctcgacacaatacctaattaaccacacacaagaaaaaaaacttaattctcaatatttattaatattttcatgaagattaaccttcaaatgcccagttcattccaaaatattagcatttctacatctgcataagttgtttgtttgcgctgtctttcatatattctccaagaatatgaaaattggaataattataacacactaatttgtgtacaatttattgatatatatgaaaatgataactacctccgtctcaaaaagttttagagttgaacacgggtattaaaacagctggtgaaatttggttgggaagagaaggcgaatataaattttgaatggtggaaagtttcgattggttaaagaaaacaaatgtaggcggataagttattatattttaaaacaaattttaaaggctaaaagttgtttttttttattttgaatgtgaggagtatatgttggtagattaacctggtggccgaagcagatgccgaggatgcgcttgcccatggcgtggagcgcccggaggagggagcagaggcggaggatccaccgctcgtcgccgtacgcgtcgtgcgggctgccgctcaccacgaacccctcgtaccgccccacctcctccgccgccgggaactcgccgtcgatcacccggaagcagtcccacctctcctcctcccctccgccgccgccgccgccgagcgccgagacgaagacgttgccgtacccgccgtacaccttcctcgcgtactccgagtcgttcagcgccagcagcagcgcgtacctcctcccccctacgccgccgctcgccgccgccgccgccaccgtcatcgcgaggagatcgagtgcgtttgcgccggcgaggtagcaggactaagctgtgtgtagtacgttgccggcggcgagctctagctagctgtagtgtgaaattgccggcgagaatgcatggtgtataaggagctcggcggcgacgcgtcgcggtcgggtgtgtggaacacgtgatggggttgccgcgcattattaaactccgccgaaatggggatccatccgtgttacactgttctgcagcatgcgcgtgataaagttttagttagcagaacaagcgtgtatatatagacgcgtgcatgtatgtgtggaattaactgtggattcggcttatataatttgttattcgttgttgagctggctggcatttcgattgaactgggtcttagttttttttatttatgttgttttctttacggatgactggacatgttataggcaattgctaatgctgatggattgaatattgtaacactaattgtttgtataagaaagtcttttttttccgagaaattgtagtaataataatccataagctcatataggctgaaagaatacaacgttagggttcaaagtctagcacacctgaaggcttaaattgaattgagatttcaagctttgtaaacataggttgacgagaatagcaggagtcagtgattattatatacacagtatatgaagagtacgtacgtcttgggagaggtgtccatatataggatagaaggcaacatgataatgacatatatgtgaataacaatttttgaggagatcatgtgaaatatgagataatacggttgtaggtgttgcacggatgttaaatatgaaaaagaagacacatactcttagtttttgagatatatgatttatatagcttttaaaatgatcttaccctttttcatagcttttggaatatacatactgatctttgctagaaaataagttcatgagttgaaaataatgcatccttagtgtttaatttaagtcagacacacccagaggcttaagttgaattgagatttgaagttttgtagtgagtggtttttcttgaaataggttgatgagaacaacaggagtcgagtaattactatactatggtacatggttaatttaaagtgataggaggttaagggactattatagatctatatgcatacagtacagtgtatgaagaggtccggcatgggatatgcccactggatggaaggcaatatgataatgacatatatatgcagatgataatttaaggagatcaggtgaaatatgagatggatgtacggttgtagttgttgcacgaatgttaaatatgaaaaagaagtcatactcttagtctttggagagatgtgagttatagcttttaaaacgaacttggaatagacgtactgatcttcgctagaaaataagaacatatataagctgaaaaaaacattcttattttgtgttatttctcatgagttcccaattcccgcgcgcgcacgcttttcaaactgctaaacggtacgttaatgtttacgtaggaaagttgctttaaaaaaatcatattaatctatttttaaaatttttatagctaatacataattaatcatacgttaatttatcgctccgttttgtgtgcggagaggagggattaccacaacccagttggtggtgtctttacacataggttggtgataatatcatgagtcaaataaatgatgattagatgtctagtcacatgttttatgccataagaggttaaggaactgctccatccgtccaaaaaaaaagccaacctagaaagggatgtgacccctactagtataacgaatctggataaaaggctgtccagattcattatactaggaggtgttatgttttgaatagcacgctcagtacattaagaggattggtatcggaggtaaatataggacggaatacaacatgataatgacatactccctccgtccaaaaaaaaccaacctagtactggatgtgatatatgttagtactacgaatctagacatatctctgtccagattcattatactagaatatgtcacatccagttctagattcgtttttttcagaactgagagagtatgcgaatgacaattgagactaccaggtgaaatatggtatagatgtacgaatgtagctgttgcacgaatgttaaattactagttgctccgtttcatattataagactttctagcattgcccgcattcatatagatgttaatgaatctagacatatatatgaatctagacacatatatatgtctagattcattaacacctatataaatgtgggcaatattagaaagttttataatataaaacggaggaagtacatagttttgacggctgcattatatgtttactatatatatatgcttggtagaggggctataattttataatgaaaaagcaatgttgtgcccagatcaaaagtaactaaagaagatacatttagaaaaaaaaacacaaaggtaaacacgtttgctttgcttgcttgccttcttatttaatcattgtggctcgattaggaccttgctgagatccataacagtggtgtgtaacagtctacctgttgatggacgtgtccatgcattatcgggtctcaatcgcctgctgaatcacatgacattgtctgaataataaacaattaaacaaataatgagataatcagtaactaatttgaacatagacaatgtcgatcttttcgtttttttttcttttgaaacaacccgtataaaatagtgagatgtttttattgataaagcaataataaaatataagtctatagtcctataagtgtaaaactatagtcaggagaaaagaaaatacaactatgccacgtgtctacatttgattctaatgatagaaacataacatgtattctaaacaacgcctccaagaaaaaaaaaaagacgctaagagggtcgtcgtcgcctgttctatagagccagattagatatgctggagttaattttgagcacgagataaacgggtgccacgtttctctacctaaccggaattaacaatacggttttaccatttggaccgagcctttttttagtactccctccatcccaaaaaaagtcaaattctagagatgaatctagacacatatgtgtacacactggtggagaaaccctttgtagtcccggtttgtaacccctttagtcctggtttccaaaccgggagtaccaatccgggactaaagataggatctttagtcccgggtgaaataaccgggactaaagatcgatctttagtcccggttggtgttaccaaccggaactaaagatcgagctgaccttttttttttgcatggccctgttgctgcatatataaaccatgcatatatatgcatatatatatatatatatgaccaaaatatatttacattatagaaaatgtgtacacatgcatatagaaacatatgtagtcatgtattaattacaatccattatatgtcctagctagctacgatttcgacgtagtagtagtactcgctgctagctcagaagctaaggatcggtgaattgtgtttccgtcgtagtagaattcacccttgggatcaaggatttcttcgttgatgaatcccatgagttggtcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctgcaaggcagtggcaatactcacacacgtaatagccgcacaagttagttccctgcttttgctttgcgcactacaaataaatgacaaacaacgagagatataattaatatacacttgtatgtatttgaatcggagaaatataaatgtagagcatgtgtactcacaggaaatttgaatttccgcctaagtctttctctccatttgccgcggatcaaatgacggaaccgataccaagccctacatggagtttaaagctatgattcgtagtagcaattaacataacaagattttcttaattaatagaggaacttatgacggtacctgtctataagttcgaaaaccttatcaaacgtagactcttttttatccattgagtcatatacgttgacggtgcaggccgacaggtcgaagagtaaaagcacccagtggaatctgcaatgtgcgtgggatgcattacatatgaaacactaagcaagttcgtacgggaatgaaatttggtatgtagaaagacagtaaaattaaactaactctgtgttgtacggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaatgataaaagggagtatattattttctatagtctacttatatacaaggacctaattaattaaaggagacgtatagtaagaaatctaactgaacgatatacttacaaaatccagcaactcataatagagacgtcgagggcgtccagctggtatagttcgtagattcccttgaaattgatccaaagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtatcaataataaattgttctatcgtcatttctttaccggtcaccaacggctctatctcctggtttggttgctctccaagctgagggactggtttggactttctagaagatgctttcttcagcgttcgctcatagtccgatagcttgatggcctccttgacagatgcagacatacccctgaagaagttcctaacactggggtctataggaatcttcttttctggacttcgaggcttgaattgtctcttgacttctgatgcaacgtaagtgtcaagctcctcttgcgtgcaatcgtacgccgggtccttgttcttggcggcgtcaactttcgccttcttcgttgcccttgtgtgggcaggcggtggagctggggggcccttgactttgaaggtgctggaagaggagcttgcggaggagtaggtgtaggagcccgaggaggagtcggtgcaggatcctgaggaggagtcggtgctggagcctgaggtggagatggtgctggcggagcatgaggaggagacggtgcaggatcctgaggaggagatggcggagccggaggatatggtacacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttatgagagattatttattagtaatcaacatatataagcagcaactagcggaatggctaaatctaaaatatataaactacgagtttacctttattgataagttcttgtaaggaatatgcagctcacatggtgtccgctgagtgatgtcatcaacaggacaggtcgattcgtcctgtgtttgcatggcgtccatgctctgtgatcctacttgccccgttgaggcgcagctgctacagtttcctgacgggctcaccattgcaggaggaatggtcggctggggatcatgggaccgatgtgcggccatgcgttcatcaaccttccttgccacctcctcttgcatgctgagttcgtagctcaatacccggaactctagatctgcaatcttcgcctcggtatctctcttactcctcatccgactcctgtacgtgtggatgtcctccttgaaaccaatcttccaaggaatcacccatttccctcgtgttcgtcctggatgctctggagtctacagggcgagtgtcagctcgtccctatctctgtccggtcagaacgtgccctgagatgaggcttccactgcatctgttagtcgtcgcgcagcctctcgtatctgatcgccgaagaccagtgagccatcagctgggttgagcgttccaccgtgagcataataccagaacttcgatcgttccgaccaattggcggttgccggttcgaaacccctctcaatcaagctagcctccatctcctcccacttcggcttcgcgacgctatagcctcctgaccccaagtggtgatggtacttcttcttggcggcattttctttgtttctttccatcatcgcctgcccttgttcacctgtcttatatgcaatgaactcgtcccagtgatcccttagctttgggaatgtgtcgaagttcggtgtctgccccttcaggatatatttcttgtacaactctcccttgaagctctgaaactgttctgccattttcttcagagtccaccttttcactttgtcctctgtacctgcgggaagggtgaatgtctcgagcattgtggtccacagcatctctttctccgaatctgggacagagctctcatgatctccgcgtgcccttgttcttcgccagtacaccgtactaacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgtgtgccctcttctgtccaacggagggttgactaccactagcctcctcctcctggttcccctccacatcactttccacgtgcccctgctggttcccctccgcatccctctccacgttcccttcctcgttcaagtactggtttggatccccattcccctcttctttattccagtactggctgcttccctccgcgattgtatcatacaatatctgttcctcatcgtggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcatgacataagctaagtctaggtgacgtatattatacaaccctagctagtaaataattatatactaagtctaattacaaataaaataatcttatattaaagctcaaataatattacatgctaagactaaaatagtcatgtatatgctaagtgtttcgtgcgtatatgctaagtctaattaagactacaatagtcaattgctaggagtcgcaccaattccgtagtcaataattgcatactaattctaattacaaataaagtaatcttatattaaaactcaaataatattacatgctaagactgaaagagtcatgtatgctaagtgtaactgtcgtatatgctaagtctaattaagactaaaattgtcaattgctaggagtcgcaccaattccgtagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctaggagttgcaccaattccgtagtcaataattacatactaattctaattacaaataaagtaatcttatattaaaactcaaataatattacatgctaagactaaaatagtcatgtatgctaagtgtttcgtgcatatatgctaagtctaattaagactataatagtcaattgctaggagtcgcaccaattccgtagtcaataattacatactaagtctaatttgcaataaaataatcttatattaaaactcaaataatattagaacactacacattcttatatgctaagtctaattacaagtctaatattcttaattgcattacaaatataacaatcatttatattattacgtcatttgcctgcacgaattccttctagggctagctcttccactccggcttgaggaacgactccgacaacacgtcttttctgcaagatacaaaaaaatatgtattaggataaatgcgaagtaacatatatatatattgcatttcacgttcacgttcgttcgctcgttctcattcacattcgttctcgttcacgttcgttgtcgttctcgttcacgttaattcgttcgatcgttctcgttctcgctctcgttcgttcgatcgttctcgttctcgttcacgttctcgcgccaacgtacgttgacgtgttcgttcttgttcacgtgttcgttaacggcggtgtggcggcatcgggccgacgcttggcacagcggcgtggcggtgacgtcgttgcgcggcggcgaaggcggcggcgtggcgtgccggcggcggcgtggcgcggcgtcgtcgtggcgcggcgtcgtcgtggcgcggcgtctcgtggcgagcggcgtgacggagagagagatcgagatcggagatcgatgaaggagaggcggcagcggctctcaccccagagatgcggcggcggcggaggaggcggaggcggcggcgaggacgacgagctcgagacgacggcgagatacgtcggcgtcggcgcggggatttaccctaggcagtggcggcgaaggagagagtccgagagagatcgatcggccaaaaacattaagtgttggtggagaaaacgagggcgcgcatcggggaacaaccgggactaaagaaaagatctttactcccggttgttctcaacaaccgggactaaagatatctttagtcctggttgttctcatcaaccgggagtaaagatcttttcccgctatttccaaattctttttaaacccggttagggttaagaaccgggactaaagattatagcactgcatattattttcgcttacatatgtgtttctaaaatagaagttaatgcattaacattatttaaagtacaaagattaatgacaattacttcgaaaaattatttttgtctgtaataaattaagtggataaatcttaataagaaaatatatggcttaaaattaataaaaattccaataatcatatatacttagcatctgaatgatattattaaattggtaaaaactctaattaagatatgtatgtacatactgcatgatttaaaatgaataaaaattgtaatcatcatatatacttagtgtaggaattatattaaattaaatgttaaaaactctaattaacatatgtaaatgccacatgcatgatttaaaccttttaaaaattcgaatagtcatatataagtagcatatgaaagatagtaaattaaattgtgaaaaactctaattaacatctgtaaatgccacatgaatgatttaatacttttaaaaattctctagtcaattataattagcatatgaatgatagtcaattaaatgtagcatatgaatgatagtaaattttgccatacatcaattgatttatatggataatcaatacatccaaaatagtttacatcgtgtacacaataattacggcattacatcgccggtgacggttgaccgcacgtactttctcctcactattgttccctccttgtgatcgctgcgtgagtaaggtgtgtcttcatttgataggaggatgctagggtcaatcgtcaccgtgaaaaggggttgcccatccaactgatcataatcctcgtcagtcttgtcctcaactccgacgatttttcttttgcctgggagaaccacttgacgcttaggctcgtcaggccctctgcccttctttcctttgctagacatgtccttcacgaaaaggacttgcgttacatcattggcaaggacaaaaggttcgtccgagtatccaaccttgttaaggtcaacaattgtcataccactgtcatcaatcattacgcctccaccagtcaacctaacccattggcaccggaacagaggaaccttgagaggaccatagtcaagttcccatatatcctcgatggcaccgtaatacgtggcagttgttccatcgtgtcccatggcatcgacacgaacaacgctgttttggttcgtgctcttcatgtcttgggctctcgtgtagaatgtgtacccattgatctcatatccctggaatgtcgcgatcgacccagacggtcccctcgccaggaagacaagttgttggttgatcgactcgttacccatgagatgttgtcgtagccacgtggggaaagtatcaatgtgatgctgtgtaatccatgcatcggacttaccgatgttcctggcgcgaactagagccaagtgctcctcgatgtaaggagctaccaatgaagagtgttgcagaacaatgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgaccttctctgttccataacccttggcgatgcttgcctctggacgagcacggttacgaacatacttcttcagaacgcccatgtacctctcgaaaggaaacatgttgtgtaggtacacaggcctgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcg

SEQ ID NO: 5643 - DNA, 590 bp, Oryza sativa
  unsure (1)..(590): unsure at all n locations
cattcttttaaatatgaatattgttcgaatcatcaaaacgcaatgagcaaaacgcctaggagaggagagtcgcctactttgttgcgctgcacgcggcggccaccgtcttgcgccagttgagcagcacgtcgacggcgacgtaatgcgtgacggtcccgacaagcacgagcacgtggaagatctggtggctgtggccgacgacttttgagacacccggtcgccacttatacggcacgcgggtgacgtagaaccaagcgactgcggggtaagcgaggcccatggtcacctcaagctatagcgccaggtaagaggcggtgtggacccagatgagccacagagcgtgcagcgcccgtacgtacccgtggagacccatggggaggaacagcgcggtgcggagactccggaaccgttgacactagcagggtggagagagcatctcgccttctacgagcgcgctcagcgcctagatggcggagaggtatgccacgcgcgccggtcggtgtgacatgaaggcgtagtacaccggcgggactaacgaggcgacgatcatggcagagatgacacngtagtcgagctgtcagacaccacgc

SEQ ID NO: 5644 - DNA, 707 bp, Oryza sativa
  unsure (1)..(707): unsure at all n locations
gagaaggaaatatctatagtatatctggtactgcatccatttcatattatagggccggttcactatgatgccattttcatctcttaccaaacctggtaaagatacaaaaaaaagtggcttcatttagtttgctaccaaattttgctaattacataagacatcctggccaaaatttgggcagctaccattctggctatgccaaaatttggtaaggatgtttttcggcatcaaagcgaacagtccctataagtcgtgtaacatgctcctttatcaagcatctgtaagtttatttttggtgaaacacaatacaacacatacgctgaccgcttctataaacatacacactgtgcctatgagcactctattaagtttgatcgagtntatagctaaatataataatgtttttttcattacaaaacaacacattatatgagaatatactcaacgttaaatttaattaaactagtctggtgtcgtggacattactatcttttgtataaagctggtcaaacttaaagaactttgattaagaaaaaaattgaatgacttataatatacaaagagagggagttcaatgccgtgtccagtgagattctatatatatccctatagggatttggtacatgagttggacgtgtcagtcaaaactatatgctcgttaggcgtaacgatgtgtcttatatgttgacaccagtgctctataaaga

SEQ ID NO: 5645 - DNA, 638 bp, Oryza sativa
gcccggaaatgcaatggatctggttgagccaactctaagtttgttggggggtttttagtaagaacatgggatgctcatttgttctttatgtaaataaatccttttcttcgggatgagctcttcagaaaatgaggcggctcttcttttctgcttacgcaaagggcctttaattctgtgtcatacctatatttaatttgcaggtatgcggtacgatcaaccaatgcttcttggcggactaacgatcatttgggtagaaacgaatcgcagaatatatgaatacatcctgttctcagattactttgggcgatactagttattttcatgactcatcatatcactttctggagatgctgaaacaaacatccactgtctagcagaaagatcaatcattcattatttcacagcttactcctcagcagattatatcccttgtcacagcttgcaatctttgctactctgcacatatatgaagaaaactgcagctatttacgcaccatgattggtggaactttactgcatagaatttggtgtgacactaggtaacgaacgacatagcttggcaatatgggacgggtatcatttgctcattcagataggggcactacgccctaccgacattagtgaagcttgatttagct

SEQ ID NO: 5646 - DNA, 268 bp, Oryza sativa
gcgtgctaagcaagttgctatgaaggtcatttggggagattgggacgaggcgtatgttcgcttgcctacactgatgcgtgccatcaaagcaaagaaccctaccatgcatttccgtgttgaggctcatcccgagaagtccaggatggtggatggagtacagaggcgagtatttggacgtgcatattggatatttggccagtccatagaagcattcaagcacttgaggccggtgcacatattatgtttgtctattgatgcagcgcttgaa

SEQ ID NO: 5647 - DNA, 5773 bp, Oryza sativa
aacaacagaatatctacacacagattgcagatcttccctcctcaatagttcttccacaaaaaacttttaagtcaacaaaattcagaacacattcgattgttctgaaattttagcatcctaaaattatttaactaattacgtttttgacattatcatggaattgccttttacttttagaacaatattattaagtctagtaagccatgaagaactccatgatttttcaaatccatttcttttatcctgcacccacaatatcattgagctgcactgtatagctaatgcaaagtctgattcaaacaacttttagctaaaattttcctcggtcccaatagctccagtagataaaataattgtgtaagccaaagagagcaatgcacaatatatcagtaaggcgcattgctctttgtgtgagggggcagaatatctatccatatcaaacctaactcctccatatatacaaaagaatcaggcattgtctttgataaaagaggcagatcagatttcacttgtacacttttggaagcctataaatagcaagccagaaggatcatagagtattgcagaacacagaaggcaaagtcatatggatgactgaaatcctacatagaagcggcagtcgatggcatgcatcatctagtggtgcatatcctagagaagttccgagagaagtatagagagactatttggtgcttgttatcacccaatgctaggtatgagttatggctatcagtggccactcgtgaaatgagatagagaacggaatgcagccaaggatgacttgccggtacgtgtatgcatgtttcaaggtactatatgtgcccccaactgttttagatccatgctgacattttccggcaagttgtccttggctacgtcttgttctttttctctcacgtgaggccattgcatggtttgcatttagcttccaggtcatgcatgtacagtgatgtatatcaatgtaaaccagaaatatattgatgggattaaggattagtttagttgtgaaggtgatgcacttctgattgctcacatatagatatccaggcaacatctgattcaacctgattgatctttccggtatgatgacggcttgttcagagttggatatgccattgatgtaaggtgttgcacctcatgttcagttatgttacctcattcaaacacacatgccgctggatagatgtttggacactttctttttattttgtaatttaagcaaacatgttgattataggtgtagtggcccatgctcaacaacattggcaatccaaggataaaataacttgcagaggctataccttgtcataactaactagctagcattatattcaaagttttccccttttaactaaaacccaccgcttcaaatgtttcaaatgatctgttaaaagaagcatagacagtcaagtttcttgattactcaaattttgaagtgatgcatgcccaagatatagcgacagctgataagatgggaatatatgttttgttgtttgaggttaatggaagttggtaatagccgataagatgcaggatcctatgtttggggtctgagtttaatggaaattggtagtaccatgatgcgttgtgaggtggagtgacagcagtaatcagcaagtctttcttcattggtggagtgacagcaggaagatggtgcctagagctaagggacgtggttatgacacaatcatcattctcgcagcttggccgatttggaaagaacggaataaccacatcttcaacaatcaacaagaacatggatggaggtggctgctgcagctgcagaggaagctgcactctggcattcaaccggggtgccaatctggctctcgctggcacggaaactgtggtcacaaaatagatgccgtgagaattagacctttaaccgcataatcagtttttttttcttttgtttctcattttagggatttgtaacttgagctgctgtacaaacactccatcttaatacaaaaatacgcagttcttatgcgtattcccagggaaaaatgatgtgttgtgagggttgtccaaactcagttaactcctgttgatgagaagttagctggacaatcatcagtagctaagagggaaaaaaaaagcactggttctattggtcgacactagattcaatgctactatccaataccaaagtcaggacatatatggtctagtagcaatatcaaagtcaggatatatatggtctactttttttaggggatatatggtctagtatttgatatagagggaaaaaattttccattaaaaatctacatgaaatgaaagaagcagtgatgattgaaatcccccatttggccactagccccaggaaacccaatcagtcaatctaagtgtcactactactagtagtactaattagacctgccctagcaatagagcaactacgacgagctcccaccgtagtcagattcgcaggcactagggtgtatcaatatcaatcaaatcgaaggatcccacggtttcatcggcgatacaatttcgcagcggagcttcaatgcttcatcaagatgtacactacaagttggttacctctcgagcgcccgtggtcgcgtcgcgtcttcgcgcgtggccccgtacgtcgtacgcggcggcggagcgcgccgcccacgacgaccagcgcccgccatctggcctggggttgcctcggatacgacgccgcggcggcgcggctcgtcggagaaggggaagaaggcgacgccgcccgcttgcctcttcgtgggcttcgagactagtatttgctttggattctcagtcactcactaggcctggttgagagatgggctggtcgagctagtgggctggcatgtgaggataggttggttgggtagactattccatcttttaattcttagggtaattttcgcaaaactataggtgttttaatcaagttattacaaaactatgaaactaccgatttaacactaggtttatcatagagctataaaatatcgcaaaagtacatatttagtaacaaagttatcacaaaactacaggttttatatcaatttaatcataaattttggacatttataactcaaacataatattagagctaggaattaaaacgtaaaaatatgtactttttgattattttattattaaatttgtagttttatgatacttagccttaaacgtatagttttaagaaaaaattattgttaaatatgtagttttatggtacatcaactttttgcaataatttagcttaagtatctattgttctgtgaaatttactataattcttataaacaaaagattccttcgtttcttaaaacaagaaaaggataaaatattccaggaaaaacttggagtggaacttcgtacgaatttggaacaaattaacaataaataaggtaataaaataactaaaatattgttcaacaagaagaaatcgtccataaattcaggactttttatagattccaaaattgagaattcccattaagttgcttgaataatttgttcttcttcttcacctgtacaaaagcacaaattttactgtttaaaattatccaaggcttttatggggcgggctttctttggtcaatggtcactaatcaataaaatgttatttggtttacaatagaaatttgatctttaacaaatgaaatactttaatcaataaaaagtgtttactagtgtcactataataccatttattgtatagattaatttaatcattttgatgttaccatgtcccaaccaattggttgacagcatcatcaccaccaccactcatgacatgccacaatgaaaaaaccaacagctaaagcaacacaaaatcaaaccccaatcagctgcaaaacagaaagacaaaacaagaaaaacccatagattcaaatttaaaattcgctggaggaaaaaaaaacaaaaaaaacaaatcggaaaacaaaatccgcttatgcagtcgtggcccccttccccatcgcgtcttccattccagcccagatcgagcgagagagccgtctccctcttcgcttctcctctcccccccgtgatctgaccgccggggacgaccccctcccaccacccgccgccgccgccgcgcccccgcccccgccggcgacgaccaccatgtcgtacgatcgcgtcacgaccttcgaggactcggagaaggagagcgagtacggctacgtccgcaaggttccctcacccctcatcgtcttccttcctcttccccatgttggattggatcggtcactctcgtgcgtagatgcggcggctctgcttcggattcggcttgttccggatcggtggagttttagctgtgagtctctgtggattttagtgctggtctcgaatccccgatcgcgagagtgtgggtggcactgctgctgactggggaatcgtcaggcgatgcgactgtgccgagagcctcggactcgggtggtgtttggatcgagttgaattgatgcgagattaggttgataggacggttgaatttaggtttctactggtgttcggatcacgctggctagactgcgtggatcgacgtttgatgcgttaacttccaaactcatatgcgggacactattgtgatggggttggttagtgaaccatccccgatgtggagatgcgctattatccttgggagtttagcccgtttggataatatgttgattgtctactattggcacatgatccatcatttcatccctcttttttttttttgtattgaacgaattgtttcgccttcatattgcattcttctaggtttctggacctgtggtcgtggctgatggaatgggtggtgctgccatgtatgaacttgtccgagttggtaatgataacctcattggggaaattattcgtcttgagggtgattcagccaccattcaaggtataggacggtgaaattctacctcacatatttgtggtgccttttccccacatgacatgtacaatataaatttcaccaattttttcttgtgattaccgtttgcagtttatgaggaaacagctgggttgatggtcaatgatccagtgttgagaacaagaaaggtgtgatgcattgttaaattctatgtgcatttcacatatggttttcttacccttttcatttcttttataacacattgttgctattttcatcagcctctttcagttgaattgggacctggtatccttggaaatatctttgatggaatccaggtgagacaaatgtaataatcggacatttattaggctgatatgaggactttatgctgactacatgaccttttttcctttctacactttgcagcgccctctaaaaactattgctataaagtctggagatgtgtacataccacgtggtgtttcagtccctgctcttgacaaagatcagttgtgggattttgagccaaagaagctaggtattgtgcctgctaacctgttataaaatctgagcatgtctcttttcaagttttatcctgtacatagataaattacattggtcatttgaataggtgttggagatgccatcactggtggagatctatatgctgtaagttaacaagacagttcccttttttacaagttattatcttgtgttattgctagcgatcttctgcaatctgcagatccctgatgatgttaatctttttatgtgtctttgtgttgcctaactgcctcacagactgtgtttgagaatacgctgatgaaacatcatgttgcccttcctcctggttctatggggaaaattagttacattgcaccagctggccagtatagcttgcaggttagtatgtgttacttaaagctgcttcttctgtgc

SEQ ID NO: 5648 - DNA, 1260 bp, Oryza sativa
gtcattagtcaggcactttccaaggtattttctctattcctctctatttgataactgctagcattgcccatgggcattagccttttagaatgactgaattctgtgcctttcctgactgaaaatatcttatgcagtactccaattctgaagctgtggtttatgtgggctgcggggaaagaggaaacgagatggctgaggtccttatggacttcccacaattgacaatgacattgcctgatggacgtgaagagtctgtcatgaaaagaactacacttgttgctaacacatccaacatgcctgttgctgctcgtgaagcctccatttatacaggtaatacatatatactgattactgatgtttttaatttcgcattccactagtatagtactacatgaatgtgtttcgatcttctgaagttcattttctctagaagaaagtgttgctttgttggagactatagctatctcaatacatcagaccatggatttctgcaggcttgtccttagccatttgtgatctatgagctaattttggaataactaaggttgcattgacaaatacatctatgcatgttccataattgttcagtagaacattgaggatcacatctttatgttatccatggcctttattatttattgaggatatacacatattcctgttagccatgacctgtattacttactaactgttctgttgcagttcagtttatgagttatgacggatggtaactaacttgctagcactagatcttttagtgaatgaacatcatcaaagtggtacaatatgtgtagtttcttgtagaacactaaaaggagtccttgcttagttatgctttatgcctgatgttttctttatcaacaaaacaatcatatttttttctgcccaccaggaattacaattgctgaatacttccgtgacatgggctataatgtcagtatgatggctgattctacttctcggtgggctgaagctttgcgtgagatttcaggacgtctggtatgatgcttcctttcgagttgctattttacctttttggcctgtatttttgtaacttatattgacttctcaatgctgtgctgtgacatgaatgagaattctttctaatgtatcattatccactatttgtatttggggtttaattttttcaggattattgtttattttctttccgttcagtagcttattttattactaatttcattaatagctgactgtaccctccaacatcaagaatactagtgcaatggggatatatta

SEQ ID NO: 5649 - DNA, 9938 bp, Oryza sativa
taagggatgcaaaaacattgtgggagaagctagagatggaactggcgggtaccaaccaggaagttatggctgcggtcgactccctccgtcgaaaaggaaagcgaatcatgcggctcgcatcgtgccggcattcctcggacgtctataatccggcaacatcaacaaggacgttcgagccaatgccggagtgtccctctacctcttcccggccgtccacctcagtccgcccttcagcatccgcgcgacgatccagtgatggtcgtgcaggagtaaggtcaacttcgtttcgtgatccacccactattccgactatcccagaaatcactgaaatttcggaacgcctaggaggctttggttcaactcaaggtaaaatacgttattgcagaatgctaaaataaatgccatttgtattaaagactaatttatacgttcgcagcacaactggaacgggtacccccacatagctctacgcccatcacctctcaatggcagggtgggtttgcgttgtttgctggtacgggatagctcatcaatatgctattttttcccaattgtttatgtgaactgaataaatgatgttttccaattgatgacagagggaacgcgaatggtccgtcccgtgcctcatatgcctcctgctaggccacaaatgattcctcaaatggctctcgatgtgccaacctcacactggcaaggaggatttgcaccatttgcaggtccgtgtacattcagtaccatattggcatgcatatgtccactcgtaattttactttttgctaattaattgcacatacagggactagccaaggtatccctaccataccccaaatgtctgcagattttatcggtcaaggagggtttacgtcgttaggcggtcaatctccccttacatctaatttcatatttttattatttcaatttattaatttttcatgtatatgaatcttattgactatttacttcctgatattaacagggcctactcagtcggttccactgcatgcacctacatatggcaccaacccatggcaaggacaatccatagattacggtggtacgcacagccatcattctccatacacatatatcaatggcactttcatgccatacatgattcccacttcaacttaagacaataactccgtgacattttatatggatgcaaggcacgtcatttggtggtagagtacagggttatatggacttgttgtaacaaggtgattggctatttggtcaatattcctcgcatcctaatgaaattccatatatgcaagcaccgtcaacaggtttggattttttttgtgttattgttgtttgctccagctttgataatttcattgatatctacattgcttctgtagggtcatttcgccctgaaataatgtcagggtttagtccttacactacatcgtacgacgacatgtctagcttcggtggagggtcgtcatcggtacccaacgagcttcggacttcacaaactaatgatgcgcctcatgtgacacagcccacataaccagaggttggcgaaggaaacgacaatgacccgcatagatctaaccgtgagctccatgagccaaaccgtctgtcactctcaggcccgcgacatgccgcaggacaaaggaaaaaaaactacaaaaaagcgaggtggcacatctaggactacgactgaccatgacgatgatgacgagtagaagtgaacattatgtttttcagttcactgccaaccctatctgaaccttgctgtgattttggcttattcttcatgttatttgtactgcaatgaacattatttatttgtactgcttattcttcatgttttgtacgatgtttcgtagttcataaatatctcatatttttatgccctattttgtagccagttaacacatatgatttttggttaactattaatttttcgtacgagagctaacaaaaataatagtctcacaaactaaattaatagtgcagtttctatgttactcgtgcggttaaaattacatattacttttactttttactactatgacttaaattgcccactaatttcttttcacagagatgcaatgatacgcacctaaaatggcatcctctctttccaatcacgggacatgcgccaaagcatcaaatcattcacaattaaactttcaagatttcgctgcgctgcgccgaaagtgacttcgtcgctttgtgattaataaagcaaacagttatgcagcatgtgccgccgaaagtgacggtgtcgctttgcaattattgtcatcacgagtgaaacagtctgacgctattgaattgattagtgaaacagtccgatgcaccgtcgtctctttccaataattgaaactgcgtagcttcttgccatcccctataaataacaaccaaacctagcacacaactacatctcttcttcataaacgttctgctggttccaactttgtgttgcatattcttaggcccggtcttgaggcaggaactgagtagttggtgaactcgctctatgttgttcgttcactcgcgacacggttcctgtcccaagactgagtctgtgaatatacaaatgtgatttttttaatacattctaacacccactctttttttcaagttccagcatccgtttgtaaatatgacctactcctacaaattcataaactcggtgttgcatattcttaggcctgatcttgtggcaagaactgagtagttcgttaactcgctacgcggttcttgtcacaagaccgagcccgtgaatatgcaaaggtggttttctctgtgaatataacatattctaaattcctattctttgtcaactttgtaaaaattgctcccgaatgatctctctactcctttatatatttttaataaatatatattcaatttctgtttttctataggtaatatatgttttctttctctgatatcattattttgcaaattccaagatatttatttttcttctcgtagccgcgtacacaatctttgcctattttcaatataaacatgtttctcatgttcatttatgtatatatatgttgcacacataataaaaaaatatgaaaaaaaaatcctttctactccctccgtcttgaaaaaacgaatatagtactaagttggtattttttgggacggatggaaaaaaattatactttttactctctcagtcccgaaaaaaacaaatctagtactactttggttttttatgggacggaggaagtacgtaccaacggtgacatgaaatattagcaatttgcaaagcgtaattagctaatcgctctcgcgcacggggagagcgataccgctcacggtctcgctctttcaaagagcgagaccgaagccgtcgctgtcgcactgccgcctcccaggattagcagatggattaggggcgtggaccacgcggcaacggtatcgcggtttcaaagggcgataccgccggcgctctcgcgcgcgcgtaccgcgagaccgacacgctctcgctgagcgttagcgcgagaccgctccggtcattcctcggaccccacaggcgtcagtcggcccacgctgctacgctctcgcgtatcccggccgtgataccgcacgcgctatcgcgctttcaaagtgcgagaccgcttcgtttcccgcgtgcgtcaggcggcatcatacggaccgcgctatcgctttacaaaagcgcgacaccgcctcgctctcacgctttacgaccgcgagaccgatgcattagctctccctcactcccaattagcgatagcgccgccgctttcgcgcacgcatagcgcgatatcgcgctatcgctgtttcaaaccgcgacaccagtatatttccgcaaatccgcccctaatcagcttaatcttgcaattccggtcaagaacacgattaatttcaaatttttttccatactactcaaataatctcgacgcaaatcaccagcaaccacaaaaccaaaacaacatgaacacacacatgtggtaataataccaatacaccatcgaatggttccatggcacaacacatcttaatacaatcaaccccaaacaatgcttttctaccaaacaaggagagccacagaaaccggcctaaacaattctcatcaattctagagattattgcaaagataaattaaaaaaaacaaggggaaaatcaatcgaagggtccatatatcatgtatcgatcggtcccatgcctaagcatccatccaacatcattaaaacggaagatactatatgcaacaagctgtggccaaccacatggcatgatcggatcaactgttcttctagatctaaaaccgacgtcacaacaattctcttcacagactcgtgtgatcaccatgcatttggcgatttttttttgtggccggagagaggagggcttgtcactgtcctgaagcagtttgcagctagctctcgtggttgtgaagttacagggtggttcagttttcaggttgagcatgtcagtctcgcacgaaattggagtagttccaagagagtttttcatagaaaataatttactgcctttcaaattttgcatcatttaagttttggattgttgtatggactgccttaggtattgcttgaggttcaagaggaaacgatttgaagctctaaacacaggtctgtagccaagactgaacacatttaaaacaatttcaaccagccgaattcatatctgagtacaagagaaacgtatatcgcgtctgtgtaaagtactgaagtgtggtgcctgcacattgtggtgcatgtgcatctttcatgtaatctgaaaagaaaaggtatagtggaagtccaaaataataatttaaaaaagaaaaggaatgcaaaattaacctaacaagaaagggtgcatcttgacaagcacgttccgaaatatttgtacaccaactaatgacatttagatcgaatctaacaaaaataagttataaaattgtatgatagccataaacatcacaattaacaaccagggtatggtgtgggggaaggacacgggtagaggattgttggccatgcttctgccccacgatccaaggtagtagtacaaaccttcatagttagacattatttggaacacatgaatctcgggggagaaaacattatgacgagttcagttcctgtaggagcagatcaagttcgtttaaacatactaaacatgccgacatctgtattaggccttaggaatacaaaccctatccccgcaaaacaatataagataaaccctattaatagaaaagaatacgcaaggtgagcatagctcaactggttaagttccttatgatggaaccaactcacctaagttcatatctagatttgacgcaggtattcatatttatagctatatgtgccggcccattcctttggagatgcacattaggggtagagcgtgcgtgcgttattcgttaatctcgagatatatgccagcccagttctttagagatgcacattaaggatagagtgtgcgttaataagggtgagtgtgcatgtgtttatagagagaaaaataccttgaggagaaatagaagaattggctggcacttatttttcaaaatacaattatgcaaatggcctggcctgaacctaaggaaaaaaaattgaaaatataccgtttaatttttttctctcaaaaatattcgggttataattttatttgcataaatataccgttgatattacgatctcgcacaataaaaacgcgagaccactcggtgtcgtgcagcaagttcgcgagagtgagcggtctcgcaaactcaaccagcgagagcgagctgtctcgcagactcaagtagcgataccgatccttgccgctattaattagtgattaattaattattaattaatttctaattaggataattaagcactaattattattaattaatcattctcgcacctctgccgcgtgacaccgcgcggtctcgcatcctcttcgtgcgagaccgcctgtatcgtcagcccacgtcagtttcacgcagcggtttagcgataccggtggtatatttgtgccaaaaagtttatatcaagactatttttgagaaaaaaaatatgaacggtatattttcaaatttaagtctgaacctaagcggctaagcccaatccaggccaagtggccaacccagtaatacctttgcggaataagttcactttgactcccttaaaagtgactcgaatctaatccatgaccctaaaccgcaaaaccggatatttcgaccccgaactattgaaaccggtgcaatttgactctctatgtggttttggagggcggtttcactgacatggtggtgttgacctagtctgtagggttgacgtggcgcttaggtggcatttgaattaaaaagtatccgtgggacctgtttgtcattcacacactaaaaaattgtggagcccactgacatgtgggccccacatgtcatcctctctctttcttcttcctcccctcttcctcccttctctctttccttctctctccccttccgccggccgcggggagcacgggctggagcggcggcaggagctgagctcgccaccgccacggaggtcggcgccagcaccgctggaggcgagatcgaccggacatgcaagtgcgtgagccctgggcctgggagcccgacgggattggaccgccacggagctccgctttggctgcggcccgggcgccctagccgaatgcttcatgccgcagctcgtcagtgtcatgcgtgcagccgccgagagggtcagcgtcatgactcgtgacccaccaataaaatcaaaaaaaaaagaaaatcagccatccagtgcaaattcaccacaaaagcacggtgaaaaccacctgttaattatgaaatctccaccgcgatgcaggagatgggaaagagcatgtctcggagttctctttatataggccggaggggaggaggtcgaccgcacggacggaaaacggcgccggcgacggtggagctccctgttgaagacaccggtttaagaaatcgattgggggcgatttagtgcgggattaagtgggatttgttgggaaaattgatgcccactacacaaggaatcgatttttgcaattaatttggaggagaaacgatagggcagggagatcaacggaggtggcagtacttgagtttcacgggagagatgaacagatgacggacagaggtagaagaagctcctggtgagctaggcccgcctgccagcacatggacagcgaatggaagagaaagagaggagggaggatgaggaggatgatttatgtgggccccacctgtcagtggtctcacccatacttttggtgaatgacaaatgggtcccacacatatttttttatttctaatgccacttaagcaccacatcaacgccatgtggaaatgagaccgagtcaacattgccacgtagacgccacatcagcgaaaccgccgagggagtcaaattacactggttttgagagttgggggggtcgagatatccggttttgtggtttagggtcacggattagatttcgatcacttttgagggtcagaaggtgaacttattcctacctttgcaaggtcagaaatggaccgtaattaacttccacaagcccataacataccttgtgccagcccagctcggcccatagctcaggtccacgacactatatactctttgccagagattttcccggtgtccagattcctgaatccaacataaacttctgatcttgcagcaaataaaacagatcattacagaatatgaaggccgggccactttttccccaggtctacagacgatatacataacatgaaacacaagcaagaaagtagccctatggcacaaaattgaaccaaatcatgaatgttggttacaagaagggggtaatgatataatatcatgtctgcaaaagaatacatcaatttcaaatttgcaacaactaagtacatgttggctgtacctccagtatcctttcctgtgtaaatgtggctccaagttgacacacgttatggtgttagtgtatactgctctagggaaaataatgttctttgccagaattctccccagaatgtgccgaaagaatttcctcccagtatctacaggcaactcagcaggcgctcgagatctgtatgtccttgatttttgttttgtgttactccgattcctcaccagtttcatttaccattctagctaggtcttggacaacttcagacattggtggcctgaattgtggttcctgctccattaggaaagtttcagattttacacatgatccctagtactcaaaacgctttgtgcaaagaatgtaaagcattggaacatgtgcatgcgtaatactagtatgcttgcaaatgcagttccagtacgaatgaagaaaatacacatcaattacccggatacacccgctgattatgtcagcaaatcgtgacagtgctttctcagaacattgcccttgtatagaagggtccaccatcctggacagtgattctatgtcatgaagctgagaattggcccatctaacaagatgttgctcagcacgtgggagtgaactgaaattttttttgaggataaaacaggcatgttaatcaaatagttctttcctcgtttcgcactaaaattttgatctaaaacaattacggacagctcttgaactcctgatcaaacatcatgagagaatgagactttaaatttttcttacctgtcgtatggtttacgcccagtaagaatttctagcatcactactccaaaactgtaaacatcaccttgttctgtaactatcccagattcccggaattccggtggttcatagttcaacagtgaatgcattcgatctgccaactggaacaagaacatacaagctgtaagtgcaccagctgtcatttccatcaacataacaagatgatttcttcactgcctagcaaaattaaattagctaaatctactcatttgtgatcaaacaacaaagcatggcatcaactagtctagcagcatagtaaaagtaattgccagtgaatcaaaatttaattatttccaaccaacgggtagagaagaattctctagtaaggtttatttaaggaaatttccaataagcttagtcacacctaaggacctgttggtacctcctcaaggactataaaatgtaaatcactctttacatgttctaaatttaaatgcttcagctatggcaacttcagcacttcaataaatacatggaacaacttatcacacatattgtatcttacctgagtgacagaacttgatgccaacaatttttctagtccacattcagcaacacgcactgaaaatttattatcaaggagtacattagccggttcaaagttctgatgcacaattggaggctggaagctttcatggagatacctacaggaaaggaagtacaaaggttgaaaaaatgaaagccatacatggattacattaaacatagaaccataattttactcactctaaggcctttcctgaaccaagagcaacctggaggcgagcattccatgacagtgtactatcaactccctctctatcatgaagtgcatcatctagtgtttttgtactaaagtgattgtacacaagtaaccgctgcccatattcagcacaatatccaactaactcatggatgttaggatgcctgatatccgagacaagctgaaccaggtctagaaattcatctactgatattcttccattagtattgtcaatcttcattacttccaaaaactacacagaatagcaggaatcatggttaatattttaactgcacactgaatataatgcatcacacttctcattaggataggtaatacttagtggttagcacacacctttccttcaggaaactctgctaggtatacctttcctagtctactctttcttatcaaattctcctctctgaaactgcttgtatattgctgaagagatgccacagagaatgaagtggcagaagttggtttatttatccttggtggagatatgtatctcttttctggaggaacaacaggattt

SEQ ID NO: 5650 - DNA, 8181 bp, Oryza sativa
atagaataacccaggcctacttccagatgtatgagatttatagctgaataaatcatcatgatagggactcatgtcaggcctttcagcagcttgttggtcacactgcacaaaatggtacgaatcttagacaggtagtgtcaacagtccattggttcatttcagcagacaacttaattgcgaatgtaagcttcagcaccactgaacaactaactactcctggtccctggagacatgaatctactacatgatataatacataaacattagcactaacaaaaagagctcacaggggcaatcaacgacagaaaagacaagtattcttccgaacaattgatattgcacagacagtatggtacaccaacagtcacaacacacattcttctctgtttaacccaaacgccgtttcatattgcatcagatgcccccacattattatcgattttactatgcatctggtgatctggaacttatgaagaaatctagattattagctacaactaacagcctcagtttttccaaggctgttttacttatagtctcttcaagctcttcttcctcgcatcaatcttcttcttctcaaccggagctttcacagcatgtagcccatccttcttgggtactgctgatgctcccaaggcaggatcagaaggagcagcattctgatcctgcaaattagagccaaatgctttatttgcagtggaggtagataatgctgctggacccaatggtgtgttcttgctgacagcattgtttgactgatccacatttagagctgtggttgattcagaaatagtcccgctcttggtcttattcttgggtttaagtgcatggatgctagtgtatagcctggatatgaagcaacatgaaataatcagtaactaattacagagccacatgaaactttagcaagtgaaacaacatagcatgctacagtggcaatcctaatatggcattctttgaccagtagagctctaatcaaggtttgatattacaacgctaaaaactgaccttgcatgccgtgcatactcctcatagttctcaagcaacaatttcccagcttgctcattaagggcagattcaggaaatggttctatcagaaggcatctcactacctgtcacatgccaagaaagaactcttactcgctgttgtgctaaatcatagctcagcaactgcttacaaagtaacattactggaataatatgattctggttaccagcagaacatgtcttaatccaaggctaggattccaatccttcttcagtgtgttaacacatatttcaccactagttgctatatttggatggaaaatttttgtcaagaagaatcctgcaaatcaaaagggaaggtcaaagacttacaaccaaatgcctcacttgaagaactaaagaagaacattactgaaagttttgagggatagctacctttaggaggagactgagggaagtcacgagacaacaatagcttcatacggaatactccattctcatatggagttccagctgcaccaagtcaagattcagattttcagaatatggtgtaagaagtacaacaggaaaaataatacgggttctattatgcactgcaagcagcagaacaatgtgctagaatggtgcaaagcaagcacaagagcatatattgatatatcattaccaggtccctcaatatcagcaaaaatggtggtgaagtcatcgtcattaacaataactttaatcccttctggaggtgactcatcaagactcttcagttccttagccaattgcctaacgacatttggtgggaggttctcgttggttgccttggtaatgcagacatacaattagaagttagaatcatgaaagagagaatagctactttgaagtggtgttctcttgaaaatgaatgaggtcccaaaattattaaatacttctgatggcttaccatggaagcaataacagcagataggtaattgtttggcaacttcacttggaatttgatttctacagtgtgatcaatcgccaaaacaagcctacaagaaaataaatagataatagttagggatgtgtgattggattgatatagaatgtttgaacaaaaaaattagcagaaaaaaaaacagtacagcactcaaaatatttcaattgatatctacggagcagcaaaatgaagactgtatcaggtaaccaaaaattaaaacgtggcttgcaaaactagaaactattgttgcagtaatatgcaattgtgcatgcaccaagcaaatattatatccaatacactacaaatgaacaactactatatgtgctaggggtcacttaatggttctagattatactgctatgaatgatacatacaatgaatattttaaaaaacagtaagtggtttcgtgcagtcatcccacgttttagtattttgtgcagcataatcggtcgcttatccggtataattggccacttgtgtggctttagcggtacaaggctggggcacctgttttttagaaataaaaactcacgatgaatgcaaaagtgactggatagcaacacattgcatatgccatgcaggagagatcgatgttatcatacattgcatttgtcgtgttatcgcacaataatcttaacctaaaagccatttctgtgtactgatataccaactcgacgatttaacatcacttcctactgatataccaactctttccctctccacaagtcccctcacgcatgcaagtgcatgtgcacactcacaccaagtaaatttaagtgctaaattagtaatttaatcccactaggaagcaatgttctacttagtaacacttgcaaacatggagtacttcaacatagtatctgcaacatcgagaagctaataacactggaacaatgcactaagaccacaaaccagaattggcggtttgcgtaaataggctacgtacattatcacatgctactgcaatattgcaaatatggtaatgagccatctccgagcgcttatttattactaacttgaccaatcaagcgtataaatagtaactactactaaagtgccaattaacttttatagcctcgctccctccactttacagagagttttcgcgcgcgcaatcgcgcactcccgccacaccatgcaaatacaattcctgcatatttattcagggcaagtatattcaggggccagtgccctgcacccatgcatcatgtgtgaacagaaaatttaacaggaacaacacggagtgcttctcgctctagtgaacagaaacctaatcaacaatagtcctcttagaattcacaaacatgtcctgtcccccctgctcagagatgagattgggcgcaatgtacttccggattaatagatcgaccgatcgatcacactcgcctccactatcaacataaaacgagtcttaacaagatctcatctccatcaacaggacgaaacagacgccttacctgcgctaaaagggcaaagggaagcgtaccacgcggagtcccgccgctaaaatgccgcctccgggtgacccgcccacgagatcgacgcagcagcacgcaaccagccaacggtacgacgatcgggggggaacggcggcgccgggcgattcccttgcagcagcggcggaggcggcggccgggcaattggggcgggcgacgggcaggatgaggaagctccgcgccggagagaggatccccggaggtgggcggccgccggcgagaggccgcgaggggggagggggaggaaaccctaggggcgtggaggaggcgctcttcgatttggggggagaagggggggaggaggaggaggaagaggggtaattaggatttgagggcgactcgagaacctacggaaataaaaacgagatccgcgcggtgcgcggtggtgcgccgagcgcgagatccgaccgttgacgtcggggtgggccccacgtgcacggcgcgtgttggggggtgggtcccgctttgccgtctcgccgacgcgctcggttagttagccgttggggggtgggggagagggggctttggttgggccttgggccgggccgttttcacgagttcgaaatcgtcccggcgagcgtcgccggggagcggttggaatgagagaaaccaacggtataattagtagagggctcgaggctactgcttcattcgtgctagaatattataacctataactaatggaataacatagtaatccaaatctgaatatatttatcagttagtctctttaattataggttctgtttaaattatagtactaaattaagttatattcgattttaggttgtaatattcacatatggagggagtatgtgctaaactgcttatccatgtgtcgttggagtttggagtacggatgcagtataaccaatgttccgtaaagttcacgagaaactactatgggcatggtatatctcctgtgattcttgtattggcaagacaagactcgtctttttacccaagaagggtccatagccccttttagacagtggcgtagctaaaatttagagtaaaggtggtccattatacaatttttattatattatctagcatatatactatagttttaatctcgatcaaatttttaggtggtccatagatcatagtgccacctagctagctacgccactgattttaggccttctattgctgggcctaatgggacaacgccatattagctcaggttttatcaccagacgctatgtataaggtgtgcacctgggcaggcatcaacacgtgtagccaaccgccgcaaactaatcaaacaatagaattaaccacagctgacgatgagcagtggcattatcaggcagttcatcaccggggcactccattttctgcactgtgtgattattagtacacacatgttcctaagatcctagtcacaattgagtgtgtttctgatttgattccatcggggagaaatgacgtaaagccaaggacgaaggacatcgctgctgttgaagcatagcttcgcctgcttggcatcacagtgacaagaatcacaatcatgctgtacgaatttaggcctgctggatactgacatgtggcgtaatagtggccaaaccattgggggccaaatgtcatgtcgacatacgagatcataactgtaccaacacacagcacaggcttagactatctccaacaggctaggcatagcgacacccaaacccaaaatatgtgctccaggctactgtagcggaaaaaaacagggtccaacagagtacccatactaaggacctattttgggttccagccgaggcggaacccaaaaatgagcgccctctctcctcgaccgaaacacctggcgcaactgtttcgcgggaggtggagagaagaggaaagcgcacctggccccggcaatagggaaagctccgccgccggcgagatctgctctgagctaggcttcgcaggtatggatctctctccaaccccaccctccttcatccctggtcccatctctcctctctctggacgtggatttggccgcggccgctcgcaccctagccaagggcgcatcacgctgcatgctgtgcctagccccgacgacgccgctcaaatttttgttgaccgcaccctccccagcatgtttgtgccatgtttaattgaatctctgttgtaataggatgatggataaaagtattggtggctcaagtgctcgcgctagcgaatctgaagaaatatttgggacagatcagtgggcttttgggttttctgccgctttgcattcttttgatgttcctccgaacccccaggtttattgcagccatgcatatgatgattttctttatttacatatctatacatcgatgattaacagttcttttcatcactagttcaacatgcatggctcgtcccaaatgtcatgcccacctataaatgagcaacctagccaggggctctccattgacaacaacattggctctgaggaccctccatcattgaaatcacagagggctgcaaagaagaagaaggtgtccaggagaggaattgcattcaccaaagaggaggacatggtggtgtgttcagcatttctgaatattagcaaagaccctattacaggtaatcatttgcaacatcttttatgaattctttgatgcccaaataacatggtggcataacatgcaggtgtgaatcaaacttcaagtggttattacaagaggatgcgtgattatttcaatgagcacaaacctgaagggtccaaccgtagccagattgctattcagcacaggtgggcattgattcagaaagcgataaacaagttctgtgggcacaaagcagctgttgataggctaaatgagagcggaaaaaatgagcaggatcgggtatactttcactcatattatcctccatctatctaatttacatatggttactttctaaccggtttaatctattttttttatagaaggtttaatctatattcatatttgcagatagatgatgctgtacaaatgtacgagaagacataaccttttaccttcatgcattgttggaaactacttcgcaacgaggccaaatggaacaataagtttcttgagctaaacaactctacatcacctgatcgaatggaacctccttcaactcaaggccatactgtagccggccatgcagaatctgggaatgagaatatagacacaacacggcctgagggtagggatagtgcgaagaggcgtagattgaagagctatgcagagacatcatcatctagtacaacagttgaagtcctccagcggttgcaggagaaatcagagaagaccgaactgaagcaagaccagcagatggttgaaatccttagtaggaaggacgaaaaaattaaaattcagagggatcttttcaaccttcagaagaagcatatgaagatgagtgtgaagcagcacaagaaggaaaatgagattagggagaagcagactgaggctcaactgatgtcagctgagtctagtattatgtccattgacattgagaaggtccccccttatctgaagaactattatctaggcatgcaacgacaaatcatggagcgcagaggattcagtagtcccttgaacaacggagactaaggagcgtgtgtgttgaatatatgtccaacttggttcgcttgagttgaacttttctattgtgtgcaactttgtactattatctattggagtgatgtgtgtctgttcatgtagtgactattgttcatttcagcaacaaaatgtcatatatttcttatcaacaacaaaatgtcatatatttcttaccaacaggcaacaaaatatctttcagccactatagttcatgtgagcagccaacaaaatacaaaggtcttatgagtaggcagcaaaaaaactaagcctacaactaaagactagttcctgtgatttggagcaaagggaccagagcattggccatatggcatctacatgtgttccatcatgtcattttgaagcaatgctgttgtctctctgtcctgaatgatgttttgagcatcaacaagtttctcaattgccgggatttccctatcctggttaataggtgggtcggacactccaggccattatgatggatggacagtaggtagctgaaccccacgctcatcttcaactaccatgttgtgaagtatgacacaagcacgcatgatggaattaagtacttttggactccataaacgagctggcctatgcaagattttccacttagcctgcaggacaccgaaagctctctccacatcctttctacacgactcctgttgctctgaaaataccttttgtttgttgctaactggcaaagcaatgcttttcactagtgtagcccaatcaggatagatgccatctgctaggtagtatccaagggaatagatattgtcattgacatggaactcaacagagggtgccctcccgttaggcacatcatcaaaaacattggaacgatgcaaaacgttaatgtcattgtgagaccctggtaaaccaaagtaagcatgccaaatcctaagatcctcggtcgccactgcctcaagtattagagttggcttgcctttgtgccctctgtacatgccttgccaaccagtcaggcagctagaccattcccagtgcatgcaatcaatgctacctatcattcccggaaaacctctggccaaattgatgcttaatatgtgctctatctcctcactcctgggaggacgaagaaattctttgccaaacaccttgatcacagtcataataaattccttcagggtctttagggcag

SEQ ID NO: 5651 - DNA, 7996 bp, Oryza sativa
actcattagccggtcctccatatgctagcatctttagagccaccgtgcacttgtgaagagcagagaatcctaattgcccagcagcatttctcctctgtgtgaagaacctgttcttggctgtgacctcatccactattcgaaggaacaattcccgtctcatgcgaaacctacaacccaaaattacagttgtttatcaaattaattcaatatatctacaagaatagtgagcaatatacaattgatcatgaaaatgttggcatttccttcaacacaaatatgtcatgaaaatggaaactgggccaaagattctacctcctcctgaaatgttcttcattgtaaagtggacgttcaacgaagtagtcctcattcaattgccagtctgctgcaattcgatcacgcttataagtcttgtggccagggactgaacctccccaagggcgttttcgtggcgtctgggtgaggatgaccactgcggccatgatctcatcgtcctcagagtatgttgcggctgtcccaaacattgacattttgacgtaactccaagccatggccaccacaacggaagtgcaggtctaaagccaagccgatttagggacaaattagccacaaattaaaagggaatgtgacatcgaacaagcaaatgctagaaatcagattacttgtgttctgattgactctgctgcgccaacgttcggccttgtccgaacggttgctcgccggcggctacctcgctgctactgagactcccttctcacatgcagccagggcggcaaaacaatcccgccatcgagccaaccccgtagtcccgcgccccgcgcccggtatatctcgcacgacaccctccgtttcccgcgtaaaaatttcattgcgggcccgcgaaggaaactgtccgcattgcatggtttccttttgcgttcgctgttggagaaggcaagaaataggtgcgtgacccttttgccgcaagcgacgcataccgtccaatgggtctcctgttaagggtattattgttggagatagtcttatgagtttcgaatgcgtgcatggtcccttctgctggcagctgccgcctgccggtgtgtcccgtgaccaatcgagaaatcatcttcctcaccgaaagagaaataaaagtaaacagtcattttttttctaagagttggttaagaaaatctccagagtcctacaagtggtctcaagaacagggtgcgcgccatataatatgatgctatgtaaagattttaacatagatgcctatcttttggggtagttgtgttccagtctccttaggctgcgtttgtttgtatgggttcctaactcacattaatccatttttcaagttagttttagctaatacttaattaattatatgctaatgagctgcttcgttttccgaactggaaggaaaggctttattaaattttatattattaaaataacaagatttttgtattgtataccttgtggtaagaaatggcactacatatctatcattaacttcacacaggtccacttatcagtgtctctcctccctcctaacccctttctctcctccacgcacttagattccattacctcatcgctccctaccataatccccccccaaatcaccaaatgccatggctctctctttcttgttgcccaatgctgaacaccaagagttgcctctcctcctagtcatcgaacgctatgctaccttcacctcctccttgtcgccgaatgggatggaaaagaggaactcagggagctctacgtagcaaacacaaaattgttgtggatccataggcttcgtgcggctcagatcttgcagttgttcgtattttggcgatgacggaaagcttgaaggtgtagatggagcggtaacgatgagcttaacgtctcatggtgagttagagatgagcttgctcgtaactcatcggaatactatctttctcctttggttttgtaaggtgccacccccattatttctttccttttgaaccactcctctagatcattctttttttttcatggggcactcttgtcctctgcagggcacgaggagtctgacaaggttatttgatgggctgacatggagttaggacaatcttctttctagggcatcaccaatatttagggccaatttggattgctaccaaaaacatgccctatcaatattttggtaatttgaatagtacttgtgtttgatttggattgaagcccattcattggtaatacctaatctagatttggcattatctagaacattctttactacaatttcacattttgactctatgttggtagcaaaccaaatatgatcaaaaacaatcttaccttaccaaatatttggtaatattaaaacttgcctagattttggtactaccaaaaaattggcagggtaacaatccaaatagacccttactacctaatttatgggtattagttattgttgtagctataatggtgaaagaagaaaaatgaatagtaaactggaccccacaaccactggccatgatagagagataagacaaatgatttatttattccttatgactaggtagtcagcatatcacctgatatttgttacgtactactcccataatatatacaacttggtagtactagtattttattccttacaacccactttacatgcatattgtggatgcccgatatgaagagttgagccactcgctacctcatcacactaaatggcctaattaagagaatcctacgaacaacctcatatttttcttatgctcataagctaaaatttaaattttcaatcttcaatttagattaatgttgaggtttttcttatcctagtttattttttagtctttatttttagattgctaagaatacatatacaaaatttttattaataaattatttttcgtttgcaaataaggccgattttagtttcaaacttccaacttttccatcacatcaaaactttcctacacacaaacttccaacttttccatcatatttttccaatttcaaccaaacttctaattttaacatgaactaaacacaccctaagccaaacgatggagccataaatttctacgttctcggcacgtctcacggtctcacgccgtttgcacgaaacaaacgtgacactgatacacacgcgtacagcaacaaaccgaatacgtacgaaaactccaccttcccaagtcacgcacggagcaaagagacgaaagttaccgaaacagaacacggggacgacgagacgcaccttaagggtgtgtttggttgcctgcatggaacctggctcgcacacgtggatgcagtgggtcgctgtttggttgcctgcaccttactcccagccaggttgagcggatgcaaaaaagcccccacagccaggctgagcaggaacgctcgatttgagcttcgctgctcggccaggcccgcgcgatgcaacgcgctgcacccgcgtgtgcaagggcaggtgatggggtcaccaccccgccccttgccccctcctcattttctcccaacgaacgatagggcgacgacaagctctacggagggaatggcacccgacgaatctgacttactgctgcatccccctcctcttcccaccatccccccctcaatttctggccaccgctgtgcccagacatcctcgctaatggcgtgagcactgccagatccagctagtgatgaggaggcaaaaagcttgacggcgacgagctcagcggagggcgcggcgacgaggacagcggatccaccgtgctgtcgcgtccctcctcctcttcccactgtgcccccatcttcaatcgccggccaccgtcgtctccctctgtcagccagatctgatggagcggaggagcggcgagcagcgagcagcggacggagaggagcatgagaagatgggcggaggagcagtggacgaagagaagcgccggaagacgggcggaggagcggcgaacggcgggcagatgggcgcacatgcggctgtgggcagagaggagttgatggtgacgaaggcagcaccgatccccttcctctatttctttcgtttcttttttttttgcccctcgttttgcgttttctctttctttctttcgtttttcactagcaacagagaagtctgtatgtagaattactagtagtagattagtttcaccggttcatccaccttaagaatttttttaattatttttttatatattgtagaggtaacctcacctaactatatgtatacgaagagataaccacactcacatcatgcaaccaaccaaacaaaattccttctaaacagtatccctcatacaggcaaccaaaacaaaatctcatgttagcctggctagaccaatacaactaaccaaacagctacatatgtattcttctggccaggtcaaactcagcctagatgagagagatagccaggctagggtgatacgggtaaccaaacacaaccctaaatttctcgcgtcacccccccctgctgaaacgcaacacatcccgccaaagacgacgacgacgaaataccagagacgccatcgccacggagacgtgaacaccgagcgagcgctctctctctctctctctcgccaaaaaacgtacgttttctggcgcattgtcagcgtgtgccttggccaaatttacccacgcaagctagcggcatctgacgcgcgcgccgccgatgaaacgggcctgccgctttggcatcgtgcggtgccacggttaaccgcaccaccaccaccaccaagcaccaacaacaacaacaaaaaaacgcattgattgcgcggcgacgcgagccacagccacagcccccaccgggtttaataccatcgcgttggctggcctggcatccatcggcagtggcagtgcagtgcaaaacgagaattaatctaggctagctactaccacctgagtttgctgttgctgttgctgttgttgcatgcggctgtgacggcggcggcggagatgatgtgcgggaaggaggagaagctgctcggggtgcagaaggcgccggggagttgcccgtactgcggcggaggggtggcggcgacggacgtggaggccaagtgggtgctctgcttcctcccgctctgcctcaacaacaagcggaggttctcctgcaccgcctgcaaccgccgcctcgtctcctaccccgcaattgtccatgactagtagtagtagcgacctctctttctcttctcttcctttttcttttcttttgttttattttcttttcccctgattcggagatttgtcgtcgtctatcttctccgggaaggtgatttgataaattctgttctagatctggaactagctgcttctttcccagcgagaagaaaaatagagcatatgtagtatttgatgagttggttcttgttgcgtttattttttggttcgtccatggatggtgaacaaggggtgttattgccgatgctgcgtgtacgacgatgtgttggttccgtgatgctaggtacctaaaagaaagaaaaagactgcgcgaagttgagttctgcttctatgtgatactccctccgtcccaatatattgcaacctaggatggaccaatatattgggactgagggagtaatctgtttaactgatacgggtgttgtttgtactactctattctaaaaagaaattcaatattagcaacttgcgtattcaggtttattgttaggattagatcattttaatagtgggggtagataattattcttttattaatagacgatacatctattgatagtgtggtgtttatagtgacttcatcaagattatatttttcatgtttttgaaggtgtttatataggtgagatgtgcgaatgtatttataaggacaattgtgtatgtattgagtgtctacgattatactgtttttaaagttatgccgttcttgtgtttataagtataggatgtacgtgtacgttttattagagtgagtgtatgcatgtcaaacgtcatgtttatattactctttctgtctcaaaatataacaattttgggtggatgaaaaataacatagtactatgaatctaggcataacctatttataatattagaatatatctcatatagctagaagttcttactccatattttaggacggtgttatatcttaggatggtgagagtactgtttttcttttgaaaaacaaaagggggaaattgtcacaaggcgataaggccttggtgctatcagtcgcggcggcgcatcgcgatcatgcgggtagttcggtcggtttgctggtcgagaaagacgtgtatctcccctccctcttcgtccgtccgtcgcgatcgtcgttggatttgccgatgatgactcgcgtgtgcaccaggcagcacaggtagacccatgaaatcgagctagtgtgtggcattggtttcccattcaatctttacacggggctaaaactttttaagcccgtatcatatcggatgtttagacgctaatttagagtattgaacatatactaataaaaaaactaattttataaatgagagctaatccgcgagacgattttttaagcctaattaatccataattatcaaaagtttactgtagcatcacattgttaaaatcatggcgtaattagacttaaaagattcgtctcgtgaattagtccaaacttataaaataggtttataattagtgtatgtttaatacttcaaattagtatccaaacatccgatgtgacaggtacttgaaacaagttcgtgaaaaccaaacagcccctagtactacaaactaggagtagctattgggtatttgcctccgtgcctcacggtatctggtgactgtgagagcgatgagatggacaatgtttctgtgtcatcagacatgaggtgacagagttggtcggtgcgctgtccacaacaagctcaactgagattcgtacttaggtttagtttagtttccttcaaactttcaaaaatttcgtcacatcaaatatttggacacatatatagagcattaaatgttgacgaaaaaaattaattacacagtttgcatgtaaattgtgagatgaatcttttgaggctaattacgctatgatttgacaacgtggtgatacaataaatatttgctaataatagatatattaggcttaataaattcgtttcacagtttacatgcggaatttgtaatatggtttgttattagtctacgtttaatacttgaaatttgtgtctgtatatgtcaaaaaaaaattggaggagggcctaaacacggccttactccctccgccacatcctagtacaagtgtgtttagatcgaggggtgtaaagttttaatatgtaatatcggaaattatatagggtgtcgtatggggtgctcgggtactaataaaaaaactaattacagaatccgtcagtaaaccacgagacgaatttattaagcctaattaatccgtcattagtaaatgtttactgtagcaccatattgtcaaatcatggagcaattaggcttaaaagattcgtctcacaaattagtcgcaatctgtgcatttagttattttttagcctatatttaataattcatacaggtgttcaaacgttcgatgtgacatggtgtaaaatttttgtgtgggaactaaacagagcctttgtaataggatatgtcacatccacccaaaatcccttacattataggatggagggagtactttatccgtcctatattattgttattcttagtatatagtactagcatagattaaagtttgagaaaaataatactataatattgcttgttaaatgacatatggttgaatatgagaagatggctacgggtagaaagaaaaaaaataaattataagtgattaatagtttaagtagtactttattgtaataattattttgaggtaaagtttaaattcaaaagaaataaaggacggatgtactaagttcaatcgattgctaaatactcactccattttaaattgatctacatatagtttttttcttaaatgatctacatatttgtgttcattcattaagtactaatcgttatttgttcattggagtaaatggacattgatgcatgcatc

SEQ ID NO: 5652 - DNA, 3654 bp, Oryza sativa
aaataaagccctgtgcataccgatgcaactgatacaaatttaaggaagcatccgttgcatgcacaaatttactggaagtctgaattcataggatcgatgctcactgatcaatggacgggagaagccaagaggtttctgttcactgaatcactcctcaacgggacctgaatattcaactgcggtgcatatctttcttgagattccaaagcctgatatcgccgggatgcttgacaaattatacaggagaaagttatactccagacaacctgagctgtttcatgtgattaattagtatgatcggttgctgtttatgtcgtttgactggattccattggctactaatgaagtaacccatttatacttgttttttcatgtttctttggatatatactttccttctctaagttgaaaaaaaagagaagaaaactttgttctgataaacttataggaaattgatctatagctagttttgctgtgctgtaggagtcctcaaaagcatgaaccctcttcacttcgtcagaacagagaacttttcataacagcagctttggatggttcggactgattaaaggcggccttcatgtaagaatgcaagcatgcattatgtttaagttaagttaacccgactgaagactaattagtcggtaatttaacaattcagagccacagtattctagtccatcttgcatgttccatgcaacaaaggacatcccactagcagcaaaaaatacagaggtttcacatgtggggcaggccatggatctagctaccatttgacccttagacagttaactattgatcgaccaacactgttaggcagacaaagacaacattactcctaacaatcataagatactccccacatgtggatccactgttaaaccctttgctttggactcatcaatgcaagctacataacgcctttacacatcaataaacaatgctgtaattaactatctaccaagttactattactaccatccttcagagttctaaaaaatctgttcatgcagggattggattgaagcagccagctctttaaccaaagagtaccagagtgatcttgccatgcactgtggaaacatcatgtattactttaatttatcccagtgtaggatcgaagttactacagttacctttgcagctgtggcaaagatcaagcaaaaatgtgcagagcgataatgtgtgtttgaacaaagggaatcaactggtggaatctttagtaccgccaacccaacttgtcaaataacggctgaactcttcatactcaaggccctaacctttactttgatgccaaaacagttgcagaaaaaattaaaaaattgtaatcaaggggtgtctttcctttgcatttctctctagctaggatcctacttgatctcatttccctattcttcagctctggtagttcttcaggtcttcaagaaagcccatatcatatttcttttgcattttcctctagaaacctagaatcctatttttttccctactctttcttttttgccttcttcaagaacactatatcccaagaagcacatagtagagtatcgtgatcggaagcgcgatgagcatcccaaaaataaccctgaaaatttcacatttatatattttaggctatatacttcagcaaccgtatggacgaacaaatagaaagtttaagcatgcatttcttacgctgtgctaagtatttgaggatggcaattgtactccttggcaaacacaaacgggacaatgccttgtggaagtgctgcctgtttgacaatcaattaatctataagatcaccacaatacattccaattcaccataattacaaaatttaatattttttttcttttaagatgattgcaagaaataaagaatctactgcttacctgaacaatggcaacatgcaagagtactcccctgagcccaatggcaatggaagtagctgcaataacagctggaccagtcaagaacctcactgccattgcaaatgtcgcaacggtcttgccacaagaaatgatctttggttgcagagccatgaacaagcctgggttacatatactattgtcagaatttcttggtcaaagcaaagaaaaaactcactagttatggctatagatatgtatcaaaaaggtcaactctgtacctaagctgaacatagccattcctagccctgcatctgacaatattgatattgagccctttattattgaaggcatttggatattccacctgatccaaattcacaaagtcaataagcaattaagcatatattttcacaatgtaaaaaaaaattgtatgacaagagaatcaatgctagatgtatcatgcatgtatgcaattttagatgcttgcaggcatgtgctcctccccactaaaaatgccctgttcttgcaaccctccctctagatgtgccatctaatggtaagatagtagtacaatgaatcaatgatgcatccatatcattgtacattttttgctcttcttcttgtacacatgatggatcatctagctagttgagccgaattcgccgtgtctgtcttggatggggacaaacacggcaatcgcagctgattcggtagatttggtctctgctgctaaactccagggctcacataagacctgcacctgcacctgcatctgcatacgtgtgtatgttctttgcatgtgctggaccagatccgagaccaacgtaattatcatgtgctctcacatgcgttcagaaaacactaatccagttgtgaagttaagtaagttctcatcgatcttgcctcttcctagattaaaatttcaagcaatctagcaacgaatagcatagcaaaaatatatcctttttgtagcttcgaacaacataaattgatcagatcgtgaactcaagtgtatattacttatttggtttagattactatgcagattatcgatttcattatacaaataaattaaacaatttaaaaaaaaacttaacaactagcttaaaacaagtaatctaagtaatgtagtagaagaatatttttttttataaaatacttttttgaaatggagagtaaataatctgttttgataattcggtataacttgaaaaaaagcgcccttgccctgaagatgaaccgggataagcgatctgtcatagctgtgggatgtcaaaatgtattggcagaagagtgttccatcttagagggaagcgaccgggaaagcgggcgtcgatgaagtggaactgtggaagcgagaacgtcagcttgagtaccgaaaacatcggtgagaatccaatacctgaaggagacgagggaccagacgaggccgatgaggctggagtaggtgttggggtttctgatgagcttgcgccacaccatgatgaggatgagccgcgtcatcacgctcgtcggcggcatcgggtgcgccgcctccgccagcccgggcacgtcggcgccgccgcccttcttcctcggcgccacgtacggcgaccccgacaccgggaacttcgccgccagccccgccgccgggctcttcagcccgtcctcgatctccaactcgccgccgccgttcttcgccgccggcgtgacactgccactcacccctgtggcatgcacgcaccattagacgaagccttgaacacatgtggtgtgatcggcgtcgtgtgcgtcaatggatggatgagagagtacctttgggag

SEQ ID NO: 5653 - DNA, 2492 bp, Oryza sativa
ccggcatcatgccggggttcggggcgggatacgacggcgggaaggcggacttacaggaggcgaactagttggtgacctgctcgtcgaggccctgggcgcggccgccggcgccgccgtgctgcgccatggggctagccatctggctggccatcttgctgcccggagaacatggcgtagaagtcggcctggttgaagctggacgcccgcggcgtgggctcgcgcgacgtctgcagcgagtagatctccacgccggtgaggttggaggcgcgcggcgtcatggcgttggacgcgccgtacgcccgggacacgccggagcgcgccgcgccgccgccgccgcccgtggtggaggccgaggcggagcggcggatgacgacgtggacgcggccgtcgcgccccacctcggcgtccgcctgcagcgcctccctcccgttgagcgagacgacgtcggagtcgacgcggaacgaggcgatgctggcgccgacgtccggcgggaactgctcggagatgagcgccttggcgccgcggtactcgaagaggaagagcatgagggtgtaccagatgacgctctggagcacgacgatctgcaccatgagcgagccggagaagtcgccgtacatggcgcggagcagcgggatgcccatgaccagcgtgttgggcagcgtggacagcgagaagagggtgatggtccagtcgagcgacgcggcggcgccgccattgcggcggtagcgggagagcaggttgtgccagacggcgagcgcggcgaggatgacgagcttctggagcgagtcggcggcgaggaagcggtagttcatggagtaggggtcgttggtggagatgaagtggaaggagaggagcggcacggcgaagacggcgacgaagcggttgatgccggagcactggtccggcgtgaatatcccccaccaccgcaccgacccgtacgccaggaacatcgccacgtacagcggcacgatcgccgccagcacgtcgtagatgtcgcgtccggtgatcatcgcgccggcgacggtggcggcggcggcgagctttttctttctttttttttcttgacacaagagaacgagctaattaagtgtggcaagagaggcacaaggatggttatatagctggagaagatgccatgacgacggtggcgatgacgcagttagttaatgggagtgttagattgacaattagttgtagttaatcaccactagcagtgttaattaagtggtaaatactggacctttggtaataaaaatggtaaacactgaactggttcaaattgaaagacaacggccataaccctaaaaaggaaggagattcatgttttttttcctcaggttaaacttctggtgtatgaacatctatacttttcttcttttaaaaaaaattaggaaaattggaactatgccattataattttgtaaaatttgagatatgtcatcctgatccacatatcattgactcgggtgggtcctacatgtcattgagataccgatggcatatctcaaactttgcaaaattataatggcatggttccaatttaccctttaaaattacagtaaaaatatagacgttcataacacgcgcacactcaccccttatatatacacgcacaccctattccataaacacatttagaaaattgtaaatgcaagcgttcgtatcaagtctaggatttgaaactacatgaaataaaaaaaaaggttaagttacactcatttggcactattcataaattttaataaaatatttagtttgaaaacatagaaaatgatatgcatagatttatcttaaaaatattttcataatcataagcttaataaaacttttcagccaaatgccaaagactgaaacgaaatcaaacgacatgcacttatgaccggagaggttagcagtgtagtagagctgaagctataggtattaattcgagttgggctccattcatataggtgagttgggctccattcatataggtgaagctatgttaattgattcgatttccatagtaacctcaagcctctacctgcctaactaagggggcatgacattgacttaaccagttaacctatatatgtagctaaccaagttgctcagtacgtaattaaggccacgccttttggtaccaaagttcagaggggaaaagtcgaagggcgaaaaactatcggccccatcgtttcggcatatttgcaaacgaaaagtgatctgtgaataaaacttttatatacgtgttcttagcgatctaaaagcatagagtgaaaaataaacttcgatgaaaaaaactcaaaatcagcttcaaatttaaggttaaaaatttaaattttaagtgataaacataaatataagcgaaaagatgaggtcttataattttttaaccgagtcaattactgtttaggacgattgacgaataagcaataaagttttgccttttcagtatacttttgaggaaaaaaaggcaatcataagagttttatgtgttatctcattctctattt

SEQ ID NO: 5654 - DNA, 772 bp, Oryza sativa
taaaactgtaaggtttaaaaaactgaaaaggttcatgataaccccaataattgtgatgtaaccgataatatgttacaaactctttcctaaactgttcaaagcaatgcacgaagctcaatagctcatagtagtattgactagcatatccacgtgtataaagccaaggatgatgagtgtaaaacctagtgaagggagttatatatctactccataaatctaacatggcatctagagatggttcctagcaagcattgtagtaacattaaagaaaaatgctacgctatgatcactcagcatgcatgggagcatgccagctcaaggtgtgtacctgtgccgagccagagagaggctaggcctgtcataaagtacatgagtacactacttgacattgtatgaacagatacagttactaacatggaccaccgtttcatcagaaagtggcaattttaggacccctctgaaatgaaatgaatggttgccataggaattttggatgaatcaattttgtaagaaaattttcttatagaaacatttggttcataaaaaagggaggaataattttcataggattgcatttctatatgtctcaatttcatagaaaaataaataagaggtccaacttcttaaaaactttgatttgctttttttcttcatgtgatgttctcaaattactcctttttatctttcccttttttttctatagtgttagaaaaacatgacattttaattcctattcttttatatcccgatattattttccatctggaccttg

SEQ ID NO: 5655 - DNA, 3999 bp, Oryza sativa
  unsure (1)..(3999): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgtgggtaaggttgacaaaatcattagacaactggaaggaaaatcactatcttacaagatgtttgcacgtgatacacaagcttcacgaagtgtgtaagtttataactattgtgtatttgtgtatttttcaagtacaaaagtggttctcttgctgttttatgataattaatcacctaggcctgacatatttgttcatctttgttggaatataacattattgttttccttgtaaatgaccatgtcactatttttatgctcgccatcaagttcaaccaaaaaaaaaaaaacttctgttgatgttttgttgttttgcagtggtccacctacagagtgtttcatgttccattctcgagctgcagtggccaaactacacactgctgatgaggtgatgctagtctaatacattgaacttttaaaccagaaaataacaatgtaacttttgctggtaatatactatgtcaggaatcaggttacttcccagtgcttccattctagtactgctaatctctacataaaagtaacagtattattttgtggtatcgcgtttgtaaccttaactttagttgctggacattggcatagcttgagtatggcattatgacgtgtatgcaattgtggattatatagttttgagttgctgatatcaaaactaaatatattatgtggactcataaaatttagcatcatggctatgcaatcgataactccctaatctgttttttttttcaattagcattctgcatgcacatatatcatttcaactggtaataccatgttccattccgttttcccaatttttgcagaattgtgaagaaggcaccaccagggccatatgcattgagctagtcgcaaacaggtttctgcgcaaggtattatacatcaagttgtttcatggcattgtaatttatccagtcgtcccccgaattctagttaatattagtaaatttcattgaacagatggttagggttcttgttgcgactgccataagggaggcagctgctggtgctgaagaagatgctttgctgaacctgatggaagccacttgcaggcgagctactgctcccccagcgcctccagatgggctctgtcttgttgatgttggatacgaggatttcaatagacaaaggtgtttcattgttgattaaacagaacagtcatattcctgttggagcagaacaagatatactgattcaacaatcgaaaatctgaatttttggattcccgagatgaaacttagatcattctggttgaacagtgaacctataagcagcactctcctgtaggaaatctgacctgcttcctagtttccatgtatccatcaactggaattttttgtattatctgagactgaaagagtgttgcttacaccattcgttcaactacggtcaaagtctctctgaactaaactctgaagaaagaagaggccgccgtgcatgctttttcaggttttcacactgtaagttttcttcaacatatttacattatcgaataatttatgatccgaaggtagaacaatcggtggaagttctactgcagatgtcgaatagaccaatgcatcttcctggaccaatatttgctgtcaaaacaacaatatcacgaccaaaatcaaggtacattccaccattttatatgaatgtgacatagaaatgggcatatatagctgtcaagttcagatgattttcagagaacaaaagcatatcaacttaaggcatatcccagcagcaacaacatcatctacaactattgctaatcacatatataattatccctaggccttgttcttgtcgtgcgataacttttttttgcatgatgtatgtgactatgttctatgtgtgtatatactataattcatgggccacgtactcgtgatttttctcttgaatcgtgggcgcgagttggcggcacgaaattctttaagacagcgcgtttgtcggtgggcgcatctcttgtgattaaccaaagcttttgtcgcgcatttcgcttccagaagtgaaaatgttgtgattaattcggcattaaaggtgtgcagatcgatgtgtcactggcaaaaatagtgaaaatggagagccaaacttgccgatgtgctttagaaaaaaaaaagaacaacttgccgatgtgctgctagatggacaaagagtaaacatcatacagctctgaactgagagagagggtcctctgaagtaccgtacgtatacgtacatacagtaccgctcgctgacacatgggtctcacagattcttagactgacatgtcagtaccgtacgtatacgtacatacagtaccgctcgctgacacatgggtctcacagattcttagactgacatgtcagttagcaatactgcacgtacagtactgcaaaggatctacatatagcatacaactacactaggcccttgtttagttccaaactttttttttcaaacttccaattcttctatcagcatccaaaactttcctacacacaaaaactttttaactttttcgttacatcgttctaatttcaaccaaacttttaactttggcgtgaactaaacacaccagaattgaggcttagactattgttcttctttaaccgttttgttaaactattatttggtatccccatgtatttggtatccccatgtaatgggttgagtcttatgtactcttgattgtggtttgggttgtgtacaccttctaaggtgtagaggccgggttaatataatccattatctaaaaaaaggaagacaacttggctggtaaaagaaaaatcagacaactttctcaacattcttggcagcctgcatggtttggttatgaaaattattgtataacccaagagattatcacgtttttaaaggtactttctttttaataaaaagtcatatatattttttttcgtcattgagctttgctggaggtctattgtcttcaccctaagtaaaaatagttatttttcgctccagacaattttaaatccaaataaatgctatcttcatttttaatatataatgccgttgattttttatatgtttgcaccatttcttttaattatatatgtttgcacaatatataattatcatttattttattgtgatttgattaccattaaaagttctttaaacattacttattattgtcatgtttgtacaaaatttagttaaacatatctctaaaagttaacgacatcatatattaaaaaataaagagaatatcactcaagtagggaaaaacaatagtagtgtggtgatttaagttgatgtataacttaagtcactaagatttacatcctatttagccataaatgttacatataagcagaaacaacggtttccaaatagtctttgaatttgtttggagaagcgttgtttccaaatagtctttgagtttgtttggagaagcttctagctgatacatcttttccaaatagtcatttttctgttcggattataaaaagctgtggttgtagaatttagaaaataaattagaagtaaggagctgagaaatccagctcccaaacaaaccctttgtcaatgtgcgagcaagcagccaaataagccattgccaaccgaaacaaagaaaaaacagaggtgatgaacaagaaaacgttgcagtctccagcggcgactcccacaccaaacgccagcttttcctcctcttcttctccctcggggtctaagcctaagcctaagcctcccgccaaataccaacacacacacacacacgcttcccgcgctattcttagctgctctctcccccacctcgcgatctc

SEQ ID NO: 5656 - DNA, 2926 bp, Oryza sativa
gacatggcgccgctcgccgcgctccgggggctccgcgccctcagcatcgccaacaacaacctcacggggccgttccccgacgtgtccatgctcccggcgctcaagatgctgtacatgtcgcggaacaagctcgacggcggcatcccgcccgccgcgttcgcgcacatgaggggcctccgcaagctcttcctctccgacaacgcgttcaccggcccgatcccgacctccatcacctcgcccaagctgctcgtcctgcagctctccaagaaccgcttcgacggccccctgccggacttcaaccagaaggagctgcgcctcgtcgacgtctccgacaacaacctctccggccccatcccgccgggcctccggcggttcgacgccaaatcgttccaaggtgagcaaattatggtgaatttatacattttttaattaaaaaatggtgaaattttgctacctgcctgttcatgcattcgtgcatgcacgaattcctagtgaattactggactagtacatgtttgatttgcaattaggacagaacatgcgatcaataaaaggatttagggagtaatggaattttgttgagatcatggtggtgttcttttctcctgaagatgaagattaatttttttacgtaaaacgaggtggtattaacgtatgattaattaatttttaattattataaatttgaaaaatagattgatatgatattttagagcaactttcatataaaaagttttcgcaccaaacataccgtttacctgtttgaaaaacataccacgaaaattcaaaatttcacccaactttcatatgttgctgttttacacatttgtctagtcaattaaggatttctttaagcaaatccagattgatgtctcactgtctcagaatccaagaataaaatgggctgcaagaactatgtaaatacaaaataaaacaaagtactattcctaccaactactgtaagtggctctttcgaggttgtacagtacgtcatgaccaattaagaaacacttacatgaagatgttaaactcagaagtcaacatccaacatgatcaaacgtgctaattaaactaaccacataaaagtattagattagtgcactgtaatataatactatccttttgctagtgtacaccaaattgcagtattcctgaatgcattgcaatattctacctttataattcttcttttttggaagaacaaaaactatagagcatatttatcaagcacatcgattcaatcaaaaatccaaacccttgattggtcgcactgtttgggctacttgtgaacgcatgatttcataggattttcgcacgaattagttcaattcctccaaaaatccaacaaaaacggattatacaacataccatgataccactgttgttctaaaataagtttatttttcacccttcccatacatatatgatatatataccaatataaaaacaaaagattaaaatactgtcactttataaaatatccatgcaactgtcccatactatctctactacaattcatttgtcttttacttttacaaaccacatcaattcgtactgcttgggtactttggaaaacacgaatttagttcaatttctccaaaataaagtcctctaaaattagtttatttttttgctcatgcaccatctgatccaaacctctccccatggaaatattcaggaaacaaaaatctctgcggcccgccggtcggcgccccgtgccccgaagtgccaatcctcgcgtcaccttcgccatcgccgctgtcgtcgtcgtggtggtcgcctcgcagcttgaagatcctcatgatcatcgccctcgtggtggtcgtcgtcggcgcgctcctggcattcgccggcgcgttgacggcgatgctcgcccgacgccgcgaggccaccaccgaaacccagggcggcggcgtcggcggcgccgccgccaacgccgccggcgccaggatgaaggccacgcccaatccggccgtcaccgtcgcacacggcggcggcggcggtggcggcgagcagcagccgcacgtgacggtgtcggccgtgccggcgaagcgcggcgggcggcgggacgaccacggacggctggtgttcatccaggagaggagggagaggttccagctggaggacctgctccgggcgtcggcagaggtgctcggcagcggcagcttcggcgcgtcgtacaaggcgacgctggtggaaggccagtccatggtggtaagcggttcaaggagatgaacgggtcgggaggcaggacttcaacgagcacatgcggcggctcggccgcctcgtccaccccaacccctccccgtcgtcgcctacctctacaagaaggacgagaagctgttcgtcaccgagtacatggtcaatggcagcttggctcacctcctccatggaggtaattaaccacacaatccttcccatcttgacacaacctgcattgcatttatttgatttatgttaatgtcgccggcgacgcgtgatcggtggcgtacgtgcagggtcgagcatggcggcgctggactggccgcggcggctcaagatcatcaagggcgtgacgcgcgggctggcgcacctgtacgacgagctgccgatgctcaccgtgccgcacggacacctcaagtcgtcgaacgtcctcctcgacgctgcgttcgagcccatcctcagcgactacgccctcgttcccgtcatgacgccgcgccacgccgcgcaggtgaggcgatcgaacgacggcggcggcgacgaacgcccgcggcgtataggccggcacgcattgactggggatggttcgtgtttgcaggtgatggtggcgtacagtcgccggagtgcggggagacggggaggccgagcaagaagagcgacgtgtggagcctgcggatcctgatactggaggtgctcaccagcaagttcccggcgaactaccaccggc

SEQ ID NO: 5657 - DNA, 4195 bp, Oryza sativa
  unsure (1)..(4195): unsure at all n locations
gcgaggcgtcgcgctcccactcctcgtagcgaaacagcagcgatctcaccttgtgtacgcgcgcgtatgtttcacagctttttcggtgcatctgatcagccctacgattcgaaagggacggaggagatcttccgggtatgtgaacgtgtgagataatactgttcagtgcgtgtaaattaattttcttagatttattaaaggaagggaagggttgtggtgaagtttttttttttaccttttgcatacgtacattttcacaggtgatatacgaagattgttggtagaaagagagaatccattagagtttgtaacaggtatacaatttacttttgcatatgccattgacttttttcttaccttctacgatttttaccatcgccgtccggttagtctatgtgtactgtacaattttatctaaatgaccaaaatacccctgggacaaaaacttctaaagtttgataaaaaaattctgaattatcatattttaagtttttgacaaaaattggatgtttacaatcttatgtttataatattgatatttcgaaatttttgtccaaattttggatgtttttgttccaggagtattttgatcatttggataaaaaatgtataatactagggaaggttaaccagacggcgatggtaaattgtagaagttaagtaaaaaaaaagtgacatattgtaaaacgtgacaaaatcagtggtaaattgaagacatgtaacaaactcagtgacatataatggattttctctagaaatattgtgaaagtatagtggtgatatgagtgagcagatgaaaggccaagggcctttgcactcgatgaatttgcatatcatgattgcattgatgacgcagtagttacgacagggactcaaacaaaggcatgcagaaactgctgactttcgtatgcatttaacacatcactccttacaccactgatctttgctcgggcgtcaaaatcagcaaatatccatgcaaaaaaggcaatattgcaaagaaaataaaacggtactccgtacttcattagtttggaactcggctagccactgccacttggctataattacggtgacaatactttctagacaggggttggtaagctgctgctatgtactgatcatagccttgcaagtactaaaatccaacggtggcaaacaatcttgatgacgtgatgcaccatataggatgaaatggaattaactacatttagtatggaccaactgtatagatttataagattagcaccggccccatcttgtcattgacgctaacctatatccccaatcgcagagctgtaacaggccagcacctaagcccctccattgccaccatggtgccagaaacatcgagctgttgatggccctacttccaagtctacaatgtgtgccacacggtccgcccctatgtgccttgccatcacttccaaccattggctctaacaacacagccctctggctttcactagcatcttcatccctaattcgttcatgccttcgtccacatcctccacgaacgaaacataaggaggtgattaatattcattatttgcaagttaaaaaaagaagaagacaagagatgggacttcatagctgctttttgagaggtctgcatacgctacgcaagcgaaacaaccgggactatccaaatcacatatatttatagcaattgtataaaagtccctcggcgaaaaagtcagccaacgatctccatgctgcaccgtcagtccatgcctagttttcttgcccccctaccaccataaatacgcacctagctgtaagatggatcacaaaacacatcgatccatccctctaccagtacataaacaagaaagataacaccaaaaaattagctagctcgccaatggccttgttgtcctccttccggctcgccgtggcagtggcggcattgttggtcgtcggctcatgcgccactgaggtcaccttcaaggttggtgagggctctagcggaaaaagtctagagctcgtcaccaacatcgccatctctgaggtggagatcaaggagaagggcggcaaggactgggtggcgctcaaggagtcgtcgactaacacctggtcgctcaagagtgaggcgaccctcaagggccccttctccgtccgcttccttgtcaagaacggtggctaccgtgtcgtcgacgacgtcatccccgaaagctttacggccggcactgaatacaagagtggcatcaacatctaattcatagacatgcgtactcttgcattgggttgcatgggaatcattaacatctatataattttgtctaaaaagagatcgcgtcgcatgtgagcgagcaaacaattaatttcctatggttatttttttggtaataggccaatggcaaataaggcataattgcgtggataccaaaaatattgttgtgtagctgtatgtgagcacgattttacatatatgttgtttatagaagatgtatcgaaaacaatatatttggtcagctttcattaagatgattgtgtggatttgatttcccaaagtttgagtacatatgtatgtccaaatcaacgtagtccatttctcctttttagcttgtcaaaaatgttgtctgcacttgttttttcattttgtggaaacaaattgttgaatcaatcatactgtgaccagactataagcataaagcatttttacatcatttagcttatttagaggtcagaaaactggaagtcacgttatcccatctctagcatgaatatcatatagaagcacacatgtattgaagcgaagccaactttgagaggagctaagcttcatatcatatagttggccaagaccccaagctatagtcaacaacaaagtttatatagtactacgagaatatcaatctattgcaaaggatctaaagtaaatacacaattggttccaaactttaaatagaagaaaaatctttacactgctagtgtgttagaaggaacaagaaaacataccattagttccaaactatatatatgtaaagaactaataaatccttaagacctaaaaaatgtagtggtggtttatggtcccttgtccaccgtaagcccatcctcactcccacgccctctcgagcgagtcccgcacgcatgatgtcccttctgctgcacgaatggaagaacaccctcgacccccaccacctgatcaaaatcaatcaaccatcattcctcggcgcttgcccatggacctcctttcacgtctagctctcaacttgcatggacgtaacagcatgtgcacttgccaataaaaaaaaaggaaaaagtacgaattacccccccccccccccgaactatcgaggtcgaacgaattacacccccgaactcgaaaactagacattctacacccttaactattgaaaccggacaaataacccccctactcattccggggtggttttgggtccacatggcagtccagtcagcatttttttaaaaaaaaaatcagtgggccccacctgtcagttctccacccctctctatctctctatactctatcccaatctctccctctctctctctcatctcaccagcacggcggcggccgtgcgagggcgggagcaggcggtgctgccggcggcggagagcatcgggaagcgtcgaggcgggagttgagcatgcagttgacggcgtcggccatcgggatgcctaagtggagctcacacatcaccggaatattctgcgtgaaccccgcgacttgcacacagagacaaccaacaaggcaacgatttcttctgaaaatgcgaatcactcagctgctaatttggaaccaaattagaagattcaacaagtaaattctaagcgatttggtttttttaagcatgaaaaattgaagaagggggagattcgggagaaaaatccaattattgtagcgattggtggcgccaccgcgaaggtcaatcttaccacgtggtggcggtggacatcgagagcggcgagggaggcggcgaggcggaggcagcggtcccgcttctcctactaggtgcgcgtgagtccagaggaggaggcgacgatggcggggcggtcggggtagacgagggcggcccggtcgaggaaggtgatgggggtgagcggcncntggttggcggcgcaaagcacggcgccctccatcgccgccgtggtggccgtgggcgtgtccggcgaactcgggatggcgagatcaaagtcagagagacaagctgaggtgaggtgaaca

SEQ ID NO: 5658 - DNA, 6148 bp, Oryza sativa
cctcctcgttgacagatatttgtcacccacagtcgttttcaacacgagcacctgcatgggctgaccctgctggctgtccatcttgctgcaaacaaaaagctataatgtaatacatccaaaatctgtaacttaacgaatcaagaatcagctcgtgaagtgcaacgacgggatgcggatttcctatatccaacgggaatacaatcaataagctgctgacgctagtggccacaagtaaaattaagtaatatctagtctaaaaaaagtttattctgtcaaaacattcagataaaaaatcaacgggaccatatgtaatgagcagttcaggaaaaaaaaaacaatccatctgctttcttgaaccacaaaattcaagagaatcgccatcaagctccttgagttttcatgtattgaaaatttcagaaggaacaaaacaaaggagctcaagaaaaacatggctcagttgcaagcaaatgaacctctcaactagcggacccatcgtgctgcccgcagccccctgcccatgtgggatcgatatgccatcgacgaggctgacccatcgcaacagaactaaagcttgtatacccttcatcccaaaataagctcatttataggtttctgtatccaatcgagcttaaaaaagtagctcagttgcaaccccaacaaagcaaagcttcacatacacacatacgatgcgttaattacgtttctaaaattactcccgcatgacacaaccgtgattagatttgagaaagatagtgatgtgtgtatgtgttatattatttgttcaaatctgctcgtttaaactccaaaatatgcagatctgccattaaaaccacattaggagtaatataattggtattgcaaagcttttttgggggggagggagggggtggttggatgtctggttttattaatttttcctgtttgcgttaagtatgaggattgcatgccctttacattttgagaggtctacacactccatgacatgtgctaattttgcctgacagaaagacaagcgggactacctatcttagatctatttatagcaattttacaagtgtttgtcgaagaacaagccggccaacgatctccatttgcaccatacatccatagcttagctttcttgcctcgccacccataaatacatgcccacatatgcaacatcaatcaccaaaatcatcgatccaatggcctccttgtcatccttcctgctcgccacggcaatggccgcattgttggtcatcggctcgtacgccactgagctcaccttcaaagtcggtccaggctctagcaccactagcctgaacctcatcaccaatgtcgccatctctgaggtggaggtaaaggagaagggcaccggtgactggacggggctcaaggagtcatcggctaacacctggacgctcaaaaccggggcaaaactcaagggccccttctccgtccgcttccttgtcaagaatggcggctaccgcgtcgtcgacgatgtcatccctgaagccttcaaggtcggctccgtctataagagtggcatccagctcaagtaacgtacacttgtgctcttgcattggatcgcatggaaattgttgatctctaaataattcttttttaaaaaaagagagatcgagtctgcctgtgcgcaagccaataattattttttatggtccttcccgcatattgttgtgaagctatatatgtgcacatgattttgaatacgttgtttatgtaggacttatggtaaaaaggtatattatttggtcagccttcaccgagacggttgtttacatttgatttttccaatgttttaatacatatgtatatctagatcaatgatgttcatctatcatttttacatgtaaaaaaaatcctgtaaaattcgcatttacacttgtgattattattattatttgtgaaacacaaattgttcgacataccatattatgacctgaaactataagcaacattggtggttcttttagcttattcggaagttaaaacaaactatatatttgtggatgtcatgtgttctaatgttccaatggatgatggattatacatgaactaagtttattacaataattcaaggtcacaacaaaagaatagatattcattttcctttaaaaaatatattgtagtgagtgatgaacctatcaccacctactcccaccaccacctgatatatggggtccattgaatagtgaatcatgcagacagtcgttccttctcaaacctaaacatgttcaaattgtttgtagcaacgcacgagtatatttacctagttaacactagatttgaaagattgatttaaaaggctctctaaatattgatgaagaagacttccgtataaatcgtaccatttaagaaacaccatgggatattttggccatgtacaacactccaccgtgggtagtggccacagcactctagctaagcgatgggtaaattcccttaaacctactctattcatcatgcgctaatggcctaattcgttttacgtattttcacagccttctcctctcctcttcttttatactcccttagtttcatattataagttgctctaaactttttagtagtcaaacttctataaatgttatcaaatttataggaaaattgatcagcatctataacattaaattagttccaattaaactaacatttaatatttttttagtatgttcattttatattgacaatgttactatacttttatataaactgaaccaatttttttaaaaaaatgactagcaacaaacttaaaattaaattaaaattaaagtgacttaggatatgatgagacgaaagtaacagctctttttctctaacaacgaactggcgtacgtggaaggaacacggccacgatatcgtacagacaagagaagccgcttcgagaagacagccgctgtccatgccgacgcgactccacgcgcgccccgcgtctccctccgccgcagcagcctcgtcagctcgcgagatcaacgccggcccagtcagcccagccacatcaccgcccactccaccaccccaccccgcatggcccggatctaataaccaacggacgcggctcgcgggcccaccggcccacccacgcccgcccacgggatctctcgctgactcggacgacgacatcgccttcgccgctttcacagtgtgggccccgcatgtcggcgccacggggggccacgcccgcctgcgctggatccgagtcagcctcgcgtcgctgtcacactgacgcagccgcgtgttatcttaatcagccacaactttttaatgcctaacctttaaattaagccgcgacgagcactgcacggtggtcggaggaaggcgatgatgaagaagtgcccgtcggagctgcagctggaggcgttcatccgggaggaggccggcgccggcgaccgcaagcccggcgtgttatctcccggcgacggcgcgcgtaagtccggcctgttctctcccggcgacggcgagatgtccgtgttggatcagagtacactggacggaagcggcggcggccaccagctgtggtggccggagagcgtccgtacgccgccgcgcgccgccgccgccttctcggccacggccgacgagcggacgccggcgtccatctccggtaggtacacatgacataatttgagtttttttgagttacagagctattgtgcaaacagcccattttctatgcgtttatttggagttatgaaacacacccaaatttagtcaaattcatcacatgttgggttcattttggttgcagatgaccccaaaccaaccatcctcagcgtaaccatcgcgtcctgaacagcgacgtcggtactcctgattgcgaaattcgctgttagcaagcatgagagggagtccatcgtcctgcgtggcactgataatccacagtaaacataagcgatataagataggtaccatagctggatcgtatcaactgcttgattctctacgcaatatgctaactaaatttgtatacagatgaacgtcatctcttcatgatactgtcttcgttctgacatttcatggatgagtgtctcaactagggtagtcccgtctcgtacgtatcctggtatgtatataagctaggtcacagtttatcctgtaatcttcgaattcacaggttatttattaaatctctcataatgttcaatatttaccagtatgccgtctgatcgcaatatagtcatgtgttgattctgttcaggcatatcctatcttatgagtcaggttctgagctaatctcaaagggcgatatacttcatctcctcttttaagtcagtctctacagagtccagccagcagttcaatacagcggtcacggacaacaggatcctcaaatcggatgtagaggccttaagagtcaaggtaattaggaacccaaactgctccttcagccaccaattatcggcgcatttaacttttcgccacttttaagatgaggtaattaagaattaccacccatagtctatgacaacatatgggtctttatcactttatgtgtctatgacatgtgagtccaattgcaaattgtcactcgtaagagtggtaaatagttaattgtttctgatgatcggcttccggcatctctccaaacttaccaattcttggcttcgatcccaggtcaagatggctgaagacatggtcgcgagggccgcgatgtcgtgtggcctgggccagctcgggctggcgccattgctcagctccaggaagatgtgccaagctttggatatgctcagtttaccacggaacgatgcctgtggtttcaaaggcttgaacctgggtcgacaggttcagaactcaccggttcaaagcgctgcaagcctagagagcctggacaaccggatatccagcgaggtgaccagctgctcggctgatgtgtggccttaagacacttcatccgtgttcgagagagcttgagattctaagaagcagccggtgagaatctgaaaaggctagttgttcagtttcctatttttagtttatgtttgaattctctggctactaatgctcaaaatctgggagagaatctaaatcgtttgggacagataaaaaattatgcgagaaggtgtagctgacagaaaccttcccaaacaaatctccatcagaacctatatgtaaagtaatacggtatcctctgttactaggtgcatgtgcataactgacaagctgctaagtactaggtactacagtctgaggcaagtatttctggtgttttggtgctgaagaactatgttttagtgcgtttgatctgcggcaatcaaggccatctgatcgaaatttgattggtataaatctgatcgaaatttgattggtataagtataatagtttgattttgatcacctctagtcgtcagcgcctttggtgtatacgctctgtaacatctgttacgaattgatctgttcagtatacttcaacagtcctgcattggttcagttcttggcgtagctctggtgcttctggtgcgcatagcatcggtgtgaaatgtgccacttttcatggcagttgtaatagtaaacgactgcaaaattacggtgtactataattcctaaacaaatatgtgacaattacgatgaaaattatcactaagatgttattaccattatttttcgtacacaaatctcttaatttttacaaaatttgttactagcatgtgaactctctaatcccacactatccttattctttttcaagaaaagtacggttggtggtggggatggttgacatatggatcctctggcctcacatgtcctttccctgaaagttggtgatgggatggtgacagattaaccactcaccatcaccattgtttttttctttaaggaatatagattgaatacataagatttaagatttatggggaaaagtatagttcgccaatcttcaagatggttgtgtacaactgattttccaaagttttagtatgccccgaaccaatgaaattcgttcatctttttttagcatgtcggaaatgatgtgaaaactgcacttacacttgaggttttcttgtggatacaaattgctcaacaaaccatattaagacctgaaactataacatcaatcattagtacatcttttagcttattcagcagcctggactagctgcatagtatccacaaatcacatttgccccatccgcaaagcagaatgagcggc

SEQ ID NO: 5659 - DNA, 1130 bp, Oryza sativa
tgcaactcttagtattgtgcaggtaaggaaactgctagattaatccaacctttgaattaaattttcaaacctttctaactgcatgttcattgtttgataatcttaactcctctcaattgcaggtcttttggggattggataagaagctggctcaaagaaagcatttcccatctgtcaattggctcatctcttactcaaaatactcaaaggttattcctaacttccctatgatgtcaatacaattaaaatcgccattttacactaacatactatatcctgtactgtaggctctggaatccttctatgagaagtttgatcaagatttcattgatattagaacaaaaagctcgtgaagtgttacagagagaggacgatctaaatgaaattgtccaggtattttttttcaccttgtgcaaggatgatctgttccctagatttagtcgtagaagcaatagtttgaacttggaccacttaaacatggtgtttttgttttccaaggtcctcctttttggtctttcacaatatttgttttcttcattagatttggagtttctcaaactattcaatttgtattttattgatatatagttgacccttcttgctttgtgtaatattattggggcaccatttggcctaatatcttcaccaaatttcaggcttgttggtaaagatgcactggcagaatctgataagattacattggaaacagccaagctactaagggaagattacttggcacagaatgcatttaccccgtgagtcataccctagttttttctgatttaatacagatttattggttgtctctattttaatgattaaccattttctttagtctgatcatctctatataatgaaacagatatgacaagttctgtccattctacaagtctgtttggatgatgcgcaacattattcatttcaatacattagcaaatcaggtaaatctaacgtgtttttaccactcctttcgtccttgaaccttaaattactcaagcaactttgatttgaaatttgaagtatgaacctgtgaagaatgttttctatagcattagtaagattgatcttgttttgaagttttttattgctaatgacaattttactttaaccaatgtggattgaaatattgt

SEQ ID NO: 5660 - DNA, 1180 bp, Oryza sativa
gcacggtagatgaaatgtatgtgtctctggcctccacctatcaaccagtgccataagtagggacttgtcgatattttgtcgtcgttttctatgtgcccccatttgtttttgtttaggttctctagcgtcgtaatgcatccttgcctgcgtcatctgcacgaaggtaagaagacctgcagctgacaacctatgaggaaatttattagtcacattaggcaatgttatagtacgatatcatgatgttgcaaactttaaccatttatgcacctcgcctcccatcgtcgatcaatcccccaccatccggctgtacgcggtatcaggacagctagactagagcaagaatttccatcatatatcttctttgcacgatgtcatgcatcgatctctttgctaagcaacgagtaaggccactctcttccatatctgcatgtacatcatgaagggtaaattagaaatttcatcaagtgcacatacggaaaagtacatatgcattaaattaaggaataaaattttctcatagtacaagtacaaactcgagcaatatcattgaaataaatagtacaacaataggattacaaacgttacaaacttggtaacaccttacaataaaatcttacaacattaccataataaaataaatattacacatacttattgactaacatattacaaacttattgaaatacaacgtcatgcagcgaacatatcatgaccgaacataaataaccggacagtgtaggttataactactgcaggtttccttcctccctatcgtgagcaccctgagagccccttctattccttctcgcacgttggtgcataaggtccatgggtggagatgtacccctcctggtattcttgccatcttcttatgcgcgggcccgacctgaagacagttctcacatcggcttaacgggccttccgctttcgatgcttccatatctttcttaaagcgacgtgtttgtcttctaccttaaccggccttcaacaaatccaagtctggcacatagatcctggtatcaccccaagttccgactaggtgtgggagggacctccacccgaggatctcagcactccatgcatttagaactctatcctttaggtagaacgtcgacacgtatgatgttgaatcaagcttaattttagcgcatgcggccaggacatggctacatggcttatg

SEQ ID NO: 5661 - DNA, 801 bp, Oryza sativa
cacaagataatttggaggacgaattgactcccgtatcctgcacagcaacataggtcctagggttcctgatcttcagaatgttaagcatctgtgacagagtgtcgtatgcttcctcaaatgtcccatatcttttctccatggccttttgtttcgccctccaagccttgtggtaactaattgtgtattgttcacctttctccaccagttttattatgtgccgcacaggcaggtcatcaccttcaataatttccttgtagtacttgttcgcaacgtatgccgcggtcaggttgcggtgcgactccctagtgttccgaatcagacaggagtgttcctgcagtttggacagaatccagtaagactcgtactttggcacgtgaccatgaagacggaagacgaccgtgtactcagtcttgttagacttcacaaccctgaactgcctttgcgtcttgaatgaccatgacttcactgcgtcttgcaaccccgttttgtcacggaacattgcacccagattgatttggccatccccgtagaaccatattgaatcatgacaagagttttctgcaatataaccagggtcttcaaggttccacgaagcaggcataggaacttcctcaacttcttgttcatcctcgtcatcattctcttcagcagcgaggttttcctcatcttcgattgcatgtcggtccaccctctcaatttcttcaactatagcaggtatgtcctccccttcatcggcttcaccagtaggatggcggttgaccacttcatctccttgtatggatagattttgaatgtcaggac

SEQ ID NO: 5662 - DNA, 4726 bp, Oryza sativa
  unsure (1)..(4726): unsure at all n locations
tttcataaatgatgactacaggacaagcccaaacactttcagaatcttaggtgttctgtaaccaacacaagaaatgaatccaatttgatcccatgagaattgaccttatttagtatattttaaatacttggaaaaggtaactttgcaagaagtttaccacttccaaatgtttcagaaagtaattatcagaccgatattcagttccttaatcatattttagggacattagttgaatcctattctttgttctattatatcacacgagagtgataattcgaataggcagcaaaccttgcagtacaacttgaactttttgtagtaaaggctgtctgccagaatcagtagagcatgtcttcgtgtaattgcaaaccactattaaaacaacaaacattaacacaatataaaacatgtcagtttagaatcgacatgaaaaaataaaaaaccaaaaacaaaccatatactgctaaaagaatgaactgtaatgccaggtaatcaggtatgtaacacaacaaactacctgggcacccttcctgaagtctttctcctcaatttcagggagcatctcaggagaatacctcccgtttccatgagggccaggatcacggaaactgagaaaataacaatgaagaaaaatatgatcaaaatatacatgcaacaccatttccaagtgatactagaaagaatgaatcaacatcaacttattgatcacatgtcaacagaacttgtttcacctattactcttacttttacatttatgaaatttgaatatgaatttggtgttcttagcttcttaccaatcaatgaagctgatatttgttcccatcagataattatagacataatcaaatgtatgcagtggaacacagctgtgagaaacaggaagataacttcaatatagtgaaagaaaggctcaaaaatcgttatccataatcagagtcagaacctgtcagaaagcaacacatagaactggttatcaacatctgccagtgcattggccaatagtctcttctctgcatcaaccattgaaatggttccccatactacctgcagagcaaccacgcactttggcaaaccccagccaattttattatccatttgaaaaggcttctggaaaattccccaaattttccanaggtttttcaatttgcccagaataaaaaggggaaaaattaaccggttctttttggtatttccaccacaaaataaattggttcaagtggtcttaccattacttaatcttaccttattataataacccttaagctaaaaagaatgaaagaattcttattggcgtagataaagaaccttattggcatagaacctactacagcatgatctactactgatatagaacatcctgaaaaatgaatgctaaatttatgaaaattatctttatcaaatatatgctcgttatgtgctcgtcgctatagtgctatgtcctctggtgtgtaaaacaactatttgtccatcactactaccttgctagatagccaaacaaagaagtttctgatggaaccaagatctaccacttggtcattaacacatccatcagtcatttggaatgcagagagatagacataagctttgaaaatagacatattttgcaggtcaaatccttaataaagaacataatcaaaggaaaggcattaaatacagaatttctgaagatgaaagtaattaccgcgtcactgtgaatatcacgaccaacaaacaaagaactagtatgtacaggcttttcacgtgatgcatgaacatagatggagtatcttccctcctgaccctgtttggagaagtcaaaattattaagattttttaggtttaaatgaattataaaagcaacaggcattatcacaatatatatatacttccagaggttcaggagagaagaggggggagattttttttttttgaaactgggggtagattgtagtaacttgtaaagtacacttgttagttattgcggacttgcggtataatatactagttggtttgttaactagtataaggaaatatccactagtttgacttcttgtgcagtaatggaaatcatccttagcatttctctcaatgatatataatgacccttgtaagatgctagctaagacattacctacggattttattatgttagttcagtatctatcaaatttaaaatgctgttcataatacaatagtgaagcactgctacaagtctacaactttcataaagaacagcaacatattgattaagtgccatttttcagtaatatgtatctaaaaacaatactagagcattaaccactgaaacaacttgttgtctgtatttatgctgaaaagaaactgatgttgctttgcagttaaaggaaacgacatgaccattgaatgatttatactcttaaatagcacaaatgcaacaaatatatctttaccaacctgtaaaaacttttcccataatttctcaaagggcagtgtaccaggtgtcaggaacataagagcgatctttggatttttcgacactggcatgggcattgcaaggatatccctaagaactacagatgaaatgatctcctcatcagtccgctccctgcgggttacagatgggagccaatccttgaaagttgcgcatgcaccagaaccgaagaggtagcattgcgaataccgccgtggtgggaaaacatatgccccaatcaatacaaaacaaaccagtgacacaagaatgattatccatttgggcttcttggcgacagcccggtggcgcagagatggcatgacagtcatgtccttgctgtcctactgcaacactcaagacacttctatctcctctccatatgttcagatcatctagaagttaccaccatcaaagtaatcaaactctggtaattatgatgtgaagttactacaccagggcccaatgaaatttgagggaactaacaaggtgacaccttcctgcaattgcaagtaagcacaacattaatcaaggaatcaagaaagctcctagataagggacagaattcagccgcacaatcacaaacaacattccatttggccaatgattgtttttgcacaaatcttgatgcgtctagtacgcgattcagctatgaccagctgtgatgcgagctaccagctcccatactttggagatttctaaactgctcgatgaatctagcaaaagctggcggttgcaattggttggaaacaggtgatctacgcgttgaaatcaggtgatttccacaggggcaggcagcgttgctcaagtccatggtggcggctcgcggaaaaagtcaaactacgaccaaatcatcccgatccaattcgctaacccagaacgccatttccaactcgatccaatccacagcttcgccaccacaagcaccaaccacgcccacgctaaatcacacagcctaagccacaatccttaccaaaaagaggctcacgtaaaaaatcggaaccaccaaaaaaaatcaagctaaatcacgcacggagaagaattacccaagctatccgagcaaccagaagcccaatgcgagaggactcacacagcgccgcacctcaccgcagcgcaggaggcgcagctcttggagcttagctcgctagctcgcacgcacgaatggcgcgaaaacgggcaccgggctggagctcgcgagcggccgattccggcgaggaggtggccgcggcgagctcggcggcgacccgggaggtggatctggagctcgcgggagatcggattgggatggcggaggtggaggtgggagtcgtagagagagagagagagagagagaggaggaggaggagggagatataaacaaatggattaattaagctggaagtggcactaattggttgggttaagtgctgggagggagtcgcctcttgctgccgtgatgggcttcaaaactggaggagggatttggatttaagtaatcaatttttggcgtgtgctttttttttgcacctgggtcccttgaaagtttctacctttcgaggtagtcatgggctcttcttaggtttctagatttgggattatttaagtcttgatccgtttgaattggatgctgtttatgctttgtgttatgcttaggccctgtttaagataaattattgaacagattattatcacggattatcggtttgattatagggatacattaaatattttgaaaaataaacttagcaaatagaatagaagtaagttctttttagaaaaacgtgttttccgaagtgtagagcaaattaccggttttaataatccggtgaataatttaaaaagaacagggcctaaatctatttgtttagatttttttcgaaataatgtggtaaagttgcaataatctagaaaataatccaaaagagggatacctttgattgaatatacatctacctttggtatcagagtgcatatgcatgtgtggcacaaaagtaatgcagccacccacaaaaaagcacattagcaccaccactacatctttgctggtgcctttgggatcagatcagacccctgtttggatgttggagcacaacaacaggtcaacagcaattttctcgcagaacatttcagcaaagattcagaggaattttacagagtttgaaactcggaaacggtgccaaattgtttgttgactggttaatgctgtgggttggtgactgggtgtacaaatgtacaatactactactacggttggagtactcgcaacgcaagtaccgtacctagaaatgacaggtagagagatctggattctggatctaccta

SEQ ID NO: 5663 - DNA, 1666 bp, Oryza sativa
  unsure (1)..(1666): unsure at all n locations
cgtggtgttggcctgtttgggttgggtgttccatgagccaagacagagagatccaggtcgagacaaaagctaggtaagctggcctggtccgcaacgatgaatggatggatggacttggtaattaaaaaaaaaaagaacaaatggatctcatctcatctcatgcaccggcaggattccaaatgctggcccggatgtaagccaagaaatcacattcacaggtgcaagattgggcatgttgcgtgttttgtgctttgcacatggggggaacccatctcacattccaatggaaacatacaggaagtaaggtgttgatgggagaaaaatatatgatgttcaagtagatggtcatcgtgcttattcaactatcaacatgtgcacaggtatcttacaatataaataattgtacaccaaaaagaatgccttcatcgagcaccggaggtcaaacaggaagctacaaaaagcagcagcagtgtcgatgcagaaggaaaatatgatgattctgaaacgtaattcacatctacaacctcacgcgaagcaaaataaattgccccaactcgcttcgaatatctggtgatattttattgtttacacgaatgtgatcctcaatttacagcacttcacctagcttcatcttctaggttgcggaatccggttgtgaggtcatcatacaatttctggaattttgcgactaggacatcttcaccctctgcagggtcctcaaacttttgagatctgttgcaagagtgaagtattcagcaaacaggattaccaatgaaataaacccaatcaaatggtcaccatntgaggtatggaactgaaatacttacactaggcgataaantagatcacccatacgatgctttatgacactgtatgtattttttgtccatcagcattagctgcacgctccacagcctacaagacaagacagaaacatacaattttgttaaggtatgatggattcaaaccaagcacatttcacttatgaatactataagtttctttccagcaaaagaaaatagtgcagatatcagatgagtcttacaagaaagttcatacatcacaattaactaaaggatattgctacttgctacataccttctctaaaactaggtgaataaatatcaagtatttgcttggtaacttttcttattgacataatcattatataaacttcagcccgttgcaagtctagccaaagcttttcgagtttacacttagccctagcacctagtagtttgtgcaccaattgccaaaaaaaaagaaaaaaataaagaagtcacacactttcattcaaccagaggaatttgagcaaaaatggttcccttaaacccaaatccttttaacttgcccttgctgactcagttgaggtggacatatgaacacaatgtcatggtgaacccttaggcattagcacactagcatcgaagccaaccaagggagctagtgagagtggatgcaagaatgcaacagaactggggttaagtaagcgaagccattatttttaatcaacttttaatgtgagaattctgtttggctgaggatctgtgcgattggtgccaatacccagggttagtgctttaatgttttttgtttagggctagcctcttaaagataatgagcatggctcattgatatttaagacatatatcacaacacagttcat

SEQ ID NO: 5664 - DNA, 2499 bp, Oryza sativa
acatgactgttcgtctcttataggcgtgtgaagtgtaccatttaccaaactactggaactataccagatctgtgatgttcatcagcagtagattgcgtacctgaagtcgaattgctatcttcaaaattagcatccttggttctcgaaacatttgattcagtgttgggggaacttcttctgaacaaacctcttaccttcatcctattaattgaaccaccacttcttttctcttctgacatctggagtatcttccatgtctcttcccagtagttgggtggattcaagggagattttcctctgagaggagatgaaggaagatttgcttcaagagcaaaaggttgcaataatttggctttatcaatcaagctctttaagtcagtgtctccaggaaaatttaacaatcttactaggcatgaagttgcatgttcacttcctagcaaggaagatctgagatggagcatcattgaaactgccattgacaaaatcagggcaccacgatgagaacataaaatcttaaactgatagtctgattgattctttatgtctgcacaatatgaatggttaggagatgagaagatctcatcccaaataaacagaagattgtcaagtgaaaattcacgaccgaatagaactctcagccatcgtagcgcaaagtactgaggctctactcccaactccatcaaatgactgtgaagaggggaatccacactagcaagcaagtgatatattgcagatgatgcctcccttacaggtgttaaacctgtgcttgattctggtgcaggactgagagaatagaagtcagtaatagcaaccacaccttgtgcaccattcatcgaaccatgcatcaaactctcaaacatacaataagcgtcatgctccatgaacttttcagacaaaataatacccagctccccttctgctccataagcatcattaatcaagaaaaggtccctcgtatcagaatcaagatcatccaaacttcttattttagctgcactaccctcaattgtgtttgtcctgtcactcctgttcagttttatcctatctggaaatgtttggccatcaaaatcatcactaaaaagctcatcatgaagctccctgacttgtttgaagtaatgcacatcagcatggaggacatagagaagaggagctaagagctcatgcattcctgcagaaagaaggaatgtgattgatgtcgacaaatttacaaggacagatggatctttagtgcaattagaacattagtacctagtttcaagtgttgattattgatgaagacttatattcgcctatatggaagaaattattattattacttctatagtccaaacaaacttatgttcaacgtgctatgcccatggacttcaacaatattacattaccaattgccaaacctagtaaccaattcacttggcctatttcaaagctgctgcctcggtttaggaacatcatattgcaagattgtgtctttagatggaatctgtgattgttaggtcacatgagaagtgtacacatcaatggcttaccttgtttgtaaccgagctctgggtacctaaggctccaaactaacagtatacgtccaagcatggactgacatatggttgtttggaagaaatttcccaattcagggtagagccgagacaaatcttggttcaacattttctctagttctgcatttctgaaatattggccccaagtgctttctgcattcacgagacataatgattagaaccaaataacacaatataatgaaactaaatagtgatcagtttgtgaagaaagatgccaccaaacatgcgactgacgccactttattatatcacctaggatagtgctgaatcaagaaaatgtcccactgatgagttctgctaattgtgagcaatcagttatcacttatcacctgaagttgtgatgatgtagcaacaaaacaaggtttctggcagctcaacggacttaaaacaatcacctatgcttagagtatctgaattaacatattaccacctcctcccctcatccaccctgaccttcctatgttattctagcaccaactgtataaacaaacagttaataacagaatgtttggcagtattgtttcagcaatcactgtgggactaacaaaacaccactgaccatcttatgtaacagactaaatcaacaagtatttatgcctggtgatgcaagtaatggcaactcaaagaagtaacatttactgaagggcaaaagcaaacccacctgggttctgtgatagtggattttccacagcaaggtcaggagcgttttcttcatccttagagagatggggatctattaacagccgccgccgcaaattagcatacctacaacaaatacaaattacaaaaccaggagtcaaaacctccgaacctaacaaacttgaattcttttgccccccatattaataagtagagtaattcataacagtatactaccatacaacattcaccgctcatcgaatgcccagagaaatgaaacatcaaattg

SEQ ID NO: 5665 - DNA, 6124 bp, Oryza sativa
gtggcatttgaagcactggcattttgagagagtggcaaatagtaaattcatagctaagcagctcattaccattaagcgtaatccacacactaacggggatagatgatctaagaaaccatacatcgcaaaacgaattaaagaatcgctgcatagctaagcattccaagcaaggaaagcatcgccggggtcaccaaagcattccaagaacggagctggaattccccgagggccctgacctgcggcgggagtcggcggcggctcggcggaactcctcggtggacacggaggcgcagtcggggaggacgccgagatcggcgcgccaccgggcgccgcggagcgcggagaaccgctccctcgctggacactccggcattgccgctgccttttggcttccagcctccctaacaaatcaggcaaaaggaagcatgagaaggcggccggagcaaatcatcagctgggttgggtgggtcgatccgcgagcacgaggagggccaagcgaggagaggattgggatcgaggaggacacggggggagcgttcttgggagggattgggattgggagggaagaagggaaagcgttgggagaagaaaggcggaaggcgtctcgtctctcggtgacttgtgtttgcaggtgtcgttgggttgggacgcgacgacctgtttcctcgggcaaatggctgtgtcagctgtgatgatgccttcaattcctctcaatctcaggtatgtgctatgttcaccgacatgtgtcactatagcggaatcggatcctctgacgtaatataccagcgatttccgtttcgtattggataacgagttagatagccgaacgagctcgtgtttgactcataccaataaaaccgagacatcacatttgatgaaagagcttattgtaaaagctataattgcctatagctcgttgttgctcgctgtctcaggggaacttacgcaatctaatatatgtgcaagtcttaacctattgatcaaaatccaccataaagaataaacaactgatttaataacgaaaatgtatatctaagtatttgcctctttctcgttagtaaatggtagagctttaatgtaggtggtggcgaaagtatggggaggagggcgccggcaagggacatgggtgcaagggatgggaaggagggcaccatggaggggaggggcttcctcggggatccgctccaaccacgcctacgccggagaagacggcaagcggtaacgaactgtcagcagtcatggcttctgcaagcttcacctgagacggtgagcgacaacgagctattggtggctatggcttctaaaataaactctttattcaaatgggtcgtcttaattttgctgggggccagacacgagcatggtcatccgtcttgcttgttatatcgaccgatgtggaacggatgtcgctggtgcatccgatgtccctctgacttagcgagcagctatataagaggatccagttcccactacggtcgattgatggttccactgagaatttgaagtgtagatgatttttccgtttgtcgataaaatgaaccaatttgtataaagtttataagttttcaaatggtggtggacactatgtaaaataaagtgtagttgaactataacgcttattatcgattgtttggtcctggttcctacatatattattagactcgcacgctcgttgcttctagaaatgaagttgattcctatctcactctcagtgtgttattgccaacattatcttctacttgctcgccacctgtgatgatatatttttagaacaagctatttgatgtatgagggtgaaggcctgtattagtttttgttgggtattttttattccaatattccaaattcgatgattcacgtgtaggtaacctttttttttaaaaaaatcaacactcaaataacccaatatgaaatttgctcataagaagatttcaactcgggatcttagggtgctgttcaggtcactgtaaccattaagatacataccctttcataaagttttactaccaggaagtttaaagaaagttggtagtttaaaaaaaaggagttaaaagttcatttacgtacgaaagtttttgatgtgatggaaagttaaaagttcgaagttggtggagagaaactaaacatggcctatattgatagagaactaccagcactggcaggatgagtggtatggacgtatgttgtactaccgtgtacgagggtatcctcctccgtacgtgtgtggtccggtccccgccagagggagagaggaaaggaaacgtgcgtgcaaaactgcaaaaagcccacgactccaccaaccccagcccaccccacgtcacgccgcacccgcaccgtatcctgcccaatctcgttcaccccttcacgacccgtgaccgtgacgcagccgcacggcacttcccactcccccgcgcaacgcatctcgacgacgtcgccgtgcaccggttcgcgtcccgtaacaatctttactatcaacggccccggtttcgcgtgcgcacgcacgcacgcacgcaaccgcaaaaaagcgcccgtcgtctcgcgccgcgccgcgcctcgcgggtgatgccgaccgccaagagccagagcccaccccgcgtcgcgcgcgcaaaccaaaccaaaccaaaccaaaccaaaccgcacatgacacacattcacacaaccgcacgcacgcgaggcctcctacctgccgttctttcccccctctctctttctctttctctctcgcggggcgctgcgtgtttgcgcttatcttcgccgccgcctcgccacggcctccttctcagctcgcccaatctctctctcgcccgccgcataaatatagcccttgcctctcctcccctctctcgcctcgcgagcgagcggacgaacggacgagcgagcggggagcgcggcgagccggaggcgggggggctgtgcgcctcggtgtctcttctcccctcctccccaccctcccctttctccgccctcctctcgattcccgcggttcaggtcagttctcttgcgctcttctttgtaggagatgagatgagattggtaaccaatctagttgctttgcgtggggccttacgcctcgtggttctttgtggtttctttccgtggatttctgtagattaatctctatgtcgccgtaggattgaggtatttcggggtgagggttcaaatctgtggggatatgttgggggagaaaggcgcgaggttcagtttctgcggtgcaaatcaaaatcgccagattaaagaatcttgcaccgacgattttgtgtataaaagtatgatttttcttttagggccttttgctgtgtgtgtatctggacctatcagaggattggttgcggaatattgtcacagaatcttacaaatttctcatctttttggatctatcccatgatgattcgtgggctggtgaccttcgacgaaatccgcctttgctccagtggccagcaaggttaaggtttctgggtggtgggagccctcgctaagagggaacacggggccggtgaggctgctgcagcagcgaaatgggaatgggagcattgtcccgagggcctcgctggtgtctctgtgaggcgaagagatggcggcgcatggagcgggggcagggaggtgggagcggcgggttcgctggtgaggttgttgtgaggggagatcagtagggttgtctcttgtctgatgtgcaacggttgatcttaattgaatggtccaaaattagcaagatttggagtgaaaaaaatcttacatatatggtataggcaatcaattcccaattcacctaggagtatgtgtttattagaatttgcttctgtagaagagtggtttttttatatattgggcaatgggcgcaactgcgctgcattaaagatttttgcatttctcatgacaactcctgattaagtaagataaaatttcttatattgtcatacggagtacatgtgactcttgggatgaactgttcctatcagagatattgtaacttttattggcatgtaaaaatacagtggaaaaatattttcttaagtcctattgattatttgatgttaatgctgcaattagactcaaaagtatttctttactcttgatttattctacattttgaggaattattgattgtgcagggactttgctgatcttaaatcttattcctgactgactgtcatgggcatggaacatctgctgaacaccgcgagtccttcatcaggttctagccatgctttaacttggtatgcattgtttcaatgtacaaggaaccactactgactgctcatactttggttacatcttacccaaaaggctttattgaggaaatgagggagctagagaagctgagaacagaaacaatgatgaaatcctgccaaagcactacaagcagggctggagcgataagatgtccagtaccacgcaagagtggcaggtatacttacaatccggttaactggttttaatatgattctaaatctaaatttctttgtccacaagacaattgtggtataaacaaacattgtcaaataccctcagggtgtgttcggatgcctctcttcccaacccctctccctcgttttccgcacgcacacttttcaaactactaaacagtgtgtttttttaaaaaaaagtttctatatgaaagttgcttaaaaaatcaaattaatctatttttgaaaaaaaaagcaaatactacctccatattttaatgtatgacgccattgactttttgtctaacatttgatcattcgtcttattcaagaaatttatgtaattatcatttattttattatgacttgattcgttatcaagtattctttaagcatgatataaatatttttatatttgcacaaaaattttgaataaaacgaatggtcaaacgctggtcgaaaagtcaacagcgtcatacattaaaaaacggagtacttaattaatcacgtgctaatagactgtcccgttttccgtgcgcactgcgcacattcccatcccctggtagcgaacacaccctcaatattctaatagatcacatgttatcaaattcatttcatcatagtgtctaattgtctattgctgcgttggattgcttgaatcatcttgctttggctgagtacattgccgtttgtgttctgcatgttcaatttgactctattgacacactcacttctcatctggaatttttcatattcagataagttcgggtattttgattttaactgcatagcatcggtgatttattttgctgttcaggtcatataaggagtatgatttaacacaggatctttctgatttcattatgagcaaggttagcttatctcttttctctttaccccatattttttggctgttgctcaaatgtgcttccaaattaagctagaaatgcaatctacaggcttctcctccatactttacgggatctccaccagttcgagcaagcaatccacttgtacatgatacacagttctgtgcatggaagctgcaaaacgttgatcagtcgcttagcattcctataccaacaaagggttgcaatgttcgttactgtgtgagggaaggatctattacaaaggcttgaagctacatttatgagcttcatgaccgctggcaaccagacctcagaggacatgcttggttaacattccggcttttgacattagttgtagttgtaactttgcttgcctcttcaaggccaatttgtacatatgagttatcaccctctagaagctgccgttttcaagttttgtgccgttgtcatcggcagtggtgtacatatcttttgtgttcagttttgtcgtctgtgaagttagttttggcaaataaagtctgtcaaacctatgttgctgagaaatgaggtaacctgaatgaaagagaatttgttttcctttagtttctgattaccatgttgacctgtgctggatttgttaatggatgattgaatgttttggccttctatttttgagtgctgcatttgttttgaaaagcccctatactggtgttgaggagagctacatcagtcttatatatgttctctgcaatgtttcaggttcaaccaattgatttatctccattttaaaagggttaaagggggggtcttattctaatcccaaattttgcccagtatttctaacttctgagctcgcaaattaaacatcaatca

SEQ ID NO: 5666 - DNA, 1374 bp, Oryza sativa
cctgtcgctaaaagctccttcatgttggcgtcaataagagggtacctgaaagtcaccatcaacagattcagcaggtttacatgatgaattatgagttaaactgagaaaattttagaacaatttggagtactccatacccagttcgaccatctctccaagattgcaaacagtgcctgatcctggctccacttggactctacgttccttggaccccctacagtagtttaaagaggattatacctttttccagccaaatctaactattctacatatatttagctgaaataactgtgtattttcaggataaacaataaaagtgaatttcagagtgatacttctttttcatgcattatctagggacatgagagagagagttatatctttacctaggtgaaaaatggagttcccatattttgctgatatgaaccggaagtaatctctccatatcaactcaaataaaaccctgaaaacattgtcatatcaagaaagtatttcagtttcaccattgacttctaaggaagttggaaacccttaattgcaataatctataaatatttcacactccttacaaactttatagcatatgtaataactctcatttctcaaatagtataataaacgagagctgaaaaaccagagtttagaagtgataaaactctggagaaggcataccagtatgtagaatcatttgctattctctgcttctcatatctctttacctgcaccatggccaaaaatacagcatgagacaaagctactgatctccagaggttaccatgaatttattacctcttcacaaatataacgaggcgaaagactgccagaagcaagccaaggggagaacttggtggagtagtctggacctagcatgccattcctggtctctttgtagactttcagctggtctttcttccagaagtactcatgaactcttcccagagctgcactctcccctcccacgaaatgcattcccttctctgactatagagagaagcaaacagtgacagttacaacttataggtgaagttctcaaagcttatctgccaaagtggcaaagtacagttgatcactgaaaattagctcaacacagttaactgaaatcactgaacctgcctttgtcatgcttaggcctagtgactccagtgttggtactgttccccaacctccaatttcatccaggccagaaccaggaggcggcccgagtgacggtggcaacttgctacaattccgaactgaggacttagattcaacagcctggtaaaaacattttattgacagtaactatcatgccaatctaaacaatggacaacctagatgaagaaactttatgagaatatacctttctgaactgtgtatatacgtcaggcacattgt

SEQ ID NO: 5667 - DNA, 1786 bp, Oryza sativa
tccccagatgagctgcaacttgggatttcgaggcttcttctggttagatgctcctccctgaggaatcacaacttgctccaagcctttgcgcacaaggtgttcaaccaggagttcctcgctgcaggtttccttatgagcatagacctggagatacaccacaaattactgacctggagatacaccacaaattactgccttaaacctcctcctgaattcagaattccaagtctccaaggcccaaaattcccacatcgaaatctactagaattcgtcgcgggcacgattaggcggatgaactcaccgtatgtgcagtgacagcctttgcaattgaagggaggatgtcttcaggtttcccatggcggatgagcaggtcgagaccttgtttcgtcaggttgcgcttcaaatcctccaagcactctatcaggaattgcgccctcaatgctgaaagaaacgaatcaaatcaacgcgtttccctcatgaacccaacgaacatgcagccaaaatcacaccaaaacataaaagtaatctgcacgaagcaaactgaatttcagtcagagattgacgcccaattctttcacctccagtcttggggaaaccgaagtagtgggtgctccccgcggagatccggggatcgacgcagtagacggggaggacggcatcggaggcggcccacgcgcgcaccaccgcctcgttgtcgagcacccggaggtcgttcctgaaccacacgatggcaaccccgccgccgccgctccgccgcatgctcggcgaggtgtacctcaagaacgcctcgtccgccgccgcgccggcctcgtcggcggagagggaaggcaccgccgccgccgccagcgcgccccgcgacgacgacgacgacgaggagctcatggcggagaccgggatggataggaggacgcgcagcctcgcggattgcctcgggaggaggaggaattggggattgagaggggaggaagaggagaggaagtggagcatttttgagatgggaggttggtttgcgagacgtggcgggagggagggaaaggtggagggaagagtggggaggggtgccacgtggagggatgtgagtggtgctacgtggctcgctcgtgggcctgaggaaacgggtttaaatggattttgtgggcccgtgaggggtggacccaattacccaaaggtcgatgtacagtattttggaatggataaaggatagtagagatatatttatttacgcaggaaattggaagaaatttcactaggatatttgatacatttgaaaaagacgataaaataaataaagttgagcaaataggatcaaattggtagttaaaatttcaaatagggtctaagggcaccagctgtctgctaacatgatatagtactcctttttaatgagaggatatggatatactacatctcaaaaaaggttcatttgttcaaaatttatcttacagagactatatttttagctagcatgatgaggtttatctcattaattccatacctgtcccaagccagtacccttctctcattgacttgttgaggctgtttggtagccagtctttgcggctgcagcaactgccgtgcatgtggcactgtttctaaggctgttatacctaacctattttaattagagatcctgacatttcttaatattactaatcttaataagaattgctagaagtgtactcattttcggacaaagggagtataaatatagagcttagatattcatttgagtgcgtattacagagcggagagcgcattcactgggtgtgtgtagcaagtttcccaa

SEQ ID NO: 5668 - DNA, 643 bp, Oryza sativa
tttagtctcaaggtctatgttcttaactgtgtgatggatgacaggatgaacatcattattttgtttggtaatatgtactgcctccctttgatgtaatctcgtcaaaactatatgtagtagcagtttgtgctgttatactatctccctctgttcaatggacagtatcaagtttggtttgaaattagctaattgcatcataccatcaggcggcagctacggctccactggaatttaacttcaattactaataaaatcaattcgcataatcaccacccaaagatacacgacttcaattattaatagcaggcaccatattgcctaaacacaacatgcgtattcaccaattccttactaatatctatccgccggcggcggcagcggaactgagaaaaggggtcggcgttgggctcgggcactcccagcggtggcgtcaccttgcttttagcaatttgggcgagaactcatgacagacggaaagggattgcggcgctctatatcgctattggcgatttgggtggtgccgattggaaggaccaatgaacgataatcttgtctattgacttatttttccaatcatgcccctgcttaatcaatggctagattagattggtacctcatggtacctagtacttcatggtacctc

SEQ ID NO: 5669 - DNA, 768 bp, Oryza sativa
cggccctcgcgaccatgtcttcagccatcttgacctgggatcgaagccaagaattggtaagtttggagagatgccggaagccgatcatcagaaacaattaactatttaccactcttacgagtgacaatttgcaattggactcacatgtcatagacacataaagtgataaagacccatatgttgtcatagactatgggtggtaaattcttaattacctcatcttaaaagtggcgaaaagttaaatgcgccgataattggtggctgaaggagagtttggtttctaattaccttgactcttaaggcctctacatccgatttgaggatcctgttgtccgtgaccgctgtattgaactgctggctggactctgtgagctgcttgaagagggatgagttttcgcctttgagttgctcgacctgatcatagatggattgctgtaagatcacactgatatttgcatcaacgcatctggaaatttgaactttgaagtttataatacctgtgattcgagttcagataactgtgcctgctttctcctcctggatcgtcgagcggactccctgttggacaccatcctgaaattcgaacaagcagttcataagaatgcgttctctgttcaaatttgttgcatttgctagaaatcaagattgatcgatcactatgtaccttcttattcgctttgtttctgtggatttcgtgccacgcaggcgtggactcctctctgcttctaacagcgaatcgcaatcggagtccgagtcgctttcaggcgc

SEQ ID NO: 5670 - DNA, 1946 bp, Oryza sativa
  unsure (1)..(1946): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccactgcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaacacatatccatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtagtgaactccgggggggaatcggcaaaaaacccacaatcgggtcacccataaccctcggtcaccacgctcccggcctggccagtctcgacatgtggatctccccaggcactagccccgacccgagccatttgaggactaggacctgggcacgagcccttgttcaagccaagacacaaaaggaccgcggcacagacatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccaatgcacccgggtcgccagcctcgtcgccactgtcgcccactccgccgtcatcgtcctcctcgtcggagttgagggctaacgcgagccgaggggccgaaccctcgaagctgtggacgatatggtcggcggcgtcccggacctgcgcgcgcgcaccgtcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgtgaggcgggcggttaagtcgctttcgcccgcggccgccccaccgctgcgcgccctcgcgtccagctccttctcccgcgcctcgagctcagtggcccgctggttcagcgtggccctctcggcgcgggcaccttccagattacggcgtgcctgctcctcccgcgctg

SEQ ID NO: 5671 - DNA, 6418 bp, Oryza sativa
tcggcctcctcgagagctcgctcccgctcggtgagcgcgtcctcgcggaggcggagcgcggactcctcttcggcacaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtttccgccgcccgccgttctcgggcagcggcagcgtcaaggaccccccgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcgagctccgcccgctctgcttgcagggcctccacctgggcacttaacccgtccaacaccgtggtgtttgcgacggccaaggcctgcagaaggggttctgcgctcagtggagcaacggaaggcatggggaagagctgcctcgaagaggatgccgcgtggcttggcccgccgatggacgtgccggactcgaggatgtcccccggacctggtttgtcctgagcgtcgcacgagggagtgggcccaagcgatgcgcccgcggcctcgtcgcgagttgcctcggaagtcgtcgtcgcctcggcctggcgaagtctggcctcctcccgagcggcttctttagcttggcgagctcggacggccacctgggcagcttcctcggcttctcgaaggcgatccgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcggcttctcgccggtcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaactcgcgttgagagaatgaatacggccacgatgggagtgggacgaacctgcgagggggtcggttaaacgaccaccttggaggggaaatgaggtttccccgggatggttctgtcccccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccgggcgtcggcagggcggccgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatgtagtcttcggacccggtgtactcccaggcgccccgggcgcgccgctggagcggcgcaatccggcgacgaaggtagtcgccgaacaccatggcccctgtgagcccctgggatcgcaggcccgccaagcggtcgaggacggcgtcatagccatctcccagatctaccggcgcccgccagctggaggcctgcgctggaggctggctcggaagtcggaggcgcgcttcgtcagcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcacaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgcagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagtacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccttgccaacgctgtgcccggctcctcgtttctcgcgcccacgcttccactaatcccattcgcccgtttgcggtgcatgaagtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccagagccggcgtgttagctcctggagatggcacgttggtcccggtcagatatataccaggcttcatcctaaccattacaagcaagacattgtatgaagaggggcgaacatgcagattgatgaactgacacgtggtggacaagaatgaccgatttgtgaccggtctgacactggtcatgtcgtcagcagacagacatgttcccacgtcgcgcctgcttccggcggaagtggaggtaggtatgggccgttccatcagaaggccattcggacggcaaccatacaagtctctgtctgtttatgaaaagataggataagtccccacaaaaaagagagagatggtgcatgtggtatccccttgaggtataaaaggaggaccttgcccacttagaagggggattttggatttcggagggggatccagaacgatcagagagggagagagtaagagctctctggttctctagctcttttgtagcttcttcatacatagatccaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcacggtctcccggtgaggagccccacgctccgtcagacaccgttgacttttaatttaacgtttgacaattcatcttatttaaaaaaatatgtaattatcttttattttattgtgacttgattcgtcatcaaatgtcatttaagcatgacataaatattttcatatttgcacaaaatttttgaaataaaatgaatagttaaacgttaataaaaagttaacagcgtcgtacattaaaatatgggaaatatggggtagtactaattaagcagattagcagaacactactggtacaactccagcagtttagcacgagcaagtggtgatcgagacctgaacttgatcgcaacgatcagaagcgcgtccgcgcgtgcactacaccacaccagctttgccgcatgtgcgtccctctccatgtcgtagctactacggtgccttttcacttattcttatgcttatcagctaaaatttaaatatttagccttaaatttaaaggtaattttaagaattttttcgccgaagtttgttttttcaatcatcgctaagaacctatgtatcgtatataaaagttttattcataatatttttttaaaatacgccgtttcgctatatggctccgtcagatgctaagctgcggcatcgagccggccggtcaccgggttcgtcggcggcagccgatcacggtgtcggccgccgcgacgacacgaccgtacaaactttgtcccgggagtggcgcgcggcgcccgacccggccggcggtggcgccattatagtaatcctgtgacagccgagattacttggctggttggaggcttggagctaattaagctctgtgtgtttggagaggagggttgattaattagcgcgtgtgatttggtttggatttgacaggcgcctacggtgtggttcagacttgagagtgttcagaccagatgcacagtcgtgtgttactcccttattccataatattaatattaaggtatggtcaaacttgacacggtctttaaaactaatctttattttataattcttataatatattataaggtttatagtaacaaaattataaccatatgaaaataaatttaaatgttaatccaataatatgatttttaacataagtaaaattcaagtcatattatactaaatgttagttaaaatattttgaaggttgaatcttaaaatatgtgagcgccctatattatggctatattatgagatggaggaagtatcggttatatcactgacttcaataaaacttccactaccttataaaaggagcatatgtaaaccatttgaccgaaatccgatgattgaaattgctccgtagatgaaaaatgaatggtaaaattaccctattagtatatttaagcattatttcttaatattacacaccactacacatataacaccacatacattattggtatggtactcaggtggtattcgtttctagtgaagatacagatgaagttatgacattaaaaaataaaattcattaacgtacgattaattaagttttgattattataaatttggaaaatggatttatctgatattttaaaacaacttctatataaataaagtttcgaacaaaatgtatagtttatctgtttgaaaaacatagtaccaaaaatcgaggtaaaatctatatcatcgtcggaaagaacgaggcatcattaagcagttacacattattagtagactgaaaatattatggtgtgtacgtgcgcctctgtactctaatactccatagaggacactgtcggctctgatctcgcctatcatgcatagacacattaattgttgaaccttatcatcaaatattacgtgatgattaagattgcttgctgttttgccatcgattatatttcttgacacgaggaagaactggcactacctgtcgaactaacctcaagcagccagtgtgagcacaaatcagctgcgaaacgaattgcaaagccagcaaagagatacagtagtactttatcaactaatctagagctctgttctgcttggcaagtcaaacatggccaacagtatgtgtgattaaactaatcaccctgcaaggaagatgtgatccatttgattaagtcaatggacaagattactttgagtaccttgctcaaaaggttctcccagccgttggctatggccgatgtgcttcattgaccctgaaagagaagaagcacctccacctcgtgaacagcacaaaatgtcggggatttctagggtattaatacggctagtacaatgccatttcgtatttttaaatagttaggctggcactacaaatatacagtagtactacttaacatgatcagtgcatatattaattgcagtatcagccaatgtttatgagagactcacggct

SEQ ID NO: 5672 - DNA, 646 bp, Oryza sativa
aggaatatcgtgtcatttcaatggtactgcataactaaatctacaatctctgatcgtgcagccacagtgggcgagaatccaggtgcacaatgtgtacgagtactttaccgaggcgttcgaaagccttagggaaaatgaagttcggtggactccgtacacgaacgaagaggccattttgcgtgcaccgcatggagtaagcatcttatgctatcacgatgaagcgtactggatgacatgaaaaatgttggtgtacgacatattcgtcgaggggtataatgttcaaagggtaatgcgtcagatgggactgtaccaacaagtcccagttcctgttggacttcaccttccaccagatgtgcacacgtatgttgttatttcaatcctgtctaatttctgtgcactaaaaattgtcagatataactaatagctaattgttgtatttttgttgcaggcaaaagaggcaagctgacaacaggtatcgtcgatctatgcactcaaggatgaccccatggatagaggcgtggtcacaggccttgaatgatgtcgtccaggagaccagggcatcgaccacaacacttacgaataatacatggcctggtactcatcgcagactctcatccggctgcttgcaccggaggatcccgacgag

SEQ ID NO: 5673 - DNA, 2448 bp, Oryza sativa
ccctgttacagaagtatcaatggcaggtgaaactctccaagtgttcatttgctcagcaacaacttacctatctagggcatattatcagtgctgctggggttgctactgagccaattaaaattcaggaagttgttaattgggttactccagccaatcaaaagaagttgaggggattcctgggcttagctggctactacaggaagtttgtccaaggatttggtatcatcagtaaaccattgacaaatcttctgaggaaaggggttccttacaaatggactcaggaaacagaattagccttccaacagctcaaacaagctctagtttcagcaccagtcctagcactacctggctttagcaaaccatttacagtagaaacaaatgcttcagattcagggattggtgcagttttgtcacaagacaaacatccaatagcttttgttagtaaggcacttggtcctagaacaaaaggtttgtcaacctatgaaaaggaatgtatggctatacttttagctgttgaccattggaggtcctacttacaattgggagagttcataattctcactgatcatcacagccttatgcacctatcagacaagaggctacataccccttggcagcataaagcttttactaagcttttgggactcaactatataatctgttatagaaaggggacaagcaatgctgcagcagatgcactgtcaaggaagttccaaggagatgcagaattgtctattatatccaactgcactccaagttggttactggatgtggttaaggggtatgaacaagattcccacgctaccgaattactgacagctttggctctgcaagctgactctaaaccaggttaccaactgcaatctggtgttatcaaatacaaggggaggatatggataggtaataatgctcagctacaatggaaactgttaactgaatttcatgccagcccacttggtggtcactctggtttcccagtcacatatagcagactcaagaaattatttgcctggccaggaatgaaatctcaagctaagaaatttgttcagcagtgtcaaatttgtattcaagctaagccagatagagctaaatacccaggacttctccaacccctgcttgttcctgatggatcatgggaagttatatccatggattttatagaaggtttgcccaggtctaagtcctttaactgcatcctggtaattgtggataagttctctaaatatggccatttcattcctcttgcacatccttacactgctctggaagttgcaaaactctttatgctgcatatttacaaactgcatgggcttcctttggtgattatctcggatagggacaagatttttactagtcaactctggaaccacctgtttacatcttctggtacacaattgcatttgagtacatcttatcacccatagtcagatggtcaaactgaaagggttaaccaatgtcttgaaatctatttgtgttgttttgtccatgcaaatccctccaaatgggccacttggttacatttagctgagtattggtacaacacctcttaccactcttccgtgaaggcatctccgtttgaagtcttatatggtcatgctcctcgtcactttggtatttctgtggaagcatgtgcaatcccagatctgcaggaatggctcaaggaaagaaagttgatgcaagccttagtgcagcaacatctgaatagagctaatcaacaaatgaaacacatggcagacaagaaaaggagtttcaggtcgtttgctgaaggtgattgggtatatctcaagctccaaccatatgtgcaatcttctgtagccactagagctaaccacaagctttccttcaagtattttgggcctttccaggttctgcagaagattggtatagtagcttacaaattacagcttcctgagactagtaatgttcacccagtgttccatgtgtcccagcttaaggcagcttgtggttttcaaggagacatccagtctactttgccttcagctctttctgaccttcaagtgccactccaaattcttgataccagggtgatcaataaaggtaattcagctgtatctcaggtgctaattcattggtctggtacttgatcagaagatgccccctagagatttggaggaactccgtgctcgttttcagcgactttccaaattccaaggggaggggattgtcaaggatcaggcggtacctgacgatgttccattgactaaagttggggagcaaaactctgacgaagctgaagatcgtcaagttggagctgtgcagtcaaagggaggcaatatgcgtcgtactacaaggcctgttaagcaaaacccccaagtactgtgggcctaactggaccatgtaatagaagtccatattgtaataggctagcgtgaacaaggggaaagaagagagagataggagatatatatatatatatatatatatata

SEQ ID NO: 5674 - DNA, 656 bp, Oryza sativa
aaggtgtactttagcatctccaatcagcgagatggctacactgagacgcctcttcatgccaccactgtacttcctgacttgcttatcaggagcaccaccatgaagtaaatttacacttcttaaagattcgttaacagcctgcaaatcattttcatttcagtaaataactctgaaaggcttctaaatagaaatagtaggaaagcgtcctattcagtatattatactagtaaatttagaagtactgtgtcaaaaaacacatactgaaaatatttcaagacaaatgaaaatgaaaaaaggatgatggagaaaatcagggaagactatctagattatatccattttttcagttcagagaagtattttgctccatgaaaacccatgcacttgacactttatgcttcaaacactcttccattcttaatacatggttcagtgctttcgagcatccactcatttgttcttaattcaaatcctataaggtttctttggagtataaaaatccatataataaagcacatctacgggcataagtattgaaagacagtacattgatattaagatatgctagcttcaccttaaaaattatgctatcagaagaagaaataagggacctggtatacttgatataacttacagtgtccaaatcagagccattg

SEQ ID NO: 5675 - DNA, 488 bp, Oryza sativa
cgaaccggtccttaattgtcatgagcacgactctcaaaaccatgtgctcacaacccacctttaccatattttagttggcaagtaattatttaaccaatcacgattgaccatcgtgaactatcattaagccatcattaaataatagtgagtcataagttatcccaatagtgtgctaatgtttctaagcatggctaagcaatcatatctaatatctagctgaaccaatatataaagcccaactagtcaagttataataacccagggtatcaaggaataaagtaatcaatgcaaattggccataacaaaggaataagttcacaccacccggtgacattcgaaaataaatgcacagttgaaataaatagagaatttaaatataggatcaacatgctcaaaggattgtgtttaggatctgtgtgacttgccttgcaatatatcggtccttcaattaatcttcttgaatactttcggcgctctcgcgaaccttc

SEQ ID NO: 5676 - DNA, 479 bp, Oryza sativa
ttggcaagtccactttttcgcagagttggatccctattcgaaaacatgactctgattggcttcccattgacaacggtgaagtttagattttccatggcacgggtagctgcaatcaatcaaactaaattaaagagttgataataaattaataagttgatattagcgggtgtcaaactctcgaaatacaaaatacaacgaaaacaaacaaagatgcatagtataaaactaaacaaaatagaatttcccttctattcaaattaaggtatcacaacacatagtttcataaaaaaaaaatccaatgctcacaattaacatggaaccattgtactccactatataatacatcgttgccaacagccctacactcaaaagtgatcaccccattaaaaaattaaaataaatataacagattaattaaacttacaatattatcataacaacagtaataagtatatgctactccaaacgaactaatttaa

SEQ ID NO: 5677 - DNA, 1032 bp, Oryza sativa
agtaggaactccctgagtcaaccaacatgagtatctcagtgccttgtatccatctctcaaacgaatcgacttggaggattcagtaccccacagagcctgttgggatatagccatcaaagtaccttcatcttgctctttggttccttcaggactagtatcattttcagaataagattcagactgcagagcctctaacaattcatgtacaacatgtaaatgtactgtagtggcacatttatggtccctaccccatctctcaccacaaacaaagcacaaccccttagatcttctgtaggccttgagtgaagccactctgtcctctttaggtttggttgattcagtcaccttaccaccatcagaagaactaccaggaaaaaatttatgccctggagtggcaggaatgaagctagagaatcttggaacttgtttatagacagatggtgagtcggctcttttgctaacagtgggtttgcaactatccaggatttcttcctgaagcagagcaattgaacaggcagagtccaaatcctgaggcctctgtaacatgactacccctctgttctcatccctgagtccttcaatgaacttggtaacaaagtacacaggtgtgagggcactatcataggccataagctgatgcatgatcttatcaaaattttccacatattcagcaacagtgctactctgttgagcatgaaaccactgcctgattagtgcctcctgtctgtccctagtgaatctagagcagactaattcacataaagtgacccaggtaatgtcaacaatctgagatctaatggactggagccaaaaggcaacattaccaacaaaattaagagtagccaccttaacccaatacataggatatattccatagacatcaaagtactgcttgcaattacttttccacatctgggggttagatccatcaaattctgggcagatcattggggggatacaagcactcaaatcatgattggtaccagtggatgcagaagttggtgatggcaattcagactcggtccttaccag

SEQ ID NO: 5678 - DNA, 1002 bp, Oryza sativa
acactggaactcatcaccaatgtcgccatatctgaggtggagatcaaggagaagggtggcagcgactggagggggctcaaggagtcatcggctaacacctggaaaatcaaaagtgatgcaccgctcaagggccccttatccgtccgcttccttgtcaagaacggtggctatcgcatcgtcgacgatgtaatccccgaaacctttaaggccggctccgtctacaagagtggcatccaggtccagtaatggacatgcatgtccttgcattaggtcacatggaaattattagcctctaaataattatctattcaaaagagagaccgagtctgcatgtgaacacgtcaatagttaaatttctattgttattttgtgacaacagactattgacaaaatgaagcataccatgtgcccttcccacatattggtatggagctatatgtgcacacgattttgaatatattgtttatgtaggatttatgggaaaaggtatatttggccatcattcatcgagatggttgtgtacatttgattttccatagttctaatatatatggttgtgcactaaactacaccttggatgcgcaccccaccccctctcccctcccgcaccttttctgttcccacatcttcttcccgcaccttcctaccatatatcttccagcttttgttaataaataaattactctaaactagtctttgttaagtaaataaattacttataagcaattgatcttgccataaaatctgcatttgcgtccctttcaaccttcattcagtaaataaattactcctaactagtctttagtcagtacataaataacttaaaaacatattggtcttaccacaaaattttcattggcatcccaacctttcttatcacttggcaaactatctgcattggcatcccatcatttctcatcactcggcaaaatatcttctcattatgcatcgttagtaaatattttactatcagagattaatatcattagtaattcttttact

SEQ ID NO: 5679 - DNA, 1424 bp, Oryza sativa
ttcagttagcatagatcagttcaaatccttactaaaatatagattttattttttattttttcttcaacattaaatcatataaaaaattaatcattgccgtacatgtgctatcaaatgttgtatatgcaacagtaaatattcccaaagtaaaagatgaaattggtgctactccaatttgtcaaaccccgccttggcaccagtaccgcgtacaatggtacgggagacagtgtgccatggaagacagcgaacacttcagcactaatgttaactgcaggagtttaagacatctggaaaggaaaaaagggcccaaaaaacacttcagcactgtcacgagcttcggtgagactattttgcggagttgaatgtaaagcgtagccgtggctggcggaagggcaagggcaaagttctcctcgtcatcccgacgccgtaatggcgaagagagagatagattgaataaatttcttcttattcgattacttcctcccaatccctttaaataggaaaatcttacagataacaaaactcaatcgtatcctaatctgaaagtattgattaacatcctactaacttactaacaaactctagagataaaacgaaattaaactaaaacattatccttgtttaacttgagacttatgcctactctgatacttacgcccccacatgacaagcactataattgtaacaaaaaaaaaaacctgagaacctctagatgcatgaagataatgggaaaatgacagtgaagagaatctgataaagggttgaccaaacagaatttctcagagaaaagtaaagttgtctctggaaagatcaagagccgcaaactgcggcgccttttcagctttccccccacctaaagggcacagtgacattattctcttctttagaaaaaatgatatggcattgctcacacatgtcaccttgccacagaatttgttctggtccactacaatctaatggtccattttgtaagtaacataccttctgttatttggcaagcctagctaacgctgtatatgaacactacgcagtttcttgcccaaagagtaggtcagaaaaaaattgcacattgtctcctccaaaatcacccatatgcaacttgactaaatcgaatttaaaccaatgagcatcgaatattgacgagtaagtggtagggcaatctggaatgatgagtccaggggtgaaggaatgttctctcagaaagagattaatccaaagtcaaagagggaatgggcatgaattctcgctgcctatcagccaaccacttagcgacagaaatacccaacttgtgaatattaattgataataagagaataggcatcagtaacttatattgatcgatctggatacagctcgcgtgggagggaggaacacatatcttggagtactgttgattcctccaggtttcctactaaactgaattc

SEQ ID NO: 5680 - DNA, 1314 bp, Oryza sativa
catacattaaaatacggagggagtataaaattaaattaggatcaatattccctttaccaaacatattattaacacatttaatagaaagcaaattttaatttttcagataatattaaatatatttctattatccgaagcaacacacggataactgatattagataaaactttaattgttggccaattgtacgacgtgaagcatagattaatcttctcgaagttggattcatttccattttatccatggccacacattcggtgctggagatgggatgaacatgatttgtgggcactctgccttctgagtaagctaaaatatgtaccaatgcatcatgcttatagtatctgtaggtgtcatagttgaacaatttgtggtcacaaaacaatcactattgtaaatgcgacttttgtagcatttttgtcatactgtcatactaaagaagataaacgagcttcattgatatggaaatacatatacatatgtactcaaactttagaaaaataaaatgtaagaaactatctcgatgaagtttcaccaactatactttttcccacaaatattatatacgtaatatactcaaaatcgtctggatatatacctctgcagcaacatgcagacatggcatacggaatgctttattttgttgatggcatatttcacaaaataaccatagaaaattaattattggcttccccgaatgcagacttgatctctcttttgaaataaaaaagaattatagagaggttaagaattattttaaaataaaaacacacatgtctatcacttagatgttgatgccactcttatatttagagccggccgtaaagctttcggggatgacgtcgtcaacaacacggtagccaccattcttggcaaggaagcggatggagaagggtcctttgagcggcgcctcacttttgattgtccatgtgttagttgacgactccttgagcgtcacccagtccttgctgcccttctccttgatctccaccttagagatggcgacgttggtgacgagctccagactttttccgctagaggcctcaccgaccttgaaggtgacctcatatgatatgaagcttaacttagcacctctcaaagctggcttcgcttccattctatccattaccacttattcatgttggagatattattaatgcgacttacattttgttctagcatctgaataagctaaacgatgtgctgattctttatgcttgtagtttcatgtcacggagtgatcgattcaacaatttctttccacaaatttttttttttaaaaaaaaactgtaaacaacatttttgacaagcta

SEQ ID NO: 5681 - DNA, 5620 bp, Oryza sativa
tggggattctcttacataaaataatagggtatttacgagatggtggctaactattatagcagaagctatagaatgactcaactctagtgttttactatagacgtaaaccatctatctatctatacttgagaactaagtagaatgagactaacttatataactgaactcccggcttcgataagaattccaaaatgactctgaaaaagaggggttgaagcaagggtgagtacaacgtactcagcaagttattaaattcaatatgaatgtatgaaatagtggtatttgagtagggctatgattacttgcagaaaaagtagaaagcctgtaatgattttaatgcaacagtatttaataaagtttggaattaggtttctaaccaaataccatatgagtcccaatgctcaaatccgtgagcacggctattcgaatatattcatttatattttactgcagtaaatgtacgctttacccgcaatccatgacgtgccaaacacattagctttgtcatggcaaagcttttcagttactaacattagtggtacctgttccatgaactctagttcccatgcgctctgaacgtaacgttatcagcagcgagaggagttttggcgttcccgaggtctttagagagaactgattgtatgacaccatgtcatcacaatcagggttcacaaacaagttgacgtcaataaatctcatatttacctgcgcctcggtaaatatcacaattgcccttcgcggcataaatttgcctcctgcgcgaggacttaagaagaaccactatacagaggtaccaccttttctagataacttaatcagctaggtctatgcccatacgagaattgcggtcgtactcgtatgttcttcacatgtacttggcagtcttatgtcggttggaacagtactagccacccggaaatcaaccatttctaccacactattccaatctaagttcattatattttatgcaatctaactaggcatggctaagcaaaatctagcatataactggtttgctatatgttcaggttatgcattcaaaatcatgaatggttaatgcatagaatagagatatagaatatagggtaattatgctcaaggggaggaataataacttgccttgctccaacgcaaataaatccgagatagacaacctgattatccgatcctcgaaataccacaggttgtcatccaaaatacaatagactctacttgaagaagaggaagaactaaattcaataaaagccataaaatagcaagaaagcgataaacggttaagagggatagggtttagggtatagcctatctcttttataggttattaggattattgggctagtatttcatgtgtaagttctaaaggcttggaggctagaggggattaagcaatcagggtcacttgtattttatgtgtggcttgattgctgaaaggatgggatgtatattgggtaattgaactggttcaactggtatatggctagtattagctggtggtaggtttaggtagtataatacctagggtttggttatatttaagccgactacggaatagggaagcatattggctaggctctgtataggttctaggagagtaggtggctgcgtatagtggataggcgatattggtaggtggggtatttggatgacggttgggttttaactagcaaggtgttagctagggtttagttgtttaagccgatattgaggtaggataaatatcggctagggttttgggtgtttgctagttgtcgctagagttggacagtatagcgactagatttggtatcatttctagcaggtgtcgatagacatcatatcggctagaagaatagtaggtgggtgcaggtttagtggggtggaagtgttactccgataaccgtgagtggcgacggagcggctaggattacacagagcccgagagctaactgtgcggcgtgctgtggaggtcgatggaatagtgaagctccgaccgctatacgcatcgaggcgtggggtgccaggagcagcacttcgaccttgggtttggtttatgccgggctttacaaccaacggttcgacgtcggggatagaaaaccgtgaacgtccccatggaaggcgcaaagttccaaccggcggctttttagtggctaaaagggtaattgggataaaataaaatatttgaaaagcaaatataggtttaaatcaaatatttattcaaatagtatttgaataaattaagaaaattcaaataaaatattagaatagtaaatttggtaccaaaaggtagattttgaatttagatgaatttaggtctaagtttcatcggaattggatctatggtttaggagatatgggtttctaaagattaggttttgaattaaatctagaaaagatgaaagtgcactgttcatgggcccacctgtcagcctttctttttctttttcctttccttcttcttcctcccgtcgtcttcctcctctcttccagccgagcaaacgagaggagggggaggaggggcaccagggctctggtggttgggaggcggcgacatcggtggcggaatgtgttcccgaacgacgcgcatctggggagggtggtgtccggcagggggaatgagagaggagaccggaacggcgatggccaaaagcttgccccggccggtttgggaagtaacggtggtggctaatcttggaaggggaaaggaaggggaaggttagggaatgggtttgccccatcgaggcgaagccgatggcgcgagggcttggtcggaaatagtccgacgagggagatcggccggtggccggcattggggacgagagagaaggatggagctcgaggctcggatctgggggaaaagaaggggcttcgccggctatttataggcggcgaaaggaggtggtcaatggcggttcagagaggagaaaaacaagggaagcacggcgctggtggagtggaggagaagaaaacggcgccggctcttctctgtgattggtcggcgtcggcggcgcgtccacgcggcggctctgctgcgtttgggcggcggaggaggtagaggacggcacggcgtcggcttggcgtggtcagcaaggcgacgacggcggctccgggagcagctgggcggcggcggcgcccacagtgaggaaaggaataagggagggaaattagactttcagacttgggcttaggtgaaggaacttcggcccaaattgagtagaattgattttgtgtatagatggaattatatttggagggagtttatatgtggagataaatttcgaaataaagatcttctatttatttgagtgcaatatttttagaagtggggtatggtggaattgatgcactcaaatgggagagaaattaacaatataattcctcaaaatatttttgggaatgaggcaagcaaacaaagaggaaaataaataggattttagccccaaaatatatggcatggattttagagaagtatttgaggctaataggaatttggatgtgtggaagagaaggataaaatatattttcttagcacaagagcaattattcataatatttgtaataataccattcttgtgccgagaagggatcaagccgtaggaactaaattggcggttagatcaaaaggaggaatttggatatttgagatttggaaagggaactaaggataggtttggaatcaaaggatgggtcgacaattaattccaattaaaattggaattacaaagagttggtttggagggttttcttggaccataatttatacaaatgaaaagggtttttaaactaaatttgaataagaggaaattttgtcgaaagaaggttttaatttaaaaccaaatcaagaaatacctcaatttaaccaaatatatttttaaatgaaaaacacaaaagaagttaaatatcaaagaggggttttatgcaagttagttctagaaggtccctctaatcataatttcctagatttagaaggttattaagaacataagaaccggcatgatacataattagaaaatatctaattttcagcatgttacagtaatatactcaaaatcgtctggatatatacctctgcagcaacatgcggacatggcatatggaatgctttattttgttgatggcatatttcacaaaataaccatagaaacttaatttttggcttccccgaatgcagacttgatctctcttttgaaaaaaaaaggattatagagaggttaagaattatttcaaaaaaaaaagcacacatgtctatcacttagatgttgatgccactcttatattcagagccagccgtaaagctttcggggatgacgtcatcgacgacacggtagccgccgttcttgacaaggaagcggacggagaaggggcccttgagtgccgcctcactcttgagcgaccaggtgttagtcgacgactccttgagcgccacccagtccttgccgcccttctccttgatctccacctcagagatggcgacgttggtgacgagctctagactttttccgctagagccctcaccgaccttgaaggcgacctcagtggcgcatgagccaacgaccaacaatgccgccactgccacggcgagccggaaggagtacaacgaggccattggcgagctagctagtttgttggtgttgtctttcttgtttcttgaagggtagagggatggatcgaggtgtttggtgatccatattgcagctgggtgtgtatttatggtggcagggggcaaagaaaaccaggcatggatgcacggtgcggcatagagatcgttggccggctttttcgtcgagcaactctaatacaattcctataaataggtgcaaacttggtagttccgattgtttcactggtgcaggacatgcagacctctcaaaaggtagctatgcattcccatgttttctctacttattttttaaattgcgaataataaaaatttgtgatgttccgtttatggaggatatggaccaagacacgaaaatattaggggtgaagatgctaacagaaaacagaggggtggtagagctaacggtcaggagtgatggccaggcacatagaggggcaccgtgtagcatccatagtatatgtcacagaggggccatcaacagctagatgttgatggaatcatggcggtgacagatgggtcatgtgctggcccgttgcggctctgctcgataggggacataggttagcatttatggtgagatggggttggtgctaagtaaattggtagagcacagctaggcagctagctggatatcgagcggtggcggcagttgatgcaatacatttgataggaatacaagatgacaactcgacgaggcgtatgtggggaggagcacgtggccttatgaaaataatccaacaattctaggtctcggtgtagattgtacaataaaaaagagtacactataaattcaattgatatttttttatggaaaaagtacgaatgactcccccccccgaactattgaggtcgaccgaattacaccctcgatctcgaaaccagacatttacaccctcaactattgaaacggacaaataacccccctgactcaatccggggtggttttgggtccacgtgcagtccagtcagcatttttttaaaaaaaaaaatcagtgggccaaacctgtcagttctccatccctt

SEQ ID NO: 5682 - DNA, 2236 bp, Oryza sativa
gcaggtttcacttgcactctatccattaccactcattaatatctatccattaccactcattaatacctgagatgggattaatgtgacttacaatttgttctcgcatctgagtaagctaaatgatgcatcgatgctttatgcttataattttagatcacaatatggtcgattcaacaattttttttcatgaaaaagaaaaaccaagtgtaaatttgacttttacaacatttttaacaagctaaaaatgagaaacggactacatcgaattggacatactataaaactttggaaaatcaaacaccaacaatcatctcaatgaaaactgaccaaatactccctccttcccaaattgatcatcatatatgcttatgcaccaagaccaaggataatttaaatcacatcaatcaagacatcaagcacacattctcccacaatgcatgcatcgattaaaacaccatgccaattacaccttagcatgcacatattctgccatgctgcagtaattgtattctgatgaaatctgtgtacatgcaggtatatgatgattaatttgagaaattttgaattccattatatgatgatcaatttgggagggagggagtataatttttcaatgcatcctctataaacaatatatatattcaaaatcatgcttatatatagccccacaacaatattttggaagaacacatttatgccttattttgccactggcctattaccacaaaataatcatgggaaattaattgcttgctcactcacacacggcatgatatcttctaaaacataattatttagaggttaataattcccatgcgacccaacacaagagcacgtatgtctattaattagaggttgatgccattcttgtattcagtgccagctgtaaagctttcagggatgacgttgtcgatgacatggtagctgccgttcttgacaaggaagcggacggagaaggagcccttgagcagcgcctcacttttcagcgtccaggtgttagtcgacgactccttgagccccacccagtacttgccacccttctccttgacctccacctcagagatggtgacattggtgacgagctctagactagtgtcgctagagccctcaccgaccttgaaggcaagctcagtggcgcatgagccggaaggaggacaacgaggccattagcaagatagattgtttgttggtgttgtctttcttgtttcttgaagggtagagggaaggatcgatatgtttggtgatccatgttgcagctgggtgcgtatttatggtggcagggggcaaagaaaactaggcagggacgcatggtgcagcatagagatcgttggctggctctttcgttgagcaactctaatgcaattcctataaatagatgcaaacctggtagtcccggttgtttcgctggtgcaggacaagcggacctctcaaaaagtagctacgcattcccatatcttctctacttattttttaagttatacaataaaaatgaattacctcatcatgccgtttatggaggatgtggagcaacgcatgaacaaataaggggcgaagatgctagtggaaaacaaaggggtggtagagctaacggttaggattgatggccaggcacagaggggcaacggtgtggcatgcatagtagatgtggcataggggccatcagcagctcgatgttgatggtaccttggcagcgatggaggggctcaagtgctagcccattgtggctctgtgagaagggacataggttagcgtctatggcgagatggggatggtgctaattaatatggtagagcacacctagttggatatcgagtggtggtggcagtcattgcaatacatttgacatgaatacaagatgacaactcgacaaggcataggtggggaggagcgcatggccctggggaaaataatcttgcaattccagatgttagtgtagattgtacttcaaacaagagtacactttaaattcaattgatttttaattggcgggtgcacacattgttacatccatgcagcatgagagctacatgtgagaggaggtacatgggcaagcaccggggaaggatggtggatggattttgacggggtggtgggcattagagggcatgcctccaatcgtgcaaggggaagggacatcatgtgtgcgggaaccacttaagagggcgtggaatgaggctaggcatacgatggatcaggccccataaatcaccactacatttttttggccttaaagatt

SEQ ID NO: 5683 - DNA, 1316 bp, Oryza sativa
tgttgatgaaaatttccatgtaacaagtgatgacaaagtaagtacaacaattctttgtcagtaatagcaactgaacaacatcacattaattacgcatgttaaatgctgttcatttacttcatcttggattatcatgttacatatataagtgcccttggttgccaattttaccatggactcattgatttcattgctcatataatgcatgaaatgtgaaactggaacagctagaaagactgacttgcttttttttcgccttccttttgtagaaacttatgacacagaagccatgcttatggaatggatcgaagagaccatgctatctttttgctaggaagttctaccctgaaactcttgacaacctactgaagctattcaccagctatacatctgtttgagctccatcaaattctttgtccttggcatatggtctcaaaatcccatgggcttttttttgctgtttctgtaaattgcaaaatcaatacctagactcttacacatggatctggacctagagactacaagactacacacgcagatcgtcatcgcagcaactgtgacggcttggagttcttagtcactgggaagggctgtggcgaaatttgtagcaatgacactgccctcactgtaatttattgtgctctctgtaatttttccattgatggttcttagtccattgactccattcctgttgaagaacagataattttccattttgtcataccattattatatgatccattttttatatagtcagataacaagagaagtacctcatcctatttttgccatgatgtgcatcttttgttgattttgtttgccctctttccgaaattaacaatatgttaatatgctcaaatgaaaccattttttcaagattacatggacggcgcacaccactacacaacagggtttaccttaccgccggtaaccgcgcggttaccgggcttaccgcgggggtacgtaccggcggttaccgggcttaccgcaaggagtacggtaatataaatactgcggtaacctccttaaattcaaataaatttaaaaaataatttaaaattttaataaattttgtacggttttgtacggtggtttgggaaacttgctacacacaccccgtgaatgcgctctccgctctgtaatacgcactcaaatgaattatctaagctctatatttatactccctttgtccgaaaatgagtacacttctagcaattcttattaagattagtaatattaagaaatgtcaggatctctaattaaaataggttaggtataacagccttagaaacagtgccacatgcacggcagttgct

SEQ ID NO: 5684 - DNA, 4933 bp, Oryza sativa
tgaattgcaatttgcaaaagcaactagccagccaagcccatcatgatccactgtccaaagttctcgtgacccaaagaggattcaggaactttcacagggagttgctgagcactgcatgcactaggctttacgcctttttcgcttttgatttcttatctgattgattacttagacccggagagtgaaaaattccggatcaaatgggcccaaagaagaaaaggaaagcgtagatgctaaatggcatttgcagtttggaaccaggggcgttttccatcgtcggtgacgtcttttgctttgctccgtagacgcacgcaatcatcatggcttcgtctgcaagtgatccaatcacttgaataaagtcgaggcgatttctgagccaccaacttggtgattaaattttggattatccaaaatgctcatgtaaaagatagcattgaaacgagtccaaagtccacaagattatgattatatatcgacgaaaggagaatctctaatgccacgtagaggagcagaaaaaatccgaccgtgcagactcgttttctctgagaggtcaggtggcattttttaaataatctgatgaggcgttaaggtttggtaaacttcgttttaattagagtttaaagaaaggccagttggtgattttttaagactaaacatcagtacatattcgtgagctatacgttagtgtctactacccctctgagtcacacacggttgagctgaaattgaatagactgttcttgatgaaaaataacaattttgctctagacaaattttttgtgtggacgacatgacaaagcaattaaaaaattttcatttgcaagatgatgattgcaataaattaattaatgtatgaacctcctatatttccatagtttgacagtcggcacagtgggcaacatcaggagttggtgcttcagattcctttttttaaaaataattacaaaaataattgcgtgctgcgaagttagtttttcctatctatagcactaatcaaattatgaaacctgtcacttgcgatatcattcgacgaatgtctgcttcatattggcatgcatgtgacaaaactactgcgtgctgtggttgtttaattaggcctgcatcttactcgtacttaagtactcaatcccaatattaattacctggttggttgatttgattagtcaaccctaggaggaggataaggattgattgcctctggagatctgggtctgctggtttgtcatggtctatagcacttgcaattaaatactacttcgacacagcactctgcaataaaatttcgtaaagatatgccacttgtgaattgcgtttctccatctcaaagtacaccacccattgcattaggtaagagaaaatgatattaattgcagtacaaatcaattacatgtgcatgctgtttaagtcaagatgtaccggatgatccactcggtcaaaacaacaattaccagcggattttacctatcaaaagacatatcactatcgatgccctactagtatatatgtcatcactatcgactaatagtgcaaacgaggtcgagcgtgtctacactacctttagatgtcaacatttcgtactatcgaggaaacgtccgcacttattaaaaaataaattaaaaattattacgccattaccgtgtcgaaattttactggtgccttgactcgctcacactgtcacacatattgggatcgatgacccctgaattttttgttttggagctagacgacttggaattgcaagctttgcaagtcataaaaaaaacacgaagatggaaagaaccacccatgttagtgttagtgtgacactacgagagaagagaagaagaaagacccaaaacccccggcaaaaacagccaatgccaacacaggccgcacccacatcacagagagggaaagatcctcctcagcacgtgcttcctccggtccacgcagcactgtgcacgaagtggaccagccgcgccacggcgacgacgcgagcccgcgccacgtcaaccggggccccacctgccaacgtgagatgagacgactcggacgagacgacgccgcggccgccataaatccccaatcattggaagcagttattactcgggtagatatcatgtaaaacgagctaattattagaaactttaaaagttttgttgtacactcgtaaaaacagatatgaaatacattttcattaaatttgaaatccaaactcaattttatttgagagaaaaaattgataaattttagacgtgtttactattcatatcaaatttatctttttgtttcactctgatacaaagtgaagtttgaacttgatattttgtgatgagaatatatttcacatatacatctatctataataatttttttcataaatttagaaaacttttaaatataatttccacacttttttaatacttaactcgttatcgctgtatatgtagtaactcgttattcatccatccatccagcggatagcatttttcgcatttctcttttcttcctttattttttcctccttgtcgctgccgttgccgtcgcgaggcgcgggggggcgcccaccttttctacggcgtcgttgcgtgcccggggttctcttcttagctgcgtctgcgttgccagccagcctcatctccttcctcgcttccgtccacttctccaccaccacctcttcgctcgctgactcgctctcgcgctcgcacacatcgctctcgctcgctctgctgctgccgcgccccgccgctcgcgctccgagcggggagcattgcgtggcgtggcttggatccggcggtctcgatctgatcgaggcggaggcgcgcgctgcgcggcggatggtgtgatcgggggaggcggcgatcgatgcggggaggtacggtgcggcgtggaggtggggttgggttgcgggcgctggtggtcgtcgccgtcgccgccgctgcattggtggtggcgcgcgcggacaccgccgccgctgacggtaagttggttcgtgctttgacttggtttttttttttttggttttgttcggttggtgtcgatacggggagacgactcggattcctcgctgctcgtgctgttcgtgtggtgcgtgctcgcgtgcgtgcgtggggtccgtgggtttcggtttcgtcgagatgagcagggggagcagggggattggttcgttctcgttgtgctccgccgctgcagctgcttgcaagtttgcaactgcttcgagatgagtccatggttcgtgttgttttcgctgttattttttttagccgctgcaattaactgtgcgtggtgagattgtgtcggtggcggcgcgggcgtcgtgggaatggatcatcggttctgtgaattggcccggttcgactccatcattgggattgattagtttttgtcttgagttcagcacaaatgccatttggcaaggcggttgtggcatgttctaattcggattaattgatgttctcttgcttgataaagcaatctggctgtccctttcgtctgggataacgaaaggaacttttgaggcctgtgatgatgtggtgtcgtgtgcttcatgtcttatcatcctcaatagaaatgggagaaagactgaaagagatggattgttcgcatttggattggtggaaacaggataacatgcaggagaaaacatttgtattggctatgcaagtaatagcagaatggacacctttaattgccatactgatgaacaactgaacataatgaagggggtaggatatgatcataggaagggaataatgtaagtgataggtgtatgttgttctcattgagtcattgtgatgtgcacattactcaatttagttaggtttatgctctaaaatcagggactgagcaatttcttttcgtgatgtgcacatgttattcctgcaattgttcttcatgtgtcctgcaatttaggtgattttgtggtcctcgtagaaaggtgcacactgtttttctttgtaataatgacttctttatgtttcccttaacttgtgtagtctctgctataaatggattgtacatttcactggggtcgccaaaacttcctggatggtcggggaatggcggagacccctgcagcgagctttggcagggtgttgtatgcaccggctcaagtataacctcagtgtaggttcttcattgcgttttcttttatctcatggaaatcctttgttttgttctcatattaactcaccgtttgtagtacgatgaatgctgcaaacttggggggtcagcttggtggcttagggaacttcacctccatcgtcaccatgtaagggtgttgaagttgtaaagtttttccacaaccatcgtagtgtctgtcaaaactagaagattctaggatttcttttttgtctggttgaattaactctttttttatgtcctggttaaatttctcattgaattatttatatgtttgatgtagaaatcttagtaacaataaaattggtggaactataccagaagacctaccggttacgttgcagcatatgtatgtacgattgatcttatctatagtttatcagtctttggtattattcaattgatcctgtgatctttgcactggtacagttttctttcagctaatcagctcactggaagcatcccaagttcattggcaaaacttaaaaatttggcagacatgtacattctcgcttctttccgcagaaagtttatatacaggctaatttgtgttgtaaatcacatatatcattttccttgttttcccaggtcactcaatgacaaccaactaaatgggcaactgccagatgcttttggttcactcactggacttgtaaatttgtaagataccatttctgtacgtttttatgccttggtgtttggttgttgtcttagtttgctgatggtcggtttcttgcagggatatttcttctaacaacttgactggtgtgttaccaccatctatgaaaaatctgtcatctttgactacattgt

SEQ ID NO: 5685 - DNA, 8207 bp, Oryza sativa
gcgctgtggtgggaggtgtcggcccaccgcgtctccggcgtctccggcgccggccatgccgacgcgctgcggcggctggaggcgtgcgcgcacgtgccggcgaggctgctcacggcggtggcgtcgtcgatggcccgcgcgcgcgcaaggcggcgcgccgccgcggacaacgaggagggctgggacgagtgctcgtgttctgaagcgcccaacgccttgggtggcccacatgtcagtgacacagctcgtcagaaatgatacttatgcagaggctttgtttgatctctttttcttttcccattacaaagagtgttaagtagaactaaatctcgtgactagcctctcaagaatattggtgtagtagattttctttcctttttgtttgaaaaaaaagaggtggctaccaatgctgtaacttcacatatgtgattagatgatagtgctatagggaaccatacattggtctaattaattattggtgatttgattagacttgtgaacaaatttgtggctcacatcattcacatgctgtttggtcgtgtgggggaaaatatctggagttgtggatcatagcacatgcacacagaataacagaaagtcataaactgtttgcaaagtttaatgttgtggagtcagagatcagcatgcagccttagtggcttatgtcatcatgcagaagttagcaatggatgactttaatttgagattaattcagaagcttacagtttgcactaccttgtgtaatttgagatttgacatttttatatttgcctcctgtattggatatcagagcatgatggattgatatagggtttatgacttggaagttaaaagaggagtttgcccacacttccagctcctagaaatctttttcacataaaggaatacacaatacacgaatatgtactgattaagcaatgactaaacatgaattggatctccagcagtatttacttattagtagttgaaatgtactgtactaggagtatgtgttttctgggtgaatgtgctgatcttgaagacttgatgaagacttgatcaagttcagactatcactttcagagtttccgtaccaccgaagcaccggctttctcgttcattgcgtcagtaagatggaagaagaggctgctcatcgtcctcgctgagtacaaatatgcaacctcaaaccaatttccaaccctaaactaaactagaacatatcttgaattctcgatcattcacacgtatacatctgattcaagtatcctccaagataagtggattgtcctactgcttaatgcttctcagagaaacaggtttgctgcagagatattattagttgttacctgcacaagtgtataaatcattcttgagtcttgacaagcactataatactcccttcgttttatattatcgatcgatttgcctttttaaagataaacttctcaaaagtttaatcaagtttataaaaaaagaaaaatacaagaaataccattgacaaacatcaaattcaataaataccatcaatgagtgcaactttcataaaaccatcatacaaacaattttatcccagaaataccatcgtcgataggattatgtccattccacgtcgttaaaatgcacacggttcatcctatagcactttaacgaaggactgctaacgaaaacctaacagtggtgacatttctaagacaaagtcgcttgtacaatggtatttcatggaactcgtactcatcgattgcatttcttagaattgtgtgcttgtcaatgacatgtttaagattctcttatagaaaaatataccaacattaatagcgcaaaattagttttcttaaatctagcattaaatgtatttttgatagtatatttattttatgttaaaaatattactatattttgtatgaacttaatcaaactaaagaagtttaacatagaaaaatcaacgctacttataatatagtagtataaattaccacgtaatttcgttctggcccaactttataggtcgcacgtacgccataatcgtgtttccggcccaaatagtatgggttgtgcagacaccgcaatccagttttggcccactccaatatacacggccaccgcatgggacggacagcttcgttgtcaatgatcgcagaaatcctaattcgcgcgtacgcgctacttctccaagtcgcgagcgtgccacatggccggtcctcctacgaccgagcctgcgcgcttcttttttctttttttccctttttttcaagtaggcgcaactactgtgtttctttcttcttctttttttttttgccgttaactaccacacgcgtctaagagtaggagtcaatatttgaaaacgttcaggtcaagatttaaaaacttttaactcagattcgaaaactttcaagtcaagatttaaaaactttcaactcagatttgaaaactttcaactcggacttgaaaactttcaactaaagatttgatactctcaattcaaatttaaaaatttcaagtcaagatttgaaaacttaactcaagtttgaaaacttttagctcaaatttaaaatctttcacctcaaaattcaaaatatttgataaaatttgaaaacattcatcttaaaattcaaaacattcaacttaaattttagaaacatttcaactcaaattcaaagctctgatattgaaggtgaaagattgaatttataaaatattaaaaaaaatcatgcgcgcgtgtggaaaagaaagaagcgattaaaaaatctggaaaaaaaagcgatctaaaaaaggaaaaaaaattacgttaaaataggagatctaaaaaaaaaagaaacgcgtaggacgcggctggcgcccgcgccggcagcatcccccaatgatcggctgggccgggaataacaataggcttgatgtacctggaatttagcaaatgactacctgcttcgtcaggactatttggaaatgagccctttcctggattatttgcaaaaagaccctactctgggttgttacgggcttattcactttgtggccaaaatcatcccaaccaaaatttctttatgaatcttgttggttttggatgaatttagtttgatttctttacaaaattcgatagtgtttttatgcgagaaaattttcaaaactaccaaattttgataagatgataccaaatttaatcaaattaaaagcagtagtaataaattgaactctggttcgatagtgttcgatttattactggaactgggaagctctccgcgtccggttcactcgccggacgccggcggcgcatcatctcggcacaagcaacggcgatcgccgccgccgccggaggaggacatgatcagtgcgcgcgcgcgcgcgtgctcgcttgtgctgaatcgaatgcttcgatcatctgagtaggcacccatggcgcggtgcgccgatggatccctctcatttttagcaaccgccgaagtagccgggcagcttccaccaccaccaccaccaccaccaacgcgcgagcctcgcctcccctcgtctcgctcttcctcttcgtctcccagctaaaattggcacaccgttcgatccaccccccccccccccccccttgcgcgaggctgcgggcgcggcggcggcggcgggcgacggcgagggcagcatatggggcccggaacctggcgcaaggcctacggcgcgctcaaggactccaccaaggtcggcctcgccaacttcaacagcgagtacaaggtcagccccctttccctccccaaatcctatcccctccatcgatccgccacaacactgctgcgtaatgtgcatttcagatttgtttggttggttgttaccctgatcgatctgatacctacattgttttcttgatggaattttggcaggatttggatatcgccattgtgaaggcaaccaaccacgtagagtgcccgcccaaggagcgatacctcaggagtgagtggtttctgtcttgggggtgggatgcaagcaaattccccatatggccatatccaattctggttcaccaaatgttgctaggttttattttatttatttatttatttatttattgctggatgcagagatactctttgcgacctcggcgaatcgaccgcgatccgatgttggttactcaatatgtacattggctaggagattatccaagaccaagaactggattgtgggtttatgctgatggtccctgattttttaagcatattccatttggttctgttcattcttttgttttccaatgaatagctactgagaattgctcctgtttggaattttcaaaataagggtgagaaaaaaaaattcagatgttaacagctatttatcttgtttttgtaggtcgcattaaaaacattgatagtgatacatagattgctcagagaaggtgatgggacatttaaagaagacttcttgaactattcttatagaggaactattttgcagattccacaattcaaggatgattcgagccctttaggtttgtgatttttttttctctgaactataagagatctctctatcctagtttcacatctgaactgatgctctccaccctacttaagtcagcttgggatgctctgttgggtgcgcacatatgcgtcctatctagatgaacgggtcgagtgctttagaattctaaaatatgatgttgaagcggatcgcctggtgaaattaccccaagcttctggcaaggtgacatcagatttctaagttggatacagatagtcgaacagcgttaacagaattctgactggctgatttcatggttgtaatgttgaaatcttgataaattaattccaggcacacagcagaacaagaactctaccatgtggagatcttttagatcacttgcctgcattgcagagactactactcaggctcatttcttgtcaggtttaattttatcaagctcacatgcacttaccctgttctccaatattattatctcgtcaagtccatcatttttgttgttgcagcctgaaggtgcagcctgcacaaattatcttgtacaatatgcattggcccttgtaagtttcaaactttgccataaagatatccccttttcattacaattttaattcacagcaagtgcgtgattcctactactattgtggaggttttttttattggccttaggttttgaaggagagcttcaaaatatactgttcgatcaatgatggcatcatcaatcttgttgatatggtacactgacagttcttcttgatatcctcccaagtgttttgcatatgtggagcaacaatttgtgaacataagcttggtttctgatctcatgtagtatttcgatatgcaaaaatatgatgctatcaaggcacttgaaatttataaacgagctggctatcaggtacataaagctctcatttgtgatattctgtagcgaggagtagcatatagctacgtcaacttactattttttttaactctatggtatgatttttcctgttcaacaggcagaaaagctttctgctttttatgagcactgcaaacgtcttgaattggcaaggactttccagtttcctactttgaggcaggtacattcattcagtgattcatccctgttttaaattgaagaatccttcccaatcttgacttcagtaggttcattacttctacataaaacgaaatagttttatcggacgcggaaagaagcacgaatatcctgatataccaaacattcctaattagtacccgttgtcaaaatcacatttacgtgataatggcctacggttttctttacttttttcttggctatttgcctattcctatgtataaatattacacttcagttatttcctatctgctaaatctccagttacaatgatttcatggtgttttgatggattacccatatgcagcctcccccttcattccttataacaatggaagagtacatcagagaagcaccccgtgtcagcatagcaagtaaaagtttggtgagtgcgttaacggttggtacaactacaaagagaaggtcatagcagaaagaagattccacagcagttctgttgatttgtttctgctgctgaaacaggaaagcgaggagcagaattcacctagtgataacgaagatgaagctccacaggaaacagagaaaccagtggatgaggaggaacaagaaccttcagagcctgaagaagagccacagcctacagctgagtccgtggaaggaacagagccggtaccactagcaactactggggatctgttagtaagttccatctcctccaactcagtgcctatttcatcgcatcctccacgctgatttctatgttgcgtgcagaatttcgacgaagaagtaaaccccctgattgcaaatattgaagaaagtaatgcactggctctgcaattgtggcaccaggtatatactagatgcaatctctggttcagatatactactttcactcatatttgtcatataggataattggctaagtagctgataaggacaacacctcagcattgaatgcattttatcatcgtcgatcctattttcatgtgcggatactgttttttagtttctaaagattgtatctgctactaaatattgtactatggatggttcagggaatgaaaacaaggcctcagcttcacaagatttgtttgcgctggacaagtctgggtgggaattggcactggttaccgcaccaagtacccacacaagtcgaccagttgacaatcagttggtaattatcttctttctagttgctgtattttttaccactctatacaggatttcagaaagctcaatactagcaagaaggataatcataatttgcagctgataccaagttactactaaaatcagtcaatagctaataacttatctgcatttgcccaacaggctggaggatttgacaagctactgctagacagcctgtatgaagatgaagcaaggaggcagcaaatagccagtgcaacctacaacggcagcgttgcaggaaacccatttgatcccaacgatccatttgcaatgtctaataacttcgcgccaccgtcgaatgttcagttagccatgatgcaacagcagcatcaggattatcaggagcagcagcagcagtattatcagattcagcaacagcagcaaatggtgacgttgccgccgcaaacataccatcagcagcagcagacacagtattctgctcttccttctcatgatggattatccaatccatttggtgatccattcggtggccttgttgcgatggctaatcctccaaagcaaaacaattcaaatttagtctgaattcgcacattcttttctgtatcaccctccgatttttgatcgtatctccttttccaattttgaggagcaacttgtatagtccgacgattttcaatactgcatcctgacgatgcaatgtaatactcacatttggaaactgatatgatcattcaaatgtcgatgtaccaaaatcacatgttatgctccactcttcatttcaccaaccaactcagataataccaagaaaagggtggtaattattaatctctttatagtttgtttgatgagtcttacatattataaccagatgagctacatggattcctgcgtttttattccctcacagtagctcatgaatttctggattctacatttgtacaacagcagaaaacaaatactagcacatgaaacaggcaaagcttgaattcgtcttcggctgatttggcttccactaatgcatcttcagctggaatttcgctcattcatcttcagctggaatgacatccgagcgctccacttcatccggaaagtgtcctgcatgatcattaaataagctaaaaatgagcaacggtgcaaaattaagtgcaagaacagtagggtagatactaaataggcaagccaaattagactggaattgcagaagagataaggaaaacaatgaaatacacaaatttgttctgctcagttcttgtgcgtgtttgttgaagcatttcatgattaggaattgcaggatggataaggaaaacaatgagtagtcacaaatttgttccgaattcgagcagttcttgtgcgagtttgttcaagcgtttcatgattaggaattgccgaagggataaggaaacaatgaatgaatagacaatagtcacaaatttgctctgaattcgagtagttcttgcgcgagtttgttgaaaaatttcatgattaggcagcatgagcaatatgggggaaatcgagatccctgaatggttagattctgaagaactcttaccatcgatgaagtagg

SEQ ID NO: 5686 - DNA, 2813 bp, Oryza sativa
agagctcgcaaaccggtggcgcttgccgcggacgcgtggtggtgtcgcgaaggtttgagagaaggagagtgggagggagccgatggtaaatatagcagtaatcgtagggcttttccgcaaattacacggtatccggttcggatttcggaaaactgcaggctgcctccgccggttttgccccaagtcggcttagggacctatccgtaaataaaattattgcaaggggttattcgaaaattacccgccgcctttacccttgtcgtgtacgcgactcaactccctctttcgttggagaggcggcggcgcgaaaaatccgaagctttcgcgggaggagctagggtttgtgtgtgtggttgggcgcgcggcgagcggcgggagatgtcggcgtacgacgaggtggagatcgaggacatggagtggaacgcggagctcggggcgtacacgtacccgtgcccctgcggcgacctgttccagatcacgctcgccgacctccgcctcggggaggagatcgcgcggtgcccctcctgctccctcttcctcaccgtcgtctacaacgaggaggacttcgccgacgccaaggagcccccgcacaagccggccccgcgccccgtcgccgtcgcctgaggcggtgagtttttttttttttggcgcaattggaatccgtttccggtgaagcgtgctcgtttgttaggttataagtttgaatcgttgctgtgtaatttggagtattaattaatcgatctcctgtatacctgattatggattcaataaatagttctgaaattttagcttttggatgacttctgaattctgttgtatgttttattttggacgaagtggggaaaaaattgcagccttggtacaagcatgcgattcgtatacctgattatggggaaaaaattgcagccttggtacaagcatgcgattcgtatacctgattatggattcaataaatagttctgaatttttagcttttggatgccttgtgaactctgttgtatgttttattttggacaaagtgggaaaaaatatgcagccttggtacaagcatgcgattcagcggtttgcaaagttaggaattgatgtatagtatagtagacctatgtaattttgagagtgtggttggctgataatattgataggtaaaatggaggagtaggatattgatgctcaggattgagtacaacctgaaaccacagatgtttgtattttgaattcctcatatatgatggcgcctgggcttgattgctttgattgtaacaggtgtgagattgtcctaacttcattgtttgtactaagacatatttaggtggtcaattaggtgcaatttgattacctactatgttttggcatgagcctacctcaaagaaatttggcagcctcttcttatggcattggtccagaaagtaaatagagtaacggttgtgcaacttgaataagtgaatgatggtgattggtgagcttcaggaatttttgtcagtcgattggttaatgtgacgctttgggggtgtttacttggttcggttgtttactaattggagaaatttgttaattgatgtggcaatgtggcatgataggttctctctttattttcgcgagtgataggtctcctgttggattatttgttgatggaaaaattaggttttgtttgtgccagtggacatgctttccaaaagagtcatttacaattagagtaactgatgatgtagattggcaactcagtttttctatggtgaggaagcttgttgaagtttaggttatagtgacttcataggtgtttattcatcattttaactgggaggatgagcttgtcttaggtgtgcaagtttttttcttgtcttgccaagagtattggtaaggctacaaggggagcctatggttctttgtactttgatctgtattgttaacttcttagaaaatctttactcgatttggttaacaccaaatttcagtattcacactgtataatattctatacattttttggtaacctttgctgcattagtagtattttcgtgccaatttgcaagcactacttaagtttcagaatgcttgtttcttcttgctgtcatttgggtattgttgactgacatcattcattgcttgcagcaggatggaatcaggcttaactaagatgagaaaacaaacgggagcatttgtacttctaagatgagaaagtagttatatcgacctttggcttttgaattcactatgtacggagttaccaaaaaaaaaaaaccacaacgtgttgacggggcattatgaataactattgcttggagattttgctgttgcatatttttttacacgatcttgcgcttacagatttacaatctcggtcacggttccatgatctgtgtggctctgtgccatgtaaaaaatcttgatgaaggtttcttcaggggaaaaaaaatggggatgatgaagcttatgcagtgcaagtatgctgacacggtataactcttctattgatgttgaatgcatagatctttacattgctgctcgatcaagatcaaaattctaaccggataaaaggagcataatattgtaaacaaagttcaacacatgagaggacaccaatcatgtgtgtttcctcattatcaaaacatacagatgaatggctccatctctttcgtttatgcttatgcttatcagataacatttgaattttcaaccttaaatttaaagctgattttgagtttttttcatcgaagtttatttttcagcctttgcttttaggtcactaataacacgtatataaaagttttatttacaaattacttctcgtttgcaaatatgctgccaaacaatgg

SEQ ID NO: 5687 - DNA, 1521 bp, Oryza sativa
cagctagcgcactgataccttatagaatgttatgatgtgcgggaatgaaattttacgtgctatgtatttgtgtactttgtatataaatgtgagtaaaaagttttactcacaacatgtggtttagcccaagcggtttttatattatgcgactttagatgatagtttgtttgaataaatttaggcagttgaaaaagagcaaaaccttgaagttctgtaatcttgtttgataaaactgcttttagaccttgtgagatgcttttctttttcatttatgttgccactaaaccatgatattgttccatcctgaaaacataaaacaattggagaagaattgacaaccacacatatatggagaaagccgaaagacgagtctttattacaagaaacataaaaagcaaaaggctaggaacacacaccaccgttgggacgacgaccggccaggcttaaacccaccaccactcaaattaagacgcaaaatatagttaagctggtcaccattatttataactcctcaataatacaaaagattaatgatttctcgaacttaatcgaaattttccattatttgtaacacgcttaattctctgcaaaatcttagtttaaaatcatccctacatatataacctgtgaatctggcatattaatatagccaaggtcgtcgagtcgtgctcgatctgtggacacgagcattctgatcaaaagaagaggaccaaaatttcctgagtgaaattaaaaggtataaatcaaacccctgtccgccgtgacgacgagctgtcagccttggatgcactgctcagatgatgacctatcgattcgtctacgtaagggcaccaaatttcatgttataaatcgttttatcttttttcttaatcaaacttgtttaatattgatgcagtttaagaaaaacataatatatatattttttaaacacaaaacatattcaatgttagatttaattaagctaatttattgttttaaatgtttttatttttttctataaataacttagtcaaactcaacaaagtttgattagaaagagttaaaatgagttatactccctccgtttcacaatgtaaatcattttagcatttctcatattcatattcatattaatgttaatgaattttgacatatatatctatctagattcattaacatcaatataaatgtgggaaatgataagatgacttatattgtgaaacggaggaagtaatatggaacgaacggagtatattcaagtcctgtgtatcgatcattcatgtatatgatcagtcggaatctcaggttgtacatgtatgtagtggtagacacctttgatagctatccattttcacagtagtttcgtgtgatctccacagcctccacagtacatgagagatcgaatgaagagggaggctctactacatatggtcacctgcggtccatctgtcccaggtcaccaccagtacatatggtcactatatatatatatatatatatatatatatatatatatatatatatatatatatatatatatat

SEQ ID NO: 5688 - DNA, 4840 bp, Oryza sativa
ggcctcggctcggtcggaccgccatcggctcggtctgaccgactacggctccgtcggctctgtatcggccatcccgagcagcatcatctcggcctccaggaggccggtctgaccgggaaagtgccaccggtcagacctcactatgtagccggtctgaccggccagggcacgccggtcagaccgccactatgtggccggtctgaccacccctggtcaggccgaacctagtgaatttgtgtaatgaaaaagagagcacaaatgaaaatgcaatgacctaatgtggcaattaaaatcatctcttgctaggtcattacccctcttaatagtacggcgaaactaaaattaaactagcaaatttgatcgccctacacctcgatcaattctaaattaaagcgctagttttaccgtcttctttccctttgctttgcgccgtcaattttaatccatcgataatcatccatgcgcgcatatgacgtggacctaacttaaaatgtatagctcaaagacaacggttagtccacaattagtgcttgtcattaattaccaaaattaacaccgggggcctagatgcttcacattctagcactaaagtgagagagagaaagagagagggagtggtcccaaagcactttttggcataatttgctactatgtactagcaaatgccaaatgccaaattgccaagttttgctactagtgtttagatccaaaatggcaaaaagtgcttcaaaatgacacaatatagagtaatagcccatacccataccaaatatagcccaatcctccttaacctattaaatatgaggtgactaacctcactactactagacccaacccacaaaacataaaacacgctattctcccccttttggcatcaagcaccaaaaaggtcttcactcttgtggaggagaaggaggacgcgccgaagtggaaggatgagaagcatcacggcggcgatgatagacaaaagcttgggtactctccaaggtttggacgcgagaatccaatacacccaccctagtatgcaatcttcccaccgaagtattcaagttgccaacatcggtgcgcaagccacgaacatcctcacgcaatgcttcatgcccggtggataagcgttgaatgctttcactgagggtattaatagccccaaggaccgggttaaagaagtcatttggttgcattccaaagtaggcatattgtggatggaataaagtacttggatcatacccttgaggaggaggggggctgcactttagcttgcaccttgatcaaaagttggttggcgcacacgaggagctctaggggaggagagttggagacgaggcttgtactccttatgttcttttaaattttgaccaatttgtcccaacttgctttgaatcaacctcattatgtagggagcataatagattccttgtccaatagtcccctttgagatggcaatctccttcatcataaggttgataacatcaaaccgacgaccatccataatggcatcaataacatgccaagcaactccgcgtatgtcatcattgttgccgtatcttgggaggatggtggcccttactatgcggttgatcacacttgggagagcccttaaacccgccacctttccatatgtgtgccttcccccttcttcataaaactgagaaaagtgatcaatgggaaagagattgtgggtgtgctcatcatgaaggtcatccccgttgttgaagcgaatgtgcaagagctccttgaattcacggcggttgatagagcatcggagggtccccgacatccacttcattgcatcacaatcgccggacacccatacggtggcatagaattgccggatgagatcttcatcaaaaggttgcttcatggtgacaattctatcaatcccaatggtccggaacatctcttgcaaattctcaaactccggtgtctcaccaatgtgcctccaagagatccatttgtgttcggcgaaggctttgttggcatacacttgtacatacacggacttttggaaccgtgtatgaaatcttggatcattacaatcgttaggcctccggaattgatcatgatgacggaggatagtgtattgttgagcattcctcaaattaagcacaaattggatcgaggaatcgagaggactcccatcatcacttgcctcatcatcttcaccatttgcactctcattgtcatcaccatcatcacttacttccatctcatcaccctcaacattttccatattgtcctcatcactttgaacatactcatctccgcttgattcctcattctcactaacgggatcgggcgtgggagcacgacgaccatgccgagtgcggggaggcatagctgaaaaacaaggagcaaaggatggatgagcaacaattttagaaaccacatagtgaagtgggaggaagggcgagtgctgcctgtcaggggcggtcagaccgagagccacggccggtcagaccaacggctcaaggccggtcagaccgccggccctcggccggtcagaccgcgtccggtcagaccgccactgacacgagcacacccaaatccttccacaatccacacaaatgattctaaaaattgctagaacagtgttgcacaagattggaactagaacatcaaggtgtaggtctattgaagcaatgggaaaactacccttaaccctaaagattgaaatagaccgatttgagagcaatgcacaagagggagagggatttaccggttgaaggagttgaatcacaccaagaaactaccctctattggtgcaaatcgatgaacacctcttccttcacctagggttccatgccatggatcacaaactcaataagaactcaaatcaatccatggaatagagagaggaagaggaggagatttacttatggtgtaaccggagtgattttgacagttgaaccggatggatttggtggagggaggtggctagggtttgggagaggagagaggaggagtttttttgagttggagaagagaagagatgagatgggatgaggaggggtcgggtagaaggaggaggaggaagaaaggacaaagtcctgggcccaccatccctggccggtcagaccggctatacgtggccggtcagaccgccaggatgcagccggtcagaccggttcctagaggccggtcagaccgccaccaccaggccggtcagaccgcgcatatagcgccggtcagaccgcctggccccccagccgactgtgcatagcccttgcacagttcggctacccccatacaataaaattcaacaaaaatttgaattttggagcaattttgaaatgtgtgagttgaaatattgccaaccattcataatatttgaaatttatgaagatttgcaacaaaacttacttgagtgctaggaggtgaccatttatggtctataggggtttttgggcgaatttgattttcaaacaacttttgaaatatttggattttgaatatgatttgaataccaaaaacatttcaaatcctcctctctaccaactttgttttgaaacttttctcagattccttctcaaactcattttggggtttaatctcattttggccaaaaacaagaatctagattcttcaaaagagagccaaaatagcatttttcattcaaaaatcatttttctagcaatgtgaggcttggaaaacatatagggacccttttgaaacattttccaagagatagttttcaaatttcattgattttgcaaaacttttgacttatgttgacttgggcattttgaaaacactactagcacttttagttgatttgctcacatataaaaggaagtagagcacatgcaagagtccaaaactcccccttaatgtgacatgctccattttcgcaatgaagaaccaaatggcaataagtccaaagcataagagcaaataggagcaaatatacaatatgcaaaagaagcaaccatggtgcaccatctcatgccacattagagaagtctatgacatttaactcattcctcaacttgcaaaagcgggtttcatcaagaggcttggtaaaaatatcggctagttgatcctcggttcttatgtggctaatgactatgtcacacttggtaacatggtctcttaggaagtgatggcgaatgtcaatatgcttggttctagaatgttggaccgggttattggctatttttatggcactatcattgtcacataggagtggggttttggtgaaggatataccatagtccaacaaggtttgtttcatccaaagcaattgggcacaacaactacccgccgaaacatattccgcctcggcggtagagatggctacggagttttgtttcttgaatgaccatgacacaagggatctaccaagcatttggcaactaccggatgtgctctttctatccactttgcaaccggcataatccgaatcggaatagccaacaagcttaaatttagcaccttttgggtaccacaagccaatagtagaggaatgctttaaatatcttagaatcattttcacggccactaagtgacactccttaggagcggcttgaaaccgtgcacacatgcaaacactaaacatgatatccggcctagatgcggtaaggtaaagcaagctaccaatcatggaacgataaagctttaaatctaccggtttacctccctcatcaaggtcaagatgtccgttggttgccataggtgtcttgatgggcttcgcatcctccaagccaaacctcttgagtagatccttgatgtacttggtttggctcacgaacgtcccatccttgagttgcttgatttgaagtccaaggaagaagctcaactctccaatcatggacatctcaaattccctagacatcatatcacc

SEQ ID NO: 5689 - DNA, 7123 bp, Oryza sativa
caaacgagtaatgttcacaaatcgaagcgacacgagatcgagtttgaacacccttactaatgtcacccaacacttggtcaattgggtgatccttggaaagagcggtgtgtattcttggaggcataggtggatcttgtgccttctcctcctccacttcaacttgagcttgacttgacgaggcggaagtagatggctcttcttgagtggaggtggatggcttgtcttccacttcaataggcttgacatctccaatagacatgttcttcatagctctcatcaagccttcatcacctacatcatccaaattctcgtgcccctcttgggagccattagtctcatcaaattgaacatcggcggtttcttccacaatacctttgttcttgttgtagacccggtatgccttgctatttgaggcataacctagaagaaacccttcatcacaccgactttcaaattggttagtctaacaccctttcggtaaatataacactgcaaccaaaaactcgaaaatggcgacatttggcttcctgccagcaattagctcataggaagtctttttcaagagacgatgcaaataaagcctattggttgcatggcaagcggtgtttatggcttccggccaaaaggaatcggaaacaccatattcatctagcatatgtccttacgcatctcaagtgcaaagtggtcagcggcaatatattatcgctttgtccactacaccattttgttgaggtgagtaggtagcggaaagttgcgtgtttgataccaagatcatcacaatagtcctcgatattggtattcttaaattcggaaccattgtcacttctaattttcacaagagtgcaactaaattcattttgggccctttttgcaaactttttgaaaatctcggcaacaatagacttatcatgcaaaaagaacacccaagtatagcgagaataatcatcaacaatcacaagacaatgactattacgaccaatgctcttataggttgttgggccaaacaaatccatatgcaagagctccaatggtctagatgtggacatgatactcttagtaggatgagaacatgcaacttgcttgccggcttgacaagcactacaaagcttatctttctcaaacttcacatctttcaagcccacaactagatcacgttttgaaagtttgctcaattgattcatgccaacatgagctagcctcctatagcaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgtgggaagaaggcacatgacaagctaagatcacaaatttgagcaaccgaaagcaaattgaaatttagagatttaacaagagagacattttcaattgacaaatcattggagatagcaattttacctaacccaattacctttcctttgctattgtctccaaatgtcactttctcttgttcattccctcctacttcaaatgtggtgaatatagccctatcaccggtcatgtgttgagtgcatccactatcaagcacccaatggctcccaccggtgcggtagttcacctacaaaagaagatcaagctcttttaggtacccaaactagtttgggtccttggaggttagagaccaaagctttgggcacccaaatggcattctttttaccaccgagtataggggaacccacatatctagcaacaatgttaccatcatgagccttcctaagcatataatgagaatcaaacatgcatgtcttaggaggcttacctccggggcaatcactcaccaaatgcccaacctcacgacacttggagcaatacttaccatttctcttgacaaaacgagtggcatggtgagaaggtttcttatccttctttggaatgaatccaagtccctccttgttaaggatgcaccgttgctcactcataatcttgtcaagagtgttattacccttgaagcatctctccaaactcttgttgagcttagccacttgctccttaagctcattgttctcaacaacaagtgaggcatcacaaatagaaacacacgagctagaactagagcaagggctaggcatatccataagataatcacaagaggtagaaatgctagatgatgcaacatgagtaatatggcaagtagcactatcatcaagcaaatcacaagatatgccaacatcaatgtgagctccatgttgagtagttgaaaggaggttgtcatgagcttccttaagcttctcatgagaaatggtaagtctctcatgagaggtctttagctcctcatacaagacctccaaagaagcatgatccttctttagggccttgaacttgacaatctccttctcactataagcatggagctcctcaaacatactcacaagctcatcataggaaacatcatcacaatcatcatcactctcactatcactaagagatgttaccttagaggaaccctttgccatgagataaagtggagcaaagagtgatggagcctccttgatggcaacaacgatcatcttcttcttcttggagcttgcatcatcaccaccttcttcctcggacccggatgaggcggagcactcctcatttgagtcccattccccgatgaaagcctcaatcttcttcccttccttcttaagcttcttcatgagcttgtagcctccactcttcttcttggatgacttgtctccatcatcatccttggaagggcacttggaagcaaagtgtcccttctcaccacactcaaaacacctcaagttggagagagtcttattgagtcttctatttcttctcctattggagttggagccccttcctctctcctttctccttcccgagagatcattgaaccttttagcaagaaggaccatctcttcctccaagtcctcattgacttcattcaccttactcttgctcttgtcttcaacttcggcttggagagcaatgcacttcttggagggtgaggcttcctccatctccttcttcttcaacttgtacatgtcattggtgttgatcttccccaagaggcttgtggatgtcattcttgacatgtcggaattgatgagcatggtgacaagggtctcatacttctccgatagggctctaagcatcttttgggcaacctcaagatcggtgtagttgccccaagccccttgagatcattcacaatgacattgagcctcccatacatgtcattcacactctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctcaaagagttgaacaaggcattcatggcttgggcattgagttggaggttgcggtgatcaatctccgtcaagggtgtgccggtgatggcaaagtctacatccacaatactccaaatatggaagctcatagctttgaggtgagtagatattttaattttccaagtggagtagtttgtgccattaaacatgggagccttccctacatggttcacctcgttcgacatcttctctctaggcggtgaagcccaatcaagagagaccaagctctgataccacttgtaggatcgagatgtcgactagagggggggtgaataggcgatttaaaactaaataacacctaatcaaatctaacctaagttgctaggcttggtgagggagaactctaactaagcaactaagttatgttttgcaaacctagggtgatagtggctcaaatatatctctaggaaagtaaatcacgctcctatgtcgatgttttgcaatcctagggtgatatgatctcaagtgtgtctctagaaaagtaaattgcacaaatgtaaatgcgacaatcaaatgagacaatgagacaagagatttttcaccgaggttcggaaactcgccggtttcctactccccgttgaggcgagcccaactccaccgctcaaccacgaagccaccgcacgcccccttcgtcaaggggtgggcaaggcgggagctggcccacggagaggactacccaagcctcgatcactcggggtagttcttccttcactccgaaggtggtgaactctaaaccactcacaaaccggcgccgggcctcctccacaatcttctcggagaggtcaccgggcaactcctccacaagccgtctaggaggcggcaacctccaagagtaacaagcaatgacccggtgtggagatgatcaagtgccacactagctctacaatggaagcaaatgcacttgactcttggctaaacaaccctctaacacactagatggatgaacacaaagctcaagtgagtgtgagagaggtgcaaggagtgtatgcaattgaattgggtgccaagagagcccccttgctgctggtgggggagtatttatactcccacccaccaaaactagccgttgggggcgaaattccccaactctgtgctctgccggtctgaccggaggtatgcggccggtcagaccgtgctactctgcaacggctagaaaactagccgttgtagccctgtcagagggccccatcggccaggctggtcagaccgacatggggtgcccggtcagaccggcctcggctcggtcagaccgccatcggctcagtctgaccgactacggctccgtcggctctgtatcggccatcccgagcagcatcatctcggcctccaggaggccggtctgaccgggaaagtgccgccggtcagaccgccactatgtagccggccggtctgaccgcccctggtcaggccgaacccagtgaatttgtgtaatgaaaaagagagcacaaatgaaaatgcaatgacctaatgtggcaattaaaatcatctctttgctaggtcattacccctcttaatagtgcggcgaaactaaaattaaactagcaaatttgatcgccctacacctcgatcaattctaagttaaagcgctagttttaccgtcttctttccctttgctttgcgccgtcaattttaatccatcgataatcatccatgcacgcatatgacgtggacctaacttaaaatgtatagctcaaagacaacggttagtccacaattagtgcttgtcattaattaccaaaattaacaccgggggcctagatgcttcacattctagcactaaagtgagagagagaaagagagagggagtggtcccaaagcactttttggcacaatttgctactatgtactagcaaatgccaaatgccaaattgccaatttttgctactagtgtttagatccaaaatggcaaaaagtgcttcaaaatgacaaaacttttgccattttggaggatctaaacagggccttatacaagcatgcaacatcatctataattcattgaattctagaaatcaacatccaatcattttccttcacattattaataattacatacaagacttatacaagcatgcaacatcatctataactagatgaataccccgccgcgttgctatgggaaattaagttgcataatatgttcaaataaaatgaaatctaaataataaaacttaaataaattgatacctatgaattttgaggcctaaaaatggttgtgattacttggtgttatgagagaagaaagaagagacaatttgaaccataaatctatcatctaatgactagaaataattggggtgatgtggcttaattagagaagagagaaatatcattaactaaactatataagtatataggattcattgaattctacaaatcaacatccaatcattttcctttacattattaataattacatacaaaacttatacaagcatgcaacatctataattcattgaattctacaaatcaggtatccataaccatgacagtaaccccccgacttcaactcaaatgaattcatgttgtcatccgcgttttctctgtcaacgttgtcatgctcacttggtcgttctcgataacaatcgagaagacatggagtactcaacatcattgaaacaagatcaatggtccacaagtgaatttgaattgaagtctaaacaactgccataaacgagcctgaaatcaacgcaaatgaacgagttgatgttctcgaccggagaccttggaacaacagtcgtcgtgatcgcttaaccgttctcagttgatcgagaaggtgcggagtatgtgactacattccttgtcttgtcgtaatcaagaatttgggttgaagtcaagaattttcatctcagcgggtacaccatcgcttcattccgtaatctttgtcgaactccaccaactgttctcgagtaatcgagtagttgtccaatcgttctcgagtaatcgagtagttgtccaaccattctcgagtaatcaagtagttgtggaatctgtgacaaagctctgaaatatgactatcctgaaatcaatactcagacagattgttagatacaaatagccccaagggtaatacaatataatatgaattttaaaattgaaaatatattgaatttgcacatgacaataaaagagtactctcgctaaagcttccatcagcaataggagtctgggactcttcctagcccccagctgtctttatggaaaaatcgtttttccacaaaggcagctaaatcttataacaaaccaagttgaagatgacgaaattctagcatccagccatgaagttgggaaaaccaattctgattacacggcttagttaatacgcattcaaaatagcacaaaggaacgataggatcgacttcaagacagggcgatataagaaaagaggatcaacggacaaatattacatatacaaacacttacagaggttgtcggagaatccatctcttgaacccatcttgtcgaaaccttgtagcaccaaaatccccatacctggcgtgccactgtcgacgtttgagatctcgactacggttattgcatggtatggagactgtcggtaccagggaatatgcgagattgagataaaagagatagatacaaggattttatacaggtttgggcccccttatgtgacaggtaatagccctactacctgttggccaaa

SEQ ID NO: 5690 - DNA, 2118 bp, Oryza sativa
cctagaaggagaggggacagaacaacacacagatcgacatacaagtcagaatagacaccaacacatgccgccaaacatcgacatcagagataagcctagacaaatccaatatggtgcctacggaggccgacaagagggatctagcgccatctctaatcacgatgagttcgtactcgagaaggaagactaccctgtcgtcgactacgtgttggttatctatgccgccaagtcggcgacagctaggtatgttatcccaaatattgtacttgtgtgattctaatgaatatagagcaacaccggctttggccaataggagtagggctattacctgtcagataagggtcccgaacctgtataaaatccttgtctccatctcttttacctcaatctcgcatatacccaggtaccgacgatctccatatcatgcaataaccgtagtcgagacctcaaacgtcgacacatgtgatactccaatttctaactactactcttcttgtactgaaacatactaatttttagcgtttaaaatttactaactttccaatctcatatatatatctcgtatactccctccgtttgtaattatattataagttgttttatttttttcatttatatctcatattctcaactaaattaaatttaagtttgactaagtttatagaaaagtatagtagtatttctaaatgaactaattatgctagatttaataaaattaatttgatattttagatcgttcgaaaaaaaggtcatcaacggtctgatcgttcgaaaaaaaaaagtaggtgttgagatgaaaagagtagtgaaagagaaaggtttctctaattttcttatacactaatcctgcatttcgaataaaatcatagtgctaattaaataccaacaaaattaaaattcagcattttttaattttatattcccacctaatgctgctaacctaggagtccagatatgaatgggatatatcggatatgattgctgacacaacatacataggggtacgtgtcatacataggggtgtctaggtaaagccgtgtaaagttttagagtgtcacatcgaatattatatagggtattgtatggagtgtttagacactaataaaaaaaactaattacagaatccatcagtaaaaccacgagacaaattttttaagcctaattaatccgttattggcacatatttattgtagcaccacattgtcaaattatggggcaattaggcctaaaacattcgtctcacaaattagtcgcaatctatataattagttctctttagcctatatttaatattttatacagttgttcgaacgttcgatgtgacagattgtaaaatttagggtgagatgtaaacaggcccatacttcgagagccactactagtgcaagcacatgcagatagaaagggccacatcataatagcctccattctgtaattgccacttgcgcaactcaagtttaaatattaattactcctccagtggcctaacacaacataatacttcctccattttctttgatgatagctcaaaattaaggtccctttcggattaaaggattgacaaatcagagaaatagaaaaaaaataaaattctgactgtaaaacgtaggaaaaatacataaatgattgtttgattgaaccacaggaaaaacataggaattaggtaagagagatagactcataggaaactttccatgaggttagacctcatgttaaaaatcctctaaaacttatatggatttgggcattccttaggaatttcataggattcaatatttttcaatcctttgtttcaaagggctatataggaaaaaaaatcctataggattagaatcttacaaaattcctatgcttttccttcgaatcaaagggtgccctaaactaaccaacgtcaagaaaaggtaacatgtcgaatgaagtactagattgctactccctctgtttcacaatgtaaatcattctagcatttcttacattcatattaatgttaatgaatctagacattgttggaattaatagatgggctaaggcccattcgaagattaattctttggaaaatcacaaaagcccacctcatgggatggcatgcatgtggagtttagtaccaccttgcttatt

SEQ ID NO: 5691 - DNA, 1272 bp, Oryza sativa
tttggaaacattccgaaaaatccggtgcgtgaaaacggcatggagtccggataggttacgcgcgacttatccggttcggtttacgcgggcgccctgatcaggcgatctatctctatataaaccgagccaccgccttcacgcagcacacgcaaaaatcaatctagggtttgcctcctactctgtgctgcgccgtcgctcgtagattacaccatcctgctcgccggcgtgcacctgcgatcgggagagcaactctccggaacctttgccttcgacgtcctgcaccgggagaaagcggcaataaggtttttgggaagcgctttgtgcgactgctccctgttcgtccacgacggctcgtcttcctcttcgctcgcgtgcttcgtgccttcgtagacgcctgcgaaaagtttcgaccgagcagccggtctttccgccacctcggtacgtgttcaatatgttgcgcatatttaatctgttcatgttatactgtgtagtttacatgtgtagatctaatgatgcgttcatgctagttttcatatataacgtcatgatttatttatggaatagattaaatcattatatgcctataatctcaacagatatatatatctatctagattaattaacatcaatatgaatgtggaaaatactagaatgatttacattgtgaaacggaggtagtataatttagaacagaagatattttttttaaaaaataaatacttaaaagtaagttatatccactacaaaatggttttcccaaacggctatattacattttcacaggcagtgtagaacccaacacccgcttgtccctagatgttcataaaaaatagtagcgattttcctaaaatgggcagttcaaccgtacgtgaaaaatggaattttcgcatacaaagcgttatgccgcaggactgcaaaaaaaaaaaaaaaaactactgccgccgtcgcctgaagcacatgcccgccaccacgcgctggttgtcgggaagggggagacggtgtactggtggccgctctagccgttctggtggatgcgtcatccccaaggctagtggcggcggatcgttcgctcctatctctactagcaaatataatattaggctataagccgactaaatgttgaggtggagaagagaagagaggagagagaggagaaagaggagaagcggtctgtaaacttacacccgacttggacacaagaatcaagaaattctgtgggagagacaagtgggtcctatattaattgtaaagagctaactattatatgggtgg

SEQ ID NO: 5692 - DNA, 758 bp, Oryza sativa
gctgaatgggcaatcaaaaaataggtgtaggaatgtttccctgtatgttggtcacaaagcacacatgtcaaattactttcttcaggtgcacaattcttcctatcaagcatgtctttggtgttcagcctgtcaactaggagtggccaaccaaacgctttttatcttcattgtacacttggtcttccagatccatttaagtgtggaatctgttgtgtaaacatgaagttccttgcataaactttctgtgaagaatatatatcatttccccaggtatacacccatttatcatactcagagatggggctgtaattgaagtccacaaattgcatatgtggcatctcttggtgtgcttgttccgacaggggtaatgcaaatgccaaatggatgtctttttgtaacgccatagcaattgactccagcattattctataaaaagaaggccaagaaatatcacgattttcaagttcattattttcacaattcctgaccaatctcaagggtgtatacagtatactactgtatagtatgataaaaaaaaacttaatttgtcaacagatggttacctgacaaaagaaaaatgtttcttatggctcatttgaaaaggaaaacccaggaaaggaaatttaacatttctgtcacagataatatagttctggggtcaaaccgaataagcatattctcaagtgaaaatcattaaaatttacctgcaagttgaagaaaataaaaatacatacatcagtttacttgcagtgaacctt
